United States Patent 10,240,205 (METHODS FOR ASSESSING RISK OF DEVELOPING A VIRAL DISEASE USING A GENETIC TEST) - sequence listing, part 11

SEQ ID NO: 332 - DNA, 118909 bp, Homo sapiens
attgcagaggcctctccgtcagtattgagatggtggaaagtgaggagaagcaaaaagacgactacttctttccccatttcccggtctggtctttttggggtctactacgtagaggtgcatcagccagcgctaccatggaggcaggaggcattcttttgctctcgtgtcagtactgacggggttgattaaggttgctgtgcttgttggtgtgggtattgggagggtggtgtgaaagcagttgggctggaatagagctggtcagtgtgtccttttgcgtgcatttgtgtggccctagtgctacagtggtgtcccttagctctgggggactgtctgaatttttgtgctctaaattattaatacatgtttatgtgtgggtttgccagaatgctgtgtccgttattgttggctccttggacagctctccttgttctgcttcactggctgtgaaattggttcacgtggtgggctctgggtccagcgagatgcatctgaggtgttgacctggtggtgtgggcctggggctgccagtggtcctgttgcctgatgagggagaccgttcctgaaactgtggcgcacactcaggagagtaggaaagagagcggagaaagccttccggttctgagcttgtggctcttgccattcctgacttgtttgttgtgcgaaccaataatttcctttttttgtttaagccaatttgagttgggtttacttgcttgtagtggaaaggttctgacacaggatctttattatatgaagtattttcataatgtacattgtgttatatattagacatatcacacgatctattttgtgatgtagtttgctttgctgtttttattctgtggaagatattcctgaatttctacacttcctatgaatttggaagtggggtgaggcaaagtcactaatatcggggtatcagtaggggagcctttcgaatcccaaacattggagtgtccttctgtgacccgtttctttgtcaacttttgtccgctaggcagagtggctgtgacatctgacatccagtgtgaaggtgtggtcactcagctggaagagaaaaacctagcactctgagagtgggtggatctgctggtgattttcaagcaatgtcttcccgtttttggatgctcatcccttctgtagttggagccttgttctcttttccttgagtacaggtggggctgatgactcatttcttatgaaccgagcacagcctgcctgactgctgaggctagctcataggattcctgaagctgcaggccctgctttccttcctgcgtgtgccctgggatcactcgctctgtggagtccgttgtccgttctctgaggactcaggaactgaggcctcctgctcacagccacgctgtggagctgtcttggtagcacctcctcagtccctgcaaggccttaggctgccagaatcccacagcttcagctgacatctcaacgacctcccctgagacccagagccacattcacccagctaagctgccctgaacgctgacacgcagaaactgagataacagatgcttgttgtttgggccactgagttttagagtgagttgcctgtagaaatggatgagcagcatctgtgcctggaggtgaagggtggagccaagtgcatgtctgtcagagtccactgctatccatcctttccctgcctgccttcctcctacacggtgctggatcccccagaggatcagcagccgagaggcttctgcgaaagaatgtgctccttcagggccgacttgcatttgtgtctttttttcttggagatttctgtaaaacagcagccgttagcagttatgtgattactgtgtttagaatttgagaagaaagggaaaaccttgtttgccatggaatacatactgtgttgataagtcttccttattttgaataatggagaattctctgtgtcttagccagctaagagctacttacttttatcatgttgtgttaaaatgataaaagttactcttcggtgacctaactgcttcacttaatgagttttgattttgtttttgcaggatgcatttcctctccttcaggaataagttctgttggggaaattatgaaatatggacatgttaccacctcctgctagatgatggcgtattaataaacagttcctacatttcagtgttttgcacccccaaaggtttattatgtcagttatgtgttagctgcagataaggtgttgctctgctccaagtgtctttcttcagcatccaggctgatagaacagctccattttgagccttgccattctcatttaaggaaaaaggataggaggttggctggaacacctgaaggcttccaaggcttctgcttagaaccagggtgctttctttcagcttggagctggtgtctgcctcttctgtcatattttgtccggaattggttccttctggtgggttcttggtctcgctgacttcaagaatgaagccgcagaccctcgcggcgagtgttacagttattaaagatggtgtgtctggagtttgttccttcagatgttcagatgtgtcagagtttcttctttccggtgggtttgtggtcttgctgacttcaggagtgaagccgcagaccttcgcagtgagtgttacagctcttaaaggtggcgcatccggagttgattcttcctcagagtaggttcgtggtcttgctgactttaggaatgaagctgcagaccctcgtggtgagtgttaacagcttataaaggtagtgaggacccaaagaatgagcagcagcaagatttattgtgaagagcgaaagaacaaagcttccacagcgtggaaggggacccaagtgggttgccgctgctggctcgggtggccagcttttattcccttatttggcctcggccacatcctgctgattggtccattttacagagtgccgattggtgcgtttttacagagtgctgattggtgcatttacaaacctttggctggacacagagcactgattgatgcatttttacagagtgctgattggtgtgtttacagacttttagctagacacagagtgcttattggtgtgtttacaatcctttagctagacagaaaagttctccaagtccccacccgacccagaagcccagctggcttcacctctcaatccgccctctaaataggagactccaactgctgttgggaattgggcagtgaccgctctagctacttcctgctggatagggatgaagaaggggccctgaagttgtagtgtcctccagaggagaactatttaggctagtgaaagggccagtgggtttgtccaggggcccttggtagaagttgttagttgagctcatttggggttccatttgtaagaccatctgtagcttgatagccttgattctagaggaaacacatttgaggaggttaaaaatacagggcccgaaggcgagtaatagcaagatggctgccacgggacctagaaaggggagaagccatgttgcccaactccagaggttcgtataagagtttgaaaggcattgtctgacttcagaagccttttcccgtaaacaccgggcagcatctcgtactatccctgactggttagtgtaaaaacaacactcttcccctaagaaggtgcagagtcctcctttctcagcagtgaggaggtctaggcctcggtggttttggagagtcactgctgccaaagagtctatttgggattgtagagtaaggatagatttcgttatttcttgcaaactgagaaatcctttgagagtgtgtggtagtaggataatgaagtagataaactggctactccggttcctgtagcagtagccattcttaaccctataagtaggggtattagttgtatggctctgcgatgacagacttgagctttgaggggtactgataaagtctgatttcctgaggcaatgttaatgttgggacttagaaagactaaggtgcaggtgcctgtccagttggtggggaggcagatataggtcgatgttccacataagaagaatacatcttggctgggtagacagaactggttgtgtatgttaaaaaggtgtgtgagtttgttgttttcattttcccatactcctagagtacttgccaaggtagctctggtgagtggctggaaaggggtgttgggagcaaactgagtggctccctgtgttctgttttcccattggagaaaaaactgttttgtatctactaggaaccattcattagagagagtgattgaaagaggggatgagaaagcattcactagtggtgggggcgctgctgcagggggtccaggggtgaatggtcatgcagggagtatgtttgccattacaaaacctggactgtttagggaggaggtgatgattttggggggccctgagaagtggacaagccgtccgcatggagctgtttgggtgacttggaagttactatgatcagttggggcttgaagttgtgaggtgtaattacactgatggggtggtaggtgccccaggggcaggcctgataacaggttgcattggatgcataaagggacatggaaagttaagatggtattcatagtaacagggccgtgtatgcgcttttcattgcttgtgtaatagatgaggttggaaatgtaagaacgtaaaagttggattgcacgtcctgttagggtattcttggtcttatcagagatggggaagttggctaatgattgcatatttagaagttggaaagggtcttttccttcataatgagggtgataggttaagttggtagagacccaggtttttgcaggaatgggagtggctacgtaagcagagattgatagatacaaagccaacagtcatttgtgagggaaggattggactggtttaacagagagtgggttgagagtcttgtagaggtatttaggagctagtggaaggggaggggtgattgtatgaggtatccaaggaagcaggagggatagatagtcaaagagtaaataggaaggtaaagagggtgctctggaagacgagatcattttatccaggctgagttaaaggtaggagtaaattgctgtcagaaggaaggaagatagaaagaaggttgataagattaggattttcgtcctagcaggagctgtagtatatagccctatcacaaagagtatggttagtatgctgcttaatcatatgatgaaatagtaaaaggattccattaaagggttaaggagaggtgttaaagattatgtaggttttcacttatcttttttaaggaggaaggggtttttcttcaggatcagtggtaggagcctttttagtctgggatatttccttccaaaacaggagatgcaagtcctccagtggttcgcaggtgtatcaaggctggtctggctgatcttgggactcctgagctgatggtcctgcaggtttctcagcgggtgtccaaaatttaactcgggtgtggtgaatccaagattccactcctgccaccttaactgcagtgggggtagagaggattaccgagtgtggtccttcctacaaagagcccatggatggggaggtagaggggagagatttgaccaacactagatctcctggttgaaacaactctgttcccttttctctgtgacatccttcaggtaggattttaaggttttgttgatattttgccaaagaagttatatctttgacgaagttggccgtttcctgatgaagtaggacgtcatttgtgagaaaaggtcgtccatacagcatttcatatggactgagccccattttgtgaggagaattttggattctcaacaaggccatgggcaaaagagtaggctatgggagatgagtttcttgtgttagtttcctttagtgcctcttgagtgttttgtttgccttctcgaccttccctgaggattgtggcctccaggcgcagtgaaggtgatattgtatccctagcgccctggaagggtaccgagttaccacggctttaaaagctggaccattgtcgctctgtaagctttggagaagcccaaatctaggaattatttcatgaattaggactttaatcacttcctgagccttctctgtcttgcgagggaaagcctttatccaatttgtagaggtatcaacacacaccaataattattgaaatcccttcgacttaggcatatgggtgaagtctaaatgccagtcctctccgggctagtgacctattctttgttcccttagaggggacttatgatggaccaagggattattcctttggcacacctcacagactttgactacctgtcagatggtccggaggagatttggccctgtaaatagggatttggccatttgatgagtgttttcaatacccatatgaaaagtttgttggagggttttaagtattttccactggatggctttgggtataagtacctttcctccttctgtcattaaccaccccgaggggagacaactatgcccccgtgaaagtccccattctgtttcagttggggaatactggggcttaatctcttggagggggttgttccataccaagggtccttccgtaggtatttctaatgggaggttcctcctggcagcaattttggcctcagcatctgccctgcggtttccttctgccttttctccttcacttccttctgccttttctccttacactttggcagtgtaagactgccacctccttgggtttttgcactgcgtgcaatgactccataatttccttgtggtatttaatgggggttccctcagaggttaggaactccctttctttccatattgcagcatgggcatgtaggattagataagcgtacttgctatctgtatacacatttattctttttccctttcccaattccaagtctcggttaagtgccactagttcttctaactgggcactggtccctgggggaagaggcttactttcaagtgtcgttacatcactaactatggcataacctgccctttgtattccattgtccaccaatgaacttccattggtatacaggttaaggtcaggattagttaaggggacttccaagagatcatctcgggcagcataagtctggactataatttgttggcagtcatgctcgattggttcgccatcctctgggagaaaagtggcagggttgagggccacgcatgtacatatttgaagcactggtccctcaaggagtagtgcctggtatctgagtaggcggttgtctgatagccataaacttcctttggcacctagtatgccatttacatcatgagtagtccagacagtgagatcctttccttgtgttattttgatagcctctgacgctaagacggccaccgccgcaactacccttaaacagtgaggccagccttttgctactacatcgatttccttagttaggtatgccaccggttgtggggttgtcccacgagtctgagtaaggactccaagagctattcctgctctctctctgatatataaagagaagttttgtcctgtgggaaggcttaaatctggagcttgtactaggttctgctttttaaggttttgaaggctgtttctgtccctggttcccattctactagatgaatatttgccctctgggtctccttgattagagtatggaggggcctggctatctcgctgtatccggcagtccatagttggcaaaacccagtgattccaaggaacccctgcaactgttttaatgtcttagggtgaggataagccagtataggccgtactcattcctttctgagggccctggtccgtctggctaagattaggcctagatatttgacctgctataggcaaagctgggccttcaacctagatgccttgttcccttgatcagctagaaagttcaggagatctagagtagcccactgacatgaggcttctgaactggtagcccaaagtaaatcatccacatgctgaaggaccagagtgcctggacttgagaagtggcctagatcttgggccaatgcctgaccaaacaggtgagggctatccctaaacccttgggccaagactgtccatgtaagttgggatgtgtggtctgtgggatcctcaaaggcaaagagaaactgtgagtcagtgcaggggaatacagaaggcggcatccttgaggtccagaatagtgaatcattctgcttcctctggtatttgagagagcagggtataggggttgggtacaactggatatagaggaattactgcctcattgatgagtctaaggtcttgcactagtctccactgacgattgggtttttgtacccctagaattggggtgttgcagggactgctgcatttccttactaagccttgagctttcaaatgtttaacaatatcctgtaatactttatgagcttcaggccttaagggatattgcctctgataaggaaaagtggtgggatcttttagcctgatttggactgggtgggcattttttgcccttccagattgtctttccaatgcccagacttcagggttgattccctcctcaagtaggggacaacaaatgggtaacttgttccccatattcgtgtagataatagctccagctttggctaatatatccctccctaataagggtgtgggactttcaggcataacaagaaaggcaagtgaaaagagcaaagtcttccaattacaactgaggaggtgggagaaatacctggttacaggctgccccaggattcctcggatggtaacagaccttgaggatagtcgtccaggactggagattaacactgagaaggcctcgccagtgtccaagaggaagtcaatttcctggccctcaatggttaaatgtacacggggctcagtgagggtgatgacaagagctggcgcttgctctgggcaccgtcagtcctgttgttggatcatctggttgggggcttctggcccagagaaccattgcactctggggcagtgcgccttccagtgattgcctcggcatagcggacatggatgagggggtggcttctcgttggacagtcttttttaaagtgtccttgtaaaccacactgataacaagccctactgggtgattggccttttccattttctgtcttctctgaaccaccaaggtttgtctgtctgagggccatgactaaggctgctgcctttctctgatctcgcttttccttttgggcctattcctcttggtccctattatagaacactgaggttgccaggtttagtaatgcctccagattttgttcagggcccagggcttgcttttggagctttctcctgatatctgcggctgattgggtaataaacttatcttttaggatcaattgaccctctagggagtcgggtgacagggtagagtattttcttaaggcctcctgtagccagtcgaggaaggcagaaggattttcttcctttccctgagttatgctagacatcattgaataattaatgggctttttcctaactctccttagtccttctagaacacaggtcaacagatgtttatgactccagtccccatgatctgagttgagtcccagtggggatccatactggggacgacttgctgaccggtagggaatttgtccctttcttcggctgtcattctgtcatttacttgactaagataccaggtatcaccaaactctcgggctgcagctaaagctgcattcttttcattaaagactagggtttgatctaacaatagcatgacatctctccaagtgagatcgaaggtttgccctagaccctgtaggaaatctatcaggatcatctgaaaacttccccaggtctgcctggatctgctttaaatcagagagggagaaggggacatgtacccagcttgggccaaattcctctccccctacagcttgaaggggacataaccgatagcccgggggtttttgtggtcccttggagatttctttgcttatttccttctgggcaggggagattagaggaggcttatcattaataggaaggggagctatagggaggctaggatatgggggtaagctgagaggtcctcctgtgggacataaattgcaagctttgcatattctccttcaatgaaaagaaagctggacataaggtatttcaatccatttgccttccctcttacagaaaaggtcaagctgcaggatagtattgtaatttatacttccctcaggtggccatttttacccatcagagagagaatactggggccaagccatagtgcagaaaaaaataagctgcctctttttcagggtttctgggtcaaattggtccgaatggcttaggatgcatttcaagggtgagcatgttgatgcctgagtgtttcccatctgaaagacaaaaccacctgcagttttggtttgtttttctccccctgcccaagaacctataatggtccctggaccctgctgatcggaatagttgcgctcaccgacgcagcagcagaaacacctcttgcccaagaaccctggaccctgctgatgggaatagttgtgctcgccgacgcagcagcagaaacacctcttgcccaagaaccctggaccctgctgatcggaacagttgcgctcactgacacagcagcagaaacactagtttccctcctagaccacaaggaggactgaggaaggttggatttagtggcccttaccgacgcattctcgtaaaacctgcaccttgcctgtcctcctagaccacaaagaggactgagaaaaatcagatttaatgacccttactgacgcattcttgaaaacctgttaagagtcctaagcgttctcctgttagtattgggactttacttgtgtcctataaagatgttatgcccccaaaatgaagtggagggccataccctgagggagagaagggatctccagggttggaagagtgatgccttttgtcctcacttatatgaataggaaggatacaatttctgaggctccccatatcctagcttcaggaatagcttttgttaggcctgcttgtctgagtaggggtgctaaaattccagatagtaccccctatgacagggctttgggcaaaaattatgtctttctgattggcgggcccgggtgcctaaagaagggaacagagtcctgaaactagaaaagaactagagacagggagtggtttttagaagcaggactagcctcagagaagagaggtgagaggacgtttgtctgacaggcattaggacccaggaggcaagggtcaggatggataggatagatgggcgagtctcacttgggcgacataactttgagagttccgctcatggccacagggtcaaccagcttgttgttgggaccccggagttgaatggctttcctctctgttgaccgttggctcagcctggaagtacaggagaagtggaagctggtaccaggcaaaccaccgctcccaactctgaagagtcgggggttgttagccctttcccagaaagcctgacacgcgtgtctttagtccggtggctgtgctagttgcttttaactggccgacaggtgcctggtatttagcccccgaattctacggaaaaataggacagaatagcaagcaaaaggggtccgatgatactcactgcttggcgatagtcccatctgggtcgccaaaatgtgtccagaattggttccttctggtgggttcttggtctcgctgacttcaagaatgaagccgtggacactcgcggtgagtgttacagttcttaaagatggtgtgtccggagtttgttccttcagatgtgtccattccttcagatgtgtccagagtttcttccttccggtgggtttgtggtctcgctgacttcaggagtgaagctacagaccttcgcagtgggtgttacagctcttaaaggtggtgtgtccggagttttttgttcctcctggtgggttcgtggtcttgctgacttcaggaacgaagctgcagacccttgcggtgagtgttacagctcataaaggtagtgtggacccaaagagtgagcagcagcaagatttattgtgaagagcaaaagaacaaagcttccacagtgtggaaggggacctgagtgggttgctgctgctggcttgggtggccagcttttattcccttatttggccctgcccacgtcctgctgattggtccatttttacagagtgctgattggtgcatttacaaacctttagctagacacagagctctgattggtgcatttttacagagtgctgattggtgtgtttacaaacctttagctggacacggagtgctgattggttcgtttttacagagtgctgataggtgcgtttacaaacctttagctagacacatagtgctgatgggtgtgtttacaatcctttagctagacagaaaagttctgcaggtccccacccgacccagaagcccagctggcttcacctctcaatatctcattggtcagagaaagtcatgtggccaggcctgcccctgcctgtaggaagctgatgggcatcactgggctggatgtagactcctcctcgaagggcagggggagtgaatgaaagcagccatactgtctgctgcagtgagcctgggttagagaggcagaggaagttggaacatagtgtactgaatgtgaaaatttaagtttgggtcaatatcagctcttagaacttttgtctgctgaagcctttttattttagaataatactctttttgattgaagctgtcctggaaaccactgtggatatttctgctagtagtcgtcctctggtcagaggttttcatatttgggagcacaggtgactataagctccctgatgttgcctgtgcatacttgtaaggttaccctaagggccttagcctgccagatgcttgctggtgaccagccgagccccatcttcctcatgtccaaatgagtcctccttttgtcaggtgttagttcaggaggtaaacttaataataaatgtggctgctttggtgtaaccataaaatgaggaatatgctaaaatagaattcctttggaggcatggcaaaaattaaggctggaagttgagtctgggccagattgtagagcctttgatgactggttccagcatctttggcttcagtttcttctgtggggttaggagttggagtgctgggtgcccaggaacaatcagcctgggcctagagactggacagcagtggggaacgggcaccagacagtgacctcctgatatgcctgttacagatggtggccttaggtccacatttgcatgggctcacccctcttccttttttctgctccaaagtctgtgcctccattgggagcacatacagttgtcacccactctgtgaagccctttctgactcatgttacgggtacttgctttctgccgccgtggactactcggtgactcctcctcctcttcctcaacacctagggcgacttttccctaccatctttctgtgtctgtggacatcacctctctcggcccctagatgggaggggtccttaccagccttgggctgcggcctctctggggagagcccagtgccctccctgctgcatccttcattttcctcccggtcatctccaagccgagcctcctttctctggaaccaagtgtgggagatgcagttgtggtacaaaggaatgaatgcccacttgccttaactcatttttttttctcttattgtcctgtagccagctgctgaattcctcaccactcaccttcacctttctctcgttttctgttcagccagctctcttgaccctggtgcttccttgctcgaaatcatgtctttttttttttttgacaatacactgtgtcagaggaatccttgagttttacaactggaagtgactttagaggttagctgattcagcttctctcccttcccaggtgaggaacgggacacccacagctgtgtggagacttatccaccctgcaggtgccagctaaatccttcaaaatgacctttccaaaattaacgccatgttctgacatagccaaaactgtaatgtctgtcatacatgacaaggttagtattgatgtctcaacaccatctgatacgtagtctgtatttacatttccccaggtgttcccaagtacactttgtagatggtttatccaaaacggtccagtgcagggccccttctggcatctggaatctcttgatccagagcagtcttgttttccatggcccagaattgtggacagacttaatgtctggcttttgtaggtgcccagaagctgcttgttcagtgaagacatggtaaagacaatggggatgagatactgaagacatttttttcttctttggctcgggggggatttccctcagtcttaaatattaatgaagttcggccttcaattaaaaaaccatgcccttggtcgtcctccatgccattgtcttctgaacctaggacttgatccccaggcttgttggctccttccagtctctccccagtgtttgtccaaatccccatcgtcccccttgttcctgtggctgaggttctccgacctacgattgcagaaatcttcctcagatagtttctctgcgtctcactattttcttctatggtttgtatagtttagcaccttctagccattctattttatgcccaaatcgctttatatatggcctgtgtatttcacagagggcaagataattttcctaaacagtgccagctacaattcagcttcctaagaagcaatttctggaaagcactgcaagagaaacgaggtccagtaaacatactctatgagaatagagttgagaaagtcattgtactttggggcttcattttatctctaaatgagagggctgacctgtaagtcatgtagatgattcttctctctgttcagtgggctttttcttgtggttattttgcatttttaaaagtaagagttttccttggcagaatggagttatctgtaggtctgttttgataagtgagatttggtgtgcccttttctttttgaaagtgtggggcattccagttgctgcttcctgtcctcaagcatgttcccctttccctggtgaggatgagaagtctgaggtctaaggggcccaatgcagggctgtagcaagcaggtggtcagggaggctctgctccgtagtctcagccctcttccttcttccagcaccgccgtgtccttcccacaacgtgccgcattgtgttgtgcggttcagtgttagaccatgggaactcccctccccgccacttttaagaaggtatttttctatccttgtttgaatactctgggcttcttttatccctgatttggtattgtatttgattatgtagtttctattgagagcaaaataccaaaaataagctaaggaattttaatgttagttttctggtggaaaactggtaggatgatttcattttgggagtatcggatcattctattgcacatttaattcacttaaatgtaaaagtaagggtgagtgtttgaaatacgctttttcaaatggatagatcctaaagcgtattatggtgcgaagtgtgtctgtgcagccacccttgtccccagcatggtgcctgtgtggggtagtgcaggtggcaggaagtgtgcctgtgctggcattgaggcttcagctgggcaggattcctaatgaccttccttacctcaccaggagcgcttctcacgcttggctgtgtgttggagtcacttggagagggttggcattttgatttgagtctctggactccagaacactgctggagtatcctgcccttttacagccccccaggaggtcttaacatgtagctcctgctgagaattgctgctcctgaggctgaggcttccaaaaggaggcctggagacaatggaatatggtttgtacttccttccctcctgctgctccttgccattgccaagagtggaaatactgctaaagcacccagcaagtcatggtggggaatgaatgaatcccgtctaagacacttgttttaataaccctagggaacaatttagtgtgctaaatgtcatggtaattcttacatacacactgatttactttttgcagagagatttctataaaagttttgagacttccctattattcccatagtacaaaatttctctgtactcagatttttctgtttctgttttttgttgaatagatttctattttaggaaatagtctgttatctttctctagagaagcacttcaatcgaaacattttgttggctgagaatgtgcattttccccctctcaggggtaaggatttgcctcatctcattgtctagcttcctgttgagaagtgtggtgtgtgtattcacttaaactctgatgtcatattgaagcccattggtgggcagtttcagccaatcagatgcttcctgggtatccaagtaagaaagatatatagttctggaataacaggaaacttcacatttttcacatcctgttattctgggttttgtgacttgctgccttgccactatgaaggttagtagaaatttatgtatgtatttctttttgtagtatacaaaattgacaaaataaaaaatgacttgaattttcagagcactaagattagatctgtagagctgaaagacattcagatctcctatttaaaaatgttatgatgaagagaaattttatgttttgcatataaggaagctgaggcctatttaattccttttaaaaaatgcagcttaacccgtatttgttataggtggttatgtcagcctagatgctgctctcatttgagttgggatttcttcttaaataataaatattacaacaaatgtattctgtatgaaagatgattctaaagactatctgttctaaggactgttttttaaaggaaggatttagcttcatgaaatcagttatattttgtgccttttgttagaaatggcatcggtaagcacatagaatgcttagatgtgttcacagctttccttttacgttttgtggttccatctgatatttccttgtgaactttaagaaagtgacctctggttttcagctcctttcttgactcttttagtgatttggtgggtttttctcttgaggtagtttttcaaagtctggttcttctttatttatgtttaaacatctcatgactatttttacttatttggaaaattatagacagaaggcctttagctgcagatgaattttgaataatacagcaggactttttcacatttggtgtcacttttcttagcttctcttggcgtgagcttcattacagcagcatgcggtgcctgcagggtgggtggctggttggatgctggtgcacgtctccattcggatgccttttcactgtgcaccggcccctgtgctgggtgttgggagatgtacaatctgccactgcagatttttagtctagggaggcctgtagacatccaccatcaaactatcatgacacgtgttctgggggagcctggctggggacctgaccgggtgtggtgggggcagccaggctgtcaaggcagggctgtgtcaggaagcaagatgaataaggattagccaggaaagggaagggaccgaaggcaggaagaggaagaagtggggcttctggcagggtctgctagaggtgtggggagagggcaggactgacaggaggagacgacagccctggagagaaggtggggcccttgtccactgatgcttatttccggtaatctcagttagaacatatggcaacaggatacacgttttggtttttaaatgtatctttctgttattggcacctctgaaagaatttttttcttaatttttctggaacatagttgtggacgatttgactgtttatctttgcttgaggttatttggtgatcagaagccatatgtagtctttgggcagtatctgagatgagagctctgtttgttttgacatggctgtgtgtgtgcacacgcgttctagacactagttgccacatacctaggcaaaccaatgtgctttacctttccaagctccaggatggtggtgggaagtgcctgccagtggcaatgtgaccagctccatcgtggtcccagggctctagatagccctggactggaggggatgcggttgtgggcttgcctggttctggcctcagagctctgagggtggtggtctcttgtccctgcccctttcctatctgggatctgcttctcctgtctgtcctccttttaccctcacatccactctgctctctgatgtccgcattttcttttgctgctgttagctttggaatcgactgtcattttcccttattttctgtggctaggaaagaacatctgtagcacgccttgcctggggcctctgtgttaatctaaggagaggaggattgcgcaagcaccgtgcttgcttgctgaatgccagcagcccacccccccaccccgccccgcccccgtgaatgagctcacactccagaggggcaggggcgggtgttgggtagggaattggcctaatgccgaggggggaccctgcacctaagtaggagaattttgattgggttcttacctcaggactgagagactgagcgtgctggtctccctgtcgcaggttgtgcggtctccttaggatttcaggctgagcatcgtcgcgttgctgggagaacttagttcatcctgcacccaacataagactctactaattttgcttgtttaatttttcctttcagacgtttgatgcaaatgatttgtatcaggggcagaattttaacaaggtcctcagttccttagtgactctaaataaagtaacagcaggtaagactcttttttattgaactcgagggggtgggaagacatacgggctgacacctttggttttcttgttttaccaaagccaggggagcattactgaatttaaaaaataagcttttgttgcattacgttttgattgttccttttgctgtgatattttatttgccttgttagaatagaatcttctttaaatgttctggtatatatcaggtgttttcctttctgtgggtggagagatttctcacctgaacgtatagcaggagaaaagtgtctagttcttatgggaaggctcatgggctgtgttggagctagaagcacctttctctcagtttttactgagtgtatgctggttaaaatttgtatctagtgggcagaagttttgagctgtgaccatgataagggagtggctcgtggattggcctgtaaagtccacactacctgtccagggctcctgagggctgtggcacccaggtacatggtgtgtgtggtcctagcccccattagtactgaagtggagaggaggttttggggacatggtgtgcccctctcatgggccacagcgaagacaggagttgttcagacaggtcctctgagggaaggtgcatgttgtccatgatgccaaggtccccggaggaaatgctccatgagccctgaggagctctttcttggatttctgtgtggctcaaaaggaaggaactttttagttgcttttttggtcttattagagtaatttttttttcctatttaccttcacggatgttaaatatcaggtttgtgggggaaagtgccgtgtccttttcaaacagaaacctcctgagttgattttgtcggggtcgcttctcagcttcgtctggcccttcagaggggggggtgtacttgcctcactgcacattgaggagagacgggggttatgcatgctttggggctgcagttcctggctcccggaggcttcatcggtggtgcagggactgtccttggtgctgcctcccagcgcatgtgtgctctgactgctgtctggaagctgatgctgctgctgctgatgctgatgccccggcgagaggcactggcccccatccctgggagcaggggcagaccccaggcagaggtgtggctgtggctgcgtgttcacagcttgacttctgaggtttaaaggactgttcagatgaaagcatcgaggaaacaaaaatttaaatggcaggattatgaagatggatgtaactaatgaaaattgtcacattatttaatgccttctctgtctctacaatctaaaaatgatccttttaatatgaacaaacaataagaaaatcacagccgggtgtggtggctcatgcctgtaatcccagcactttgggaggccgaggcgggcggatcacgaggtcaggagatcgagaccatcctggctaacacggtgaaaccccgtctcaactaaaaatacaaaaaaattagccaggcgtggtggcgggcacctgtagtcccagctactcgggaggctgaggcaggagaatggcgtgaacccgggaggcggagcttgcagtgagccgagatcgcgccactgcactccagcctgggcgacagagcgagactccatctaaaaaaaaaaaaaaagaaaaagaaaaaaaaagaaaatcacttatctaaagttatggatgacattgaaaaggacatacatttagagtggatcactggaatttaatacaagaaatactgcaacaggtgatgtacagaagtggcatattcatgtgtcctgaccacatgggggaatctgcctgcaaactcatattcatccatgcctcagagttttgaattattttttatggaggcagggtcttgctctgtcgtccacgctggaacacagtggtgtgatctcagctcactgaagcctcagcctcctgggctcaggcagtcctcccacctcggcctcctcagcagctgggtctgcaggtgtgtgcctctgtgcctggctaatttttgcatatttgtagagatggggtttcgctgtgctgcccaggcttgtcttaaactcctgagctcaagctatctgcctgccttggcctcccgaagtgctgagattacaggcttatgccaccatgcctgtcctaaatgatgtgccttataattaacgtagatctctgtggcagatggggcaatagcacagatatgtaaaatctacaagtaatccttaatttgactctgctcccattgaatacttttttagaggttgctcacaggagcagaagatagtaactttgaatttcattgtagatgttttctctgcttttgctgtaagtgggggtgctaattaggacgaagtggctttagaacatggctttaatttgtacactcagtcttgggattgtcaaccatctaggtttgagacggtaggatttacaagtaaataagagaagtcagaatccagtagctctcaggctattagtttttacctctaccttatggaaatgtattttgtatatgttcttggtatcattggctatgtgttggatgtaaaatagatagctttgttctttacaaagacaaatttggaagttaccacataaacttggtacttttaagcttttaaactataggaatgacccctcctagatggaaggaatgctttgcttttctgtttgccctttgtttttgtttttgaagtcagtgggaaggcaatacccgtacgttttctttttgagacagagtttcgttcttgttgcccaggctggagtgcaatggcatgatcttggctcaccgcaacctccgcctcctggattcaagcgattctcctgcctcggcctcccgagtagctgggattacagacacgtggcaccacacccggctaattttgtatttttagtagaggcggggtttctccatgttggtcaggctggtctggaactcccagcctcaggtgatccaccagcctctgcctccctaagtgttaggattacaggcatgagccactgcgcctggcctcgtttctttctagatttcagctttccttgattggcaaacagtaagacaactgcagcagccacagttactgtggacattcttgggaaaattgtcattgtctttctgcttctgtctcttaaaatcatatgtgttctcaaggcatttagttgactgtaactggccttttaattggatagaagaaagcttggtgatggggaagtacagaatgtcttcaggatggccctccttgtatgagaatttcctggaaggctgtggccagcagagcactgcagaccatggccgggagccctgtagaatttgctggaaatgcccttttagctggttttgtgctgcgggttgcctgagacccctgtgttctcaagcagaatgtgctctatagagattactcgtaacctgccctcagcaggtcctgggaagtgtagggtgagggggtgacctgagaagaatttaagatcgttggagtagcaagcccccatctgtggggtcaggcaggtggcgtgaagggaggagctggatggaagggcatgggtgctgggtcctctcaggacagcccctgcccagctctgagccagctttacctgatgggatatagacctggtgtggccacatcctaaatgtgtcaagagcagtggggaatctgggtttttggtgataccttcagacttttcgatgttgaccgtttaattcagaattttataagatacgtgcaagccaatccaaacacctgggaggaagctgggacctggagacttagggttgctttcatggaagcctccctggagtttaggacatggccgggcacgtgcctctcagaacagcgattttcccagcaaagtttttcacagcctcattctctcttttttttaattgagtcacttttaagaataaattgctattatttatttgttggatggcctgtgtggagtgtcttatgaagggagatccagagaacagaactaagcctcttactgtctgtttactttgattctgtcagcaacttcatgaggtgagtagagcctgtgctgccttagtgttggggaaataatcctcacaaggttctctctggctgaaaaatacactggattttctcttttaaataagagtcttttccttctgttgcttattgcatgacacatcgtcctggaaaagtgggcatgtggtggtgatgctttggagaatcagtacttggttgttctccgctccataatcaaatttgagaggcttttttttccaggtgaagggaaaatctttaaaagttataatacatttcacaaacttttgaaaattatattagagaagaactgattaatagttatctccagataatttctggaaaggtagttggggaatgaatgcaagtcatttatgtagcaaataatttgttctttgttttctgcataaatgggctgctttgttgtggtcttttggtgtgtccctctgtgctgccctagttttaaagtctagtgtgtagtgtgggtgcgtggtatcaggcgctctcagctctctttttctgtgtgcatgctctttgcagacatcgggctggggagtgactccgtgtgtgcccggccctcgtctcaccgcataaagtcttttgactcccttggatcacagtctttgcacactcggacttcaaaactgttccagggccagtatcggagtttggtaagtttgagagattttgttacttaaatatgtttgggaaggatatgagtgtgtatggatatatctgagaagatacgtatgcctccattaatggtgttaaacagggcaaaggtagctggacttcgcctccgttgtgcctgtaatctggtttggcatttgctcattaccagatgatccagatattatgcttaatgattgcttttgagaaactcatttgtttttaggttgtattgcaagactcatgactcgatatctggagtgatgctgctttaaaaaaacacaccccttgtcatttgcatggcattatcagctatgcacatgtacagaaatattgagaataagaaatatgtatggaaaagtactcagctccgtaaagaagagatggttaaaactaaagaatctggcctttcttctcttcatgaaagcatggcttagtgtgctttactaagtcaggatttagtttacaggggagggaatcccttagaatgactgattgggacgcagagaaagaaacttagatgatcgaacagttgtcgtggagagtgaaaaaatactcgtttaaaaatgctcaggatacaggctgtgagtaaagcccatggaatgtaatagtgaagttgaaaatgagaaactcaagcagggttaaacagggctgcctgtagagtgttggggcagagccagggctgccactctgcagtcctgcacccttctctgagctgcagctggcgggcagtgacttcgattggctgctggggataccactgctttctcgcgacagtacatactttgttagaaacatagtgatcttgtaacgtgagtctagagagaaccctattctagagtcatgaagggtccatggattttcctctgccttaacatgggggagtattgctaagtaagctgatggtggtcctcaagaaataaaagttaatttagatagagtcgtgatttgtagagggaaataaattacagtggtttatgaagcatgtgtgaaaaatggaaagatatgcgaggaatgtgatttttatgtttctgaactttttgaactcaagctcgctatcattgctgtgtctcctcttagaggatccccgaggggtctgactgcttcaggcgtggtgggcggtgggctgcatggcctgagtgctgcagtcctcacagcagccccgagaggcctggctgttgctgtttcctgctttgcaggagcctgttctggaagaattctgtggactaccattgggagcattaggattccaagttaaagaggactaaacaaaccactttaaacacacttgaaatgagctctgtaaaacacatgaggaaaacataagagaaatcagctcgccttgggtaaagctgtgatttgctgtctcacccgttcactggtggcaattttcatctgatttttttttctttttgagtagaggactagattacaaatgtataattttaagtaaaataaagttaaatgtaatgtttgttggtaatgttactgagatcatagtaagtattggattaatttttcattagctgctgaaatttcgttatactagaaatagacttgcgctctctgacctgtgtgaagtctttttgggctgatgttttgattgggtgctagagagctgctttctctttgatggaatgtgcaagacctctctcagccatgctaggtaagaatgaatgtttctttacccttaggtttttctgtgtagtttatcgatagcactttgtagtagttttcttggattaaaaattaagaacttatcttgaaacaagaatggcctaacattcctttgaagctgggcagtggatgcatggagggccacctgtcactctctccttttgtgtgcatttgaacatttccatgataaaaagttaagctaaaaggcaacttgcagtttcttgaatgtcagttttgagatcatattaaacctaagctttgagattgcgtaagacgcttccatcccccaggcgaggatctgtgttctgaggggctggtgttgtttatgcccctttgctcttgtgttgctccttcattacctgcctccctttcagtgtaagaatgtgtcctccagccaccactgcagttgctggttgtttttataagcttgtttttcatctgtgaaaccgtcagccccctgcctcgggacagatttcctgtcttgggatataggcaggcttgaacagtttgatgttgcgtttactgctttgcactgcagtggaggttttcacttgtctgcggtgcccctccaccattccaaggaaagaacagtcaggggagagttcttacccacttccagaggctgaactaaatcgagctctttatccagttcggctctgtgatgggcctcggtggtgaagaatgtggtaggcgccagttgtagatttaggtatggtttttctcatagataaggcatgagttcatacttcactctttgttcgacaccgctggaattcctggtgactgctgtgcttttagtcttcaactgctggctgctgattggtacagccttgagtgctgaatgctgttctcagagtttggggatggcgtttgtgaggtgattgtccccatcatccttcatttctgggagaggtgacttgatttcttaaagtgctgcttctgcttctggaaaccagggacctgtacgtctggcacagtcctgatgctggcagctaaccttggctttggaccagtcaccgagtgtatttccaagacatgcaagaaattatatccaaatgtattgtacacattgttaaatattttcatataccatattttgtcaattcaaagacttctctttttaagtcattttaacacatctggaagtacgtgtatcttacagttgatggtatgccataatgtaattgacagtatttggtggaatataaaggcattgtctaatttttggcatcttatattggttgacatgaggaaactgaagcttagagaagatatttacccaagatcacagcactcagaaatagtaaagttggagtaaaaattgtgtctccgtcctttggcaagcatttctccttctgtaaaggaaattataggtgctcttagagagcggaggagagggtattgttggtgtgaagcagcactccagagtgtcctggttttggattgttagggtaatttcagaacatgggatacaataaagtaatcaggtgattaatatccaagatactgatgggtggtgctttggctccaggcatcagaaagaggccgttaaggagcatggtgggcatagatgactgtgcccggccaggtcgtgtgtgcctggatggggtctcttctccctttgggttagggcagtgggggaactgtcttcactcccctccagttactaaattttattgacacgtaacgtacatagaaaaccagttcatgtattgtgtgcatacagcgtgatgtattgcatgatgaagttttatacatggaacattcccgtgtaagcacccagatgaggaggcagagcatgaccagcctccaactcctcgatggagcttgcgttccccaaggtatctgctgtcctgatgtctgatggtgaagatgagttttatccatttttgtattttttttagcaatgggattctgtggcatatccttttgttgttgttgttgtaacgactggcttgtttttctcaactgaatgatttagattcccttagagtgtcatgttgagtccagacaggtaacaagctacagtttcaggagagctttttaaaaaagggaaaaaaaccccacaatgataaaatagtgatgaaatccatctcttccagcttcctgtaacactactgacagtgaacggacccctcactcagctgccgtgattttaggctgaacgtggtagtatagagtgtgtagttggaatatagccttttctaggacacccttttccagccagtcccatgcatcttgcgctctgatggagcacttcttggcatgttctaagtaacctgtcttgagagtaataggcagaaagaacattacagagcccacatgtccttcagtgtaatgactgctgaagaatggaggtatgttgcgacgtttcacctggatacctggatctgaaacagctgcctgccccctgtacccttccttggattccccgctctcttagacgccgccctttctttctggggtgttgcattgatgaagtaatgtcagtaggcgtgcctccctcacccgtaccttaagtgtagagcgtgcatgcatttgcacactcaagactgaggtggaactccgctgcctcttgatcatacctcatctcccctctgcttccattcaggcctgccctggcctcagccctggtgctggctggagcctcagggctggccaagggtgatctcgggcacctgacctgggaaggggcctgctgcgcctgcgttgctttgctcaccacagctgtgttctggcattggagctgatcaccagggtgcatgcactgtgagcctgttttccacaaggccggcgtgcccaggtgacgttggattacttacaggagagcatggtcgcgatcacagcagacagctagtgagtggagatggtggtttgcaaaaagagaacttgacatagcacagtgaactcgggtcacgtttcaccacacaagagcaaggaacacgtgacagtttctggatgggatcttcagttgcaatggcaaacttgaccctgccccttgttggtcacagggcccagagagctttgtgtctgcgctggtaattgttcgctggcgcttttgttgccaaacactgaagagaggcttcttgattaaatatgaaatatgcattaagtatttcacttatgaatttgaattactaaatacatatttataattaatacttaatctgtaaacacatttaaatagataagtattaaatatttttggaataatattacagctactccttattgaggatctgttgtgacctctttgctttgatgctttaccttttaaaaatgttttttttttcagtgatttatacattcacttaaagtcaggtgattcgctgagacctgctattaggaaaaaacagtagggacggccacttttaatttttttccactagttctttttttgttttgatttttatggtgcatagttcatctatatttatggggtacacgagctgtcttgatacagacatacaatgcgtcataatcatatcagagtaactgggggcatccgtcccctctagcatccatgacttctgagtgctggttcttaaggagtgctttctaatgcggatagttgttaagtttggtgtcctgcggggctgagggggcgatcttgctggaggattgtatttggctgtcctgctcctccgttggtgctttgtaggtatttgcctgtgtgtctctaaataaagtgccctttttttttgtttttccttaatttggggtgatatcaatgtggactcccacagagaaagaggggctggtgctgttttcctcccctggccccttgacctgcataaatgcctaggcctgtcgtccccatggctgagttccaccctggtttcactgagatcggtgttcagggtaacatgacgaggcgaataatatttggagcagagccacgttgtatgctatgactgttcttacctttctaatattttgttttcgagaattagtaattctcgtttctttgtttagttttctgtgtatgttttgcaggttgcagatctagtcttttgcgtatttctaagggtctctttgacattcaaacacattaatttttctcttctcttcccgattaactaagctcttggagcctgtgccctacttgaatctctcttggttgtgagccaggctggccgcacagctgctgcctctgagccgccttccattgtcacctgggacactccccctgactgtgtagatctcctctgcctctttcttttcagtttttttgttaattcccctgttttggagaagcacatttttaactccttcagaaagtggtgcgtgggaggtaaatttttgagatcttgtatatctgcaggtgtctgttttattaataacttttttgtctttagttttcagaagtttaatttatggtatgaattggtttgaatttctttaggtttatactagttggggttcacgcaggttcctggattggtatatttatgtcttctgtcaaatttgggatattctgagccatattttcttaccctgcttttcagctctgccctcttagactcagcttctgagactgataccagtgtttgaagttcttttatttcccacaagtccctgggactgagtgttgctggatgggggggtgatgattggcctgctagtggtagagcgggggctgtatgtcaagaagtgtgggtggtctcaggccttccctgtggctgggtggagggcagggagaagccagtgtgggcagatggaatcacctgctgccacctggtggggatagaggcctggactctgctgatgtcactggtggggatagaggcctggactctgctgatgtcgctggtggggatagaggcctggactctgctgatgtcgctggtggggatagaggcctggactctgctgatgtcgctggtggggatagaggcctggactctgctgatgttgctggtggggatagaggcctggactctgctgatgtcgctggtgttccctagagctctgaacgttctgtgcagtctgtgggacactgcgttgcaggtgggctgggctcgcttaccatcagtggtagggaagaggggtgggccggggctgaggtctgccaggcggcccttttcttgctcctgtgccggcacgagcaggcttctcctagggttgtcaggctgtgcgctttggtagttctgcatctccagcctccagagctctgtccggggcagatggaaatcaaacaggccccagcccctctgccttcctctttctgcctttcagaaatctgaaaatatgcacagtttctgagaaaaatgcgaattaaaatacgaggtactgtttcttgtcagtttggcaatattgagtgttggtggaagtttgaaatgagcacttttagatactgttgctggggatgttgcttggtgtagtttgtagaaactttttggaggacaatttagaaagatgtattaaaaagttaactgtaataaatatgtcttctgaccagaatttaatgtatagctggtttacaggtatattcaaagatagacatacaaatatttttaatgcagccttgtctacacaaggaaagtactgtatatggtatctggaaatatactggaaataatctaaaaatccactaatggagagtgggttccataatgagtggtatagtcatatagcataacattaagtgttatgtaagcaccagtaagtactgccagataaatgacatgttgtcttaacttttgtgacttgtggagaagtgcgtgtagtgtgactctgtctctgtcacatggatgtgtctgattaggcatcacagtggcagaccaggacctttgaatgctgtgaagagggtgtcctctggggctggagtggtgctggtggtggtcatggggcactggaagggaggaaactgaaatttctctaaatgtatttctactgttgggcaattatgctacctttgtactagtaaagtataatccattttataatgaagtagactgttcttggtataatttttctcccactcttcttccccttttaggacatgaccgataatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcgaggtcaaggccagcggtaagtggccgagcctgggctgtgtgtggctttttgcgatgagcagaaagaagtaaatgtacttgacatagtgtttactctccagctggacctgtgcaaatgacctggtcttaggatacagttttttgttagatgtaatggattttcacctcagccccacattggggccctggcatcaagggctctctagttactagccagcatttcctttcatcctggcattttccagacgtgaagagaaacatctcgaatctttatcattgcagttttactgtgaaagaattgatctttttttttttttttaagagctagtgtcaggacttggagttggcagtccgcaggctgtgtttaatttttgtgactatgggtggtacttttggcagtggtgtgcaatgaagtaatttctgtcattctctttgtactagtgatagtattttacaaatgcattgcttccttatgttttgtagttgttcacattgtttcactgactttccgattttgaggcttgtgttcttatgaaagaatagtgatcctcggcacatggctatggctgccgggctgtcgtgcttcttgtggaagcgtgtgggtgggtggacagaggtggggggtgggatttgtgaagggaacaatcatgtgtgtcactttacttgcatcctgccctgtagttgaaaaacaccgttgtatactacagttcctcagattctgctggggaaagagtgacttacagagaatagctgatacacagggagctgtggaaaggacatgatacaaaattgtagctctgctctagggcttgggtgactgagcctcagagccacaggtgtttcatatggaaaatgaggatgatagttctcccttgtgcggtcttgtggggttgaattgttaaggtttatactatgtgtatggagtctggcagagtaggagctcagggaatgttaatggctgctattgtttttctaaggtagcaagaaaaaaagatttacaaatgggaatatgacaattttgatgtaaaaatattttctcagtgacctcagaaaacaagtattttaataaggcagatggcagcccttatttgtaaacttctctggtgttggaatttttaggaacagcacctgcctgttcttattgtatgtatatgtatacatatatgtaaagcagttcgccatttttaccagttctaagtgtactgttcagtagcactaggtacattcacagttttataaccatcaccaccgtttatctccagaactgtttcttctcaaactgaattctgttcccattaaacagtccccattcccctccccagcccctgccctctaccattctgctttctgtctctgaatttgattaccgttggtgcttcgtgtaagtgcagtcattttgtcttttgactgcttatttcattcagcataaagtgctggagggttttccatgctgtagcatatgacagagttaccttcctttgtaaggctgaataatatttcatcatatgtatgtacaacattgtgtgttgatgggaacttgggttactttcacctcttggctatgtgaataatgctgctaggagcatggttgtgtaagtatttgagtccttgcttttcagttcttttctgtatatacccagaagtggaattgctgggtcagatggtggttctgtgattaagtctggaggaactgccacgtggttttccccagcggctggaccatgtcgcattcccacaagcagtgcacagggttctgctgcttctgtgttctcgccaacttgtttttttttttcttaaagtaatagccatcctgttggatgtgaagttgctactgttttttgtagttgttaataatgataatttaaaaggcagtattttttattataataaatcgacttgggcagaatttttttccggctgcttgttatgttccagttaatgtataaagtactttccatttgcaacttcagttctcctcataacccttgaagacaagtattgctgggatattaagaagggggtgggttgcaagtacatgacatcctttaaaaaaatccgttcatgtgtagagcccactgagagcgcggcactggcaccatgctgaggcgtggaaatgtcaacttgatagacatcactgttaggagatgcagtttagtctgtgactcagttggatggcactggcctgcatgagccttcctggagacctagggctagggcaggcccggtccatcctgtgagcccatctcctagcccagccccaccagttggagagatctttttcctgggaaccaatgagagcagccctgggccgagaggcctgaggtggcgccagtggactttccaggaggacacttgagccagggcagaggaaggaggacctcgttcgttgctcacctttgccaaggagagttgaggttacagaactgctaagtgggacgcacctttggagtagggacagacgcttgttccagctggtctttctgactttctttaattcttaagtgaactcctcctttaagtgtgaatcctggactgactctgaaccaccacagtaagagtgcaggtgagtggggttttacttttcatgtatttctccttgtggattttttagaagtaacccagagcaaggaaattacgctgaaaagatggggtttgtggatctcaaaatcctctccagttggaagtgattttcagacacatttgaatgtcgtcagtgtcatctgccgtgggaatttgtcttgcagtatgctgttacccctgatagcccacaggaaggcatcgtgagcccccgcttttgagtggactgtgggcccttgagctggcagcagcagaggacgccctccaaaggaccggcagggcgtgtttagaaacatggctctcatgaggaacagtgctctcactttgttctacccgaagccactactcatgtcttaggcgtgtctgagcgtgtgtgcgtgcccggtttcaacgtatgtgcgtgtacatggtgtgttgccatcaaggagctctttgcaggggccacacggaatccataggtgtattagggtgctttagagggacagaactaatagtattctcctgttagttatatatatagatatagatagatatatagatatgaagggaactttattaaggggagtttattatatatacatgttatatatatataaaggggagatatatatatatctacatatacatatatacatatacatccccctattgtgggaccttgtgatcatgtaagttaatacctaataaactccctttcatatatatatagatatatatgtctatatatatctatatagatatatatgtctatatatatctatatagatatatatgtctatatatatctatatagatatatatgtctatatatatctatatagatatatatgtctatatatatctatatagatatatatgtctatatatatctatatatagatatatatgtctatatatatctatatatatgtctatatatatatctatatatatatctatatatatagatgtctatatatctatatatatagatgtctatatatctatatatagatatatatatctatatatatagatatatagacatctatatatatagatatatatagacatatatatatctatatatatagatatatatctatatatatctatatatagatacatatctatatatctatatatatagatacatatctatatatatctatatatagatatatatctcccctttatatgtatatatatatgtatctcccctttatatatatatataacatgtatatataataaactccccttaataaaccccttgatatatctatctgtatctatctatatatacagctaataggagaatattattagttctgtccctctattacttctgtccctctaaagaaccctcatacacctatggattcatatatgtatgtatatgtgtacgtgtacgtatatgtgtatatgtatacaaggtcccacgataggccatctacaggctgaggagcaaggagagccagtccgagtctcaaaactgaagaaattggaggctgatgtttgagggcaagaagcatccagcatgggagaaagatgtaggctgggaggctaggtcagtctcgccttttcacgtttttctgcctgctttatatttgctggaagctgattaggtggtgcccagcagcttaagggtgggtctgcctttcccagttcacggactcaaatgtgaatctcctttagcaacaccctcacagacacacccaggattaatgctttgtgtccttcaatccaatcaagttggcactgagtattaaccatcacaatagggtttgtgccaaactgagacctaagtaactttggaaaatttccctttttttcctgtttattttttaaaattcaagaaatgtcatttttgagcatattagtgatgcatttgctaaactttatctgatggttgaaccaaaggaataaccttctgtccctgttgttctctaattacctaagcatattgtatggaaagtcatgctagttttattttagtttatttatttttaattttattttactattttattttgagatggagtttcactcttgttgcccaggctggagtgcagtgatgctcactgcaacctttgcttcctgggttcaagcgattctcctgccccagcctcccgagtagctgggattataggcacgtgccaccatgcctggctaatttttgtatttttagtagagatagggttttaccatgttggcaggctggtcttgaacttctgacctcaagtgatccacctgcctcagcctcccaaagtgctgggattacaggcgtgagccaccacgcccagcccagtctgagtttaaccgtgggcatttgaggcaagtgtgaaaccacattttttaccgtgttactctagagcagttaagaataaaactctaggatcacaattacattcagtacagcagacttccctctcacctctggctttgcgtaatgtggttacaagtacctgcagtcaactgtggttcgaaacaggtgagaacaatacagtaagatatcttgagagaagagaccacattcacataactttagttatagtatattgttataattgttctatttcattattagttgttgttaatccattattgtacctaatttccagattaaacacacataggtatgtatagatgggaaaacatagtatatatagggttggtatatatacagagatatagctgcagtttcagacatccagtgggcagtcttgtgggtacccccgtggataagggtgggcggctatattgcattttttccagtagtttatgtggctttctgattttggaattaggtttccttttttgaagagtgtgttaaatgtattttgatttatagttaattagtgcttgatttttctgaaaacaaaattgtgccaggttccaaacttagagacttctctgaccatcatgttaggatcatttctttattcatgaaaacactgacttcctttaaattgagggtttctcttctgaattatattttaatttgatgtacaaatagttttactgagtaaacaagaactgaagtttttctctaaatggcacttttttaggctgtttatctccagataaattgaccagatggtccaattcacctctcctgcttccctggggaagtgtagccattggtggtttgccctcttgtggtcggagatggaattgttcttgtcaaggttcaccgttgtgttggtgcttttaacctgtggtgtaggatttcttgtttgaatagtccctctttgaagacagataaaatgttctaggattctgtaataacgatctttctaatgcttgtgtcaaaagcattgtatattattcctgaatatgtacagtacagtcttatggaaggtaaataattgtcacttagcatttattttctgtgcaccttttttggttaggtaaaacccatggatttctatagcattttttttttttttttgagacagagtcttgctctgttgcccaggctggagtgcagtggcataatctcagctcactgcaacctccacctcctgggttcaagcgattctcctaccccagcctcccaagtagctgggattacaggtgcccgccaccacgcccggctaatttgtgtatttttagtagagacagggtttcaccatgtcagccaggctggcctcgaacacctgaccttgtcatctgcccgcctcagcctcccaaagtgctgggattacaggcatgagccaccgcagccagcgtctacagcattttttacaggctgatatgtatttgtgtttcacacccacccacccaccctcactcttactcccttgcttcagaatttcctaaattcaagggagaagttaaggagagaagcagcaaggtccattctggaagtgagtggtgatggtggttgctgtgattggatagaagtggaggcactcagctgcatgtggcacacacggttagcagctgtgagaacacacctcgtgctctgtgtgcttccaagaccagttttctgtgtgtgcatgtggactcaggcttttttagatgattatttctaatgtgctgactttagtcattctcctatttctggacagcttattatctgttgtaaagacatttcttttaaatgctgttttgggggctggttagcttgagatgatgactgtctgtgtttggcagtgatgtgagagcttaaatgggactgtcatttgctgatccacagatctttaacgacattgccactttttaagttggtcacttttaaatattttttacttatttttgacataaagcaacacgcagctgaattttggatgtcgttattaatttagctgtggaggaacagtgtttgatgtgagtataatctgtgcggggaaaaggacaaaagtaccccagaaccttgccttccttcgtgccactggatgtgagcttgtgctgtagtccttcctcctctccggtgaggattgggtttggatgggacacatgaggctgcattacaggatggacctctcagcactattgtttcaagatgtaattgtttttaaacaagagagaagaacataaattagaagatatgggccccccgaggcaggcgtagggagcgtattatagcattatgtacaaaggggtcttggagtagatggtttggaaatgtttctggcgtgtgaaagtgaatattttcctagattggtataccgagcatgtcctcactgcaatgtggctgcctcccgttgtcggtgatgattacacatcttccgtttcaggagcacgtcccatagaccagctgacttagagtaattaggggtcaggttgttagtcttccagtattagagcttctcttttttaaaaaagttttatttgcatttatgcttaagtaattgtattacttacatgccacatgcttgtagcatgtgatagccagtagacggaagagctcatgtggggaagagcacaggccacccactcccacagccctgatccagggagaggcgttactcacctcctctcctctcctacgtagctgcctcgcaactcttcacagtatgcagagacttctctgcttagatttatagggcgtatctcactttattgcactttgcttgtttttttgtttttttttttttctcttacaaatggaaggcttgtggcaacactgttggtgccatttttccagcaccatgtgcccacttgtcccagtgcttcatttgggtaattcttgcacgatttcacagcttttcattattgtatccgttatggtgatctgtgatcagggacctttggtgttactgttagaattgttttggggtgccatgaaccatgcccatgtaagatggcagacttaattgataaatgttgtgtgtattctgactgccctactgaccgggaattccccatgtttttccccaggccactcattccctgagacacaaaaatactgaaattaaaccagtttataaccttactatggcctcttaagtgttcaaatgaaaggaagagttgcatgtctctcactttaaataaaaagctagaaacgattaaccttagtgaggaaggcatgtagaaaggtgagacaggctgaaagctaggcctgttgcaccagtcagtcgtgaatacaaatgaaaagctcttgaaggaaattataagtgctactccagtgaacacatgaatgataagcaatgaaaccaccttattgctgatatggagaaagtttgagtggtgtggatagaagatcaaaccagccacaacatttccttaagggcaaagcctaatctcttcaattctatgaagactgagaggtgaggaagctgcagaaaaagagtttgaagctaatggaggttagtgcatgaggttgaaggaaagaagccgtctccagaacatgatgaaagtgcagggtgaagcagcacgtgctgacggagaagctgcagcaagtcatccagaagatctagctgacatcatcggtgaaggtggccacaccaacaggctgactctctggtctggggttaatgtagctggtgactgagttgaagccaattctcatttaccattctgaaaatcctagtacccttaagaattatgcttaaccaactttgcctctctgcgctgtaagttagaacaacaaagcctggatggtggcacatctgcttgtgtcatggtttgctgaatattttaagcccactttagagacctcccactcaggaaaaaaagattcccttgagcatgttactgcttattgacagtgtacctaatcacccaagagctttgagggagacatacaaagaaattaatgttgttttcatgctgctaacacagcatccatactgcagctcatgggtcaaggattaatttagatttttgggtcttagcatttaaggaatacattttgtaaggccataaatagtggttcctctaatggatctaggcaaagtaatttgaaaaccttctggaaaggatttacccctttagatgctgttaagaacatttgtgatttatgggaggaggttaaaatatcaacatcaacaggagtttggaagacattgattctaaccctgatggatgaccttagggcctcaggacttcagtttaggaaggaactacctgtgtggtgggaacagcaagagaactaaaattggaagtggagcctggagatgtgactgaactgctgcagtctcatgagaaaacttgaatggatgaagagttgctccttatggctgagcaaagaatgtggtttcttgaaatagaatctacccttgctgaagtgccgtgaacattgttgaaataacaaaagatttagactgttgcaaaaagttagttgataaagtggtagcagggtttgagaagattgactcttaattttgtaagaagttgtatgtgtgtaaaatgctaccaaatagcatctcacgctccagagaaatctttcatgaaaggaagaatcagttgatactggcacacttcattgtcttgtttcaagaagtgtccatagccaccgcagccttctgcagccactgatcagtcagcagccatccatatcaaggcaagaccctctacaaagagattacagcttgctgaaggctcagatgattgttagcatttttttagaaactttttttttaactaaggaatgtactttttttaaagacagtgcaattgcaaacttaatagactacagtatagtgtaaacatagcttttatatgcagtaggaaacaaatttgtgtgactcactgtattgccatggtctgaaaccaagccctcagcaacttcagggtctccctgtgtaccccgtttgacttaccttcttcctcctactttcttctaggtttgttctttgtgattaatttgttcttctgttggtttcctctgttggtgtgctaaacgagatgctttagtcttatttgtatttcagtgacatttggcagatacctcctgatgccccattttgttccgtgaagattcaccttgacccttttctctatcctcccacattctgcctttactcacctgtatcttcctgttgcattgtcaaggttgttcacagttacaccagttacacttggctctaaagccacacccagcatccattccccaaatacttactttggtgagcactgttgtggaaactgagaaacacagcagtgggaaaaccaagagtgtcttcccagaagttatgaagcacatctgaggtgtcctgcacggcacatgaggtaagcgtgcaggtctgtgctctctgctctctactggcatccaaaaaagaggagggggcgcttttatagaatgaaagagactttagtggcacagcagccagatgtgctgcgcagacttcatttggttcctgattcaaataagctgacatcagaaagccattgttttgacacacaggaagatctgaatatagactaggcattagatactatttaaaaattattaatatcgtcaggtgtgataatggtctgaggttagggttttgagtttaaagaagaaaagctccctttgctaacactgaagtgttggtgagtggagatgacctcatctctgagacttgctgatggtgcttccagcagagaacacggcgggagcggatgaggcaggctcgatgctgaggactgctaacactgttaagagtctatacgtggtcattctctgtatgtttatgtatatttttaagtttctaaaagtttgggaaaaagtaatggcacaattataacattttcgaacaaagatcgagcgtcttagcagatcatcccttgaacaactcggaggacgtcacctgacaggagggtgcatgtggttcaggaaagcggcaggcagacactgctgagcacgggcagacacacacagacattgactctgtgaactctgagtgcgtgagtaacagccaacaaaccacgcacagagccccagcacagaaggtcggaagaggacgtgggaattccgagtttttcagggccatgtctgctctggtggttgaagccagcggtgatgattaactctggactttgctgggttggtgacacgtcacaaatgaaagcgtaaccactgaaacagagggaagcggctgggtggcttccagtcaagcggaagaggcaagtgaggactcacagaagtgtgttcttctcaaaagaggcagaaattcccagccctgtgatggtggagctgcctcggagtggggagggcattgcacctggctccccggacctggccctcgcccagctgtgcagcgttcctgtgtgtcttggtggactctggttttgctcggggctggctgtgcttcctcagcccaaggaatccagagctcttcagttccagaaaggatcttctcaaggactacttccagctcactccctgatttttctcctgaatatcttactagatgtcttattttgccctctgttttaatccgcgtattttaatctactttgcgtatctgtttgtttcactgtgctgtattatctattcctctgcctgtcagttcattaattccctcctcacggtgatactaacctgtttgtggagatttccattttagtgaccatatttatttgtagaagttttgctgcgcttcagatgttttcagtcttcatggcgccttttttattcgtcgtgattggtcctaattgcgtatctctcctgtcattttaaacgacagattacattaggtcttgattttcctcttatttctactttggggaacctggtccctttatatgccacatccactcacaccctcctggtagctcagtaccttctgtggctgatactgtttaatggtgggcttattcctgatggtgggttcctgtgtaccctgggttgtagaaatatttctacagagaggagtaacatttgcttcttaggggttcccggagacttttttgtcccaggcaggtactggtagtcctgcaagaggagagcataggttggagtggtcctgctaagcaggtgcgggctctgggttttggtttcttctaggctgtgcccccgtctgtgagcagcctgcacacttccttgctatttctctagaccagtgcatagaagcttccagacatctttgcatcagctgtgcgggttactaagggatccagttttatttgcttgggttggagcaggtctgttttcttcctgcgttgggtgtagccccagctgctggagcctggagacaggtgtgtctcccctcccctagtgagagggtttcctctttgcttttggcatgtcatcccctctttttcttttacacgtctatatttaaattttcttgttttcagcatttttcgagtttattttaagaaagggaagacttgctgccccagtcagcccttggaaaggtagcactaagctacattctcttggttccccactcctcaataccagtgaattttattaatttttagctaccagatgggccaaaaaatgctgcttttcttaggatagtagggcagttgagtattttctaatctatttcctggctgtgtgcttttctgtctgttacgaatggccgtaatttagcctcttttaatttcaatgctgttttttggtagaagctactagaaggcttcctaggctgcccgggagttacctgtgcccctgctgccccgcacccctcctgttgatggcacatttcttctggcgtgaccgccccaggagcctggacagtggtggggcaagcaaggagctttgcatcagaagccaggagtggccttgctggggtctggcagccaggggcttcctgtctcccctgcagggtctcctgacagcagacccaccttgggcgtttgtggaaattacgcttcctgattggaagcaagggcacgttgtgggtggcacacttcagcagtgccctcttgttgaaaacgaaccacagggtgttctggggaacgtgatcttgacaccttccattcagcagccagcagaattgggagctcttttttcctaggggagaaaaggcaacctgcctggacttaatctgatttgactgggtttcttctgcctgttttttatttttatgtaatgttagtaacctgaagctttttcttttgaaaacttttttcttacagttcttatagtaaattaattgaattttattaactgtggtgttgagttgtgaggtatgtcttaagtttaaaataacacagctggcaaaatcattacttttaaaataatgcagattcagggtcactgttacgaagttcacttcaccggcacacatgctgacgtgcggcttatgatcgcagtggctgtgattgaggtgtggacagtctcccctgcaatgttgttttctatcctgcctccaaattgtagatttcaaagatgaaaaagtgttgtttttcctcagatgaaaacatttcatagtgttttcttctacaattaaattcttagctgtagaaaagagattgagtaggtaagtgtgctagcaagaatagattggttttcctccttgtagctcttacagtgtagaagggatttgtttcctgtggagttttgttttccatcctgtgggcagagagaattcttgcaacttgcagcggcaccttattttgttgttttcaaccacctggaagtacttaacagtgaggcattgaaggaagatttagaaacttgacagtgaggcattgaaggaaggttgaggtaaacggctccacaggaggaggatccaaagttaaggagcatgaggttggttcggggcattctgggtttctgttgccagaagatggtgcagatcctgaggaggcagttgacgttagggacctgaagccttagagtgtttggggttgaaggcactgttttgggatatactacctcagaccccaggacactgagattgtggatgggggacgcatgggaggagaggagagcagaaggcatggactgtaggcaggtgctgctcacacaccagaggggaggagtgtgttcccgcccagtgagggggttcacatggcaggattcttgcagtggaggtgagctttgagggaaaactggtagggactaagtcctctaggaaatgctcatcagaatttcttggggaagaatgtgggaaaaaacctctccctttcctttgtccccactagccccaatttgatacactgctctgtagccctggaaaaccagtggtaaacagaatccgtagaaccaatgttagatatacagaaccaatgttagatgtacagaacgtagaatcaatgttagacctatctgcccaccccctagaactgttggtagatctaccccatggaactatgatatacacacaaccattgatagacccaccctatagaattgtgatagacacaccctatccatctaaccattaatagaaatacacacatacccataaaaccattgagagacagagggacccaccccatagaaccagtgatggacgccatacactgtctgcagaactaatggtaaagacacagacactgtctgtagaactgataatagacacacaccaccccatagaactatggagagacagacccacccgcacagccagcgatggacacacccacactgtccatagaaccagtgatagagaccccctcccgtagaaccattggtagacaggcccaccccatagagctgatgacgggcatgcatggtgccaggttttgtttggcaggtgtttcttcggcaggtgtttcttcagcacctgttatgcagagtaagtgtgtgttgaatggatgtggagtgaaagcggtgctgttttaaaacatcagaatccttgctggagtcaggactgctttaatggttttgcctggtgtggaagtgaaggcggtgtgggtttttcttgtttttgcccctgcttgagatgacttttctttctcctccttgtctcctgtgagtgatggttatttcaagccctgagccagatcttgcttgtttagagagacttttccattctgagggatctgagtccctaacttttagccctgatgttttaatattgttatgtatctgccaaaatgccttttatttgggtgacgctttatatttaccacactatggaattgtccttgtagctaaactgctttggttttggctggcattcgtggagcagtctcttagacgccttcaacttgaaactgggagaacagggtggggatggggtgctgtgattggccttggtgagccgagcctgagggactgggtttctggggcactgagggtcactgtggatggccttttccttggcttgccatttggcttgttaattcagtgaggctgctggatgagtatccttggcctgtgtgaggggctggaacttttgtcatctttagtactgatcagtaaaactatgttacattttcatttcagagaagcctgtgtctcccaaatcaggaacactgaagagccctcccaaaggatttgatacgactgccataaacaaaagctattacaatgtggtgagtaattgcagaacatttttaaactaactggtttttgactgcctgtaaaactcagcaatgtagaatgtagtgtaaagtacctagaataggaagaaggaaataaagttcattcatctgccacacaaatgtaaccaccattaaggttttggtctgtttccttctaatctctgtatttttgtaattgtatgtttttgttttaatatcatgtatatggaaatgtcccttgctcttgtcccgtaacatagtaatgtgcgtgtttccccatgccatagccagtcttcaaaaatgatatttgaaaaaatgtataatgtgatttgaaaattttatatgcattgagtgccattctgtttgtattcagagtagactgtaagtactttagacataaggcttctaatttattttttctcttaatatagtgtttcccaggattgatgtgtacatatcacatggcgtagaattaggggagcatgtctaaacgctatacgtgttaaagacaggtgtttctggatcctaaaatttgctgcttaatatgttcagtatgtgatactaaatctgtgtagtctaatgctattaaatcaaatgtatagtctcatggtactaaatctgtgtcgtctaaaccttctttgtacctaagcttatgtagcaattgcatgttctatagaaatggaaaataatttattttaaagaatttattaaaattttaaaccactcaacatgataacaacaaagtaaaccctctaaacatgtgtatgttttgaattctggggaaaatgcgcatttgttttgttatttcttcccctactcccaatcttcattttcttcttgagtagatataactatgaacccacgagacctttgaattgttggtgtgaaacagcagttgattggtgtttttgtgcagcagtcattttcttgtgagcatttcattttctgcacctgtgttgggaaacggtgaaaaggtgtggtgcaatggagtctgagcagctccaccacgtggagctgtgccaccgtcttgtgctgcggggcttgcactctcagcttcctcctgagtgcccaccttccatctgccccagcatcgtactgcaggacagactggcctggggacccactcattaataactgtttattgggcgcctgctctgtgcagctctgttaaaggcaccaggatgcacagtgaacagaatggcgggtgcctctcccctcgctgagctcgcacttgggtacgggaacacaatggtcttttgttgcctccatttttactgcttctttttcataatttgacatctgtgcaccttcttgtgagcaggtctcctcatgcatcatgccacttctcttacattagtggcaatctttgacttatttttccttgtatttggtcaactccggatccttttctgccttggaaacccttttcttttgcttcccctctttcttccctttttttcattcatcttcatttggctgcttggactctgccttccatctcaactttgtggactttgagaagatcagactccttttagcgcgtcgtgtggcccacattacccgagacacctgctttctgtcatctctcctagtgctctgcatcgccttcatcccttggcctgttgggcatttactcccaggatttggctctactaacccattcgctttttagtgtgtaatgtagcttatgtgtagttttgtgtacgtagctacagagacagtagatgggttttatgggttgtaggaaaacttgagttttaactcctggagctgccctttcctcttgcattcttgtataagacactgcttttttggggaaggcttcatgtggtgaataacacagccacaatccacagtgagattccaaagggtgtgttaccttctgttatggttcaggtccagataattctgttagaaaaagtggtcagcagtgtttaaattggtgccaagggcattctttagtttctccattaatcttgctttcattaggcactttataaaaccaggcaaccatgcttttttagaaatcctggtgggtttttctttgcattatatattctgtaatacttctcagattgaagcatagtcgatacctttttcgttttccttctctaactgtccttttacagagagaatagcctgggtattataagtgctcttttcttcaaatcagccaactctttcatacagaatgatggaaaacaccttgacctcaaaatcacatctaaattgttttctatataaagctgcatttataaatagcacatggtaaaattacagttgttatagaaataaactcatagaattcatagagaattgtcttttgatgtagtactctcattttacagcagagaaaacagaagctaaatgccttgtccaaggttatacactggttactaagccaggaatcaatttcagctttccttaattttatatttgtaaattgtacataaaaatagagaacagaatacaacacagaacaaaacatgatagataatgtgttaggcatttctacacccccttttgtagtttcgttttcacagaaaactataaggtctgggtgtttttaacctcactgaaagttgaaaacttactaaagggtaagactggtgtggaccaatggtgttaaggaaatttacatgaatgacttgtcttaacttgggatcagtataatggagttgagagaagagtattccatgcgaaagtaccaacattttgaaattaagagacaatgagacaggtatgaatgggatggatatgtgttttcctgctattgtataatagttaagatgaacaccaaaaagacactggaaagtaaaactcgtagtaatttatgtctgttattatgaaccattcagtaactatttctctctcctctccttctgggactcctgtggtgcaattagtcaaatatagacaatatttgagccattgtcttcatactgtcctttaattttttaaacatagtttcctttagttctttggacatatttataacagctgctttgaaacctttatctcctaagtccactatctgtgccccctagagacagtttccattgactgcttctttttttcttgtgtgcgtgtgtgtgtggtcacactttcttgcatgtcctatgattttttaaattgaaaactggatatcttagacctattttagcagctctggatgcttgaaatccacctcccctgggttatactgttgctgttgctgtgtcttgctcagtgactcacctagagcacttctgtagtttatcttcccatagtcactgatgtctatttttatttttttattcttgtttttatttttaattctgtctttctaggattcacttttgggtagcataatttagtattcagccaaagattcaccaaagattgtgcttaaacacctttaacagttcaggtattacggctcacacctgtaatcccaacactttgggaggcctagtagggaggattgcttgaggctaggagtttgacaccagcctgggcagcataacaagaccatgtctctagaaaaaaccaaaattacctgggctgggtggcaaatgcctgtagtcttagctactcgggaggctgaggtgggaggattgcttgagccctggagtttgaggctgcagtaagctatgattgcaccactgcacttccagcctgagctacagaacaagattgtgtccctaaaaaaccaaaaaacacctctgacggtgaggtttcactcttgccagtgatctgtatggggttggggaatgcattcaaagagagggctggggaggagcatgactttttaaaagttaaaggcagtggatgaaatgacaaaggaaaagataaatcttttaggctacctaatgagagtttaatatattccttgcctcaaacagtataagccagatcacaagttaattggaatgttatttgcatcaggtataatacaaggttatccttaatgtctgaagagctcattaagacaaatacatgaagattaatagacaaatgggaaaggttgtgaacaatttaaaaaatggtaaacactaaggctttgaaaaaaaatagttaaactcaccataaaaattttaataggcatattttctgtaatcagtgagcagagatttaaagagagaatctttagttctaatggtggaaatgtaaatccatacagagtttctcaaaagtaatatggcagttatatatagaattctggaagtgatcaagttctttaatttagggctttctctttaatttctaaatttcttgaaatccattccagagaattaacctgaaatatattcaaagatgcttgtgtaaaggcattttcagaggattatttgttatagtaataaattgcaagcaacccaaaataaacagtatgagatgaacagtaccagaatgattaagcgatcagtggtttgtccatttgtagttactaaagtgtacatgaggctttaaaaatacaaaaaacatatattttcatgttaagtgcaataacagaatatgaaattacacaggtgatatgatctcatggtattacaaagttgacatagaagatagaagacattgtgctagagaatggtttctttccagtggaggaattttagcttcccactaatgtaagggatagtgattatgggggaagtctttggcaccacagtccagaatgtgttggagatagaaacgggcctctgaggctagggaggaagccagcgtggaacatggcaggcacacaggccttgggcttggagagtgacggggaagggagaggaaatcaagatctcttaaatgcagatcttttaatttcaattagtttttgtgacacagccagccactactcttgcctctattttctcatgtacgtactgtttgaaatcagtctgttagctgtgcttagggtgcccttgttgtgtaggtagttcagataattaagatccgggcggcttgatgcagtggaaggtgtacagcctttttgttgaatcgtccatgctgcttagcctgggtggccaggagctttggccctagcttcctgagcccagttatctcatttgtaaaatgagattggtaatgctggccctgacctggtagtattaagtggactggcaactggccttaaggcctccagcaaagtgctggaccttagaggtttttgtgtgtattaagaagagtatttaagagcattgggaacagaaggcatcactgaggccaccataccattctgtttgtaaactggaatccccgtagattttgagggtgacctgtgaaagctgtagccaaggtggcctgatcatataattaaaagagacaggtttgtgacctgatgtgcccgagcttggtggatttgacagtgaaagcacactcgttgcccccatggcatggtgactggcatctttcctgatggggatcaaaggaaggggttggatgcctaggctggagagaatgatggtctggagttgcctctcggggggatgaggagcaccccgctccgtcattagagaatgaggtttcttaagtcgctgactgggaagacacagtccttatggccttccctgctcagcgatatacactatggtttgattttttaggctttctgtattagtccgttctcacgctgctgtgaagaaatacccgagactgggcaatttataaagaaaagaggtttaattgactcagagttccgcatggctggggaggcttcaggaaacttacagtcatggcggaaggcacctcttcacgaagcagtgggagagagaatgagtgccaacaggggaaatgccagatgcttataaaaccatcagatcttgtgagaactcaccatgagaacagcataggggaacgcgctgcgtgcccctgctcccccacacccccgtgccatgattcagttacctccaccctgtcccgcccttgacacatggggattattacaattcagggtgagatttgggtgggccatagagccaaaccatatcactttccctgttatttagagcattattataatactgtgaatataatgtaataggtagcatcactctttctaatctgtaagtgtataaaacggttatgtatccttagatgccatcacacacatccacgggcctttcctgtgctccagagaagccgcacacctgtcttttcctccctgctcctttagtttgcgatggccttcagatgccaggccaaggaggaaaacctgagcctcctggtgacagggtgtcttcggtctccatccatcagcagtgaccctaaaccctggcgttgcttcgtctcttcatcttctgctttgcccttggcttttctccacctcaatgaagatttctgttaaatcttttgactcctgaagtctctgcttggggcccgtaggtggagatggttaatgatgaggggccctgaggtatcagggagggtgtgcagcttgtgggatcccctcttttcctgggcggcgaggtgcctgctggcttctttcacacctggctcccattgtttttcatgggatttccttgctgtatctggactaagatgatacagatgaaggttgtcaggtaggcactagtggaatgctgacacggagaggagctcagtgtttgggaggattgagtgacttaattgcaagaaaggctgtcttgtgaaataattacctcctgactgaaggagtcatttaagaagcagctccaagtaagactctacattgggctggaaggtcgaagggtgactggctagatgccttcctactataagccaatgactggcactcttgagtaaccattataacctcgtaaaacccctttttgtgaaaaagggaaacagaccgatagacttgtccagctgcagacagtcagtggtggagcgcagctgggagcccaggtccacgtggctgcagaggccggctctacctgtcgccatgctgctgtgcaggtgccattggtggtgtctgcttccccctgtgtgctggaggctttgcaggagccattgcctataaacctttaacatttaggagaaacgtaccccaagacctgtgaatctccaaatttaaaagtaatagaataacatttatttcaaaagatacagcatcataaaagcatttatgtggtctctccaaactttttttgagaactaacgttccgaggtattggtaaggaccagcagtgctaacacaccacattaaatcagcaaccgtgtggtcggggagccactgactgcctcatgtcattgtgacccgtagaggagccagcaggagcttctgggatttcttgtcaacactccttcctcctcctcctcctcctttccgtggagtcagatgtttattacaggccacattgtgtggtgaactactgtcttgtaatgtactttttgaaaatttacttgaagtgtaaatagactggaatggagaacattaaatgatgatcttgtttctctgtagcagtggacagggaagggctgattaggtagggtggaggtagatttggaataattgtgccactttttggtttttcttcttggacttatacattaggattgggatatggaaatacagttgtatgatgataaaaatcttttatacagatgaaacaaaaaaaattaatgttctttgttctcttatgtaaatcagttatttgtttttaaaggctgttgatgacataaacatataaaacacctaccgagattggcagtggaagttgtaacccatttgtaaaatcagaaatgctaagtactcctttaatgatgcaacgaataaagtgtctgtgtctgcgaggcacagcagtgagtcctctttgttttgctgtgctctgaggcgggcagcatagggattgagtggcaccagtgtttgactgcacttgcctctccatgcctcgtgacccccgggaagctggcactggctgagctcagctctgtgggcctttcttcagcactgtgggtcgtaaaagctgccttttctttgaaaactgcctgcgtcctctgggttcccagcgttggtgggatggagctgtggcgtccaggctgtgaggtctcatggggtcctgcagcagccagagcgtgcagaagacgaggaggggaagaaaggtggtaagtggcacccccggctgcgccccgaggtcaggaaggccagcaacctcctggcagagggagtgggcaccccagctggagtcagggagccaggcctggctgtgtgtttgaggaaaagttaagtgtaacttgcattgtttggttgggagtaatacaggaattgtgtttagcaccctatttgaaaatagtgtttaagactatttgttgaattaaccaacttaactattttaacaaatgtagctttttggcagagggctctttcaagtagtttttggtgcttatgggaagctttcatttctacaaccagcgcttagtgctgtgacggacaaaaggtcattgtattttattcttctcatattcgtgctagtgatagtttctagtggctgctttcttatctcacataggaacatttttctgtttgaaaataagtatataggtcttcaggtgtgcagtgagcagtattggtaagttggtatccaatatttgtaattaggaagctaaatcatatttcctatctttaacattgaaaaggacttttctgatacgtctgtgacagatcttatttcatcttatttagctcaagatctcattatgcttggctggcttcccctgttgttctggaggacaggcctggtttcgagtagcgtctctggggtgtggtggctggcatcacggtttacctctgctcaccagacctttgacatttgtgttcgacgggaatttcgtagaaggaagacattgtggttgtggggtcagcatttcccatgaagagccagctccctgcagggcccctcgctctggctctcccacggtcgtctcccttgaatagatcccttcagggatgagcctgagttccttgtcaccagtggaagagcctctgttttttttcgcccaagtagtttagtaagtgatttaatcagatttgcatttactcaggaatgactgtattcctttctcagagtttacagtcaacagtaggcaaacagagtaacgacccgggttgtctttactaaggctgaaatttaaatttaacttgatgacttttttcttaaatgtttaaatttacatttggattatcaaaaatgatggggacagactgagcatgtttaatatctttattacttctgtacaatttcttttgtatgaataagtgagaatgtattgttagctctgggagacaaatagcacatcttgatgcatgtactagatgcgcagaaaatacgtgtaatgtgatttcctgatttaaaaagcactagctctgtaacagactcgggtgaaaaagaatggaggcagggattccactttcttcacttacgtcaggtccttcaggatcctcagcgtgctcctcagtctcatgccaaagaagacagtgtggtgcggtgcagtggcaggaggacctggggccgctgtctggctctgcttttctcagctgtttgagttgggagaagtcagcttctctaagaggaaaagttttgtgtgcagagccccttgctcggtgccaggagtgcgaggagcacctgcagttcacatccaggtgccttctcgtcccaccctgggctgggcctttgctgcagtgatagctggtggaaagcattcctacttggtttcatcagttttgcactttatatttatctgtcagtttttaagacttaaattattttggctaaatttgctacactagtacagggtattgggaaacattttaattttaaggttaatttataattattctgctatctttaaatgaagtagtaaagattgttaacattgataaacctttagtttttaataaatgtggtaataaggtgtctgagactgtcatattcactagggaaagtctgtagttcccagaaattgatttcaatttttagatgcaatctaaagagtaaactgtttttttagttgagagtaatattacatatgttaaaatacatagatttcaaaggcacagtccagtgagcttttacaatgtatatatctgttgtaaccgctacccaaatcaaaatacagaacctatgtatcaccttagacatttacgtcattctcctttccttgttgtccacgcccccatcctacccttcacctcttctctgatttctgtcaccatagattagttttgtcatctcttagacttaatacaaatgggatgatgcaggatgtccttttgggaatggcttcttttgcaccacacagtgtcgtagagattgatctgtttgtccatgcagttgtgattcttggcggcttctcctttttatctaaacagacatggcatctgatgatggaattcatgctaggtatacctgtcagatacggttggcagtaagataaagtcagttgtatggccttagtaataattcattacatgggtttaacagtcaataattgcaaagaatgatgatgatactcaacactttagtattacatagaagtaacagtgtgaattgaacaatggcgatgaactgtccaaagtgtataaatcttagtgtcaaatagcaattgaaatgtcaaataacacttattcatcatttattataggtgctacagaatattttagaaacagaaaatgaatattctaaagaacttcagactgtgctttcaacgtacctacggccattgcagaccagtgagaagtaagttagatgataaattgcattaactgtaaaatagtctaaaccttaggctgttctcttctattttcagagaatagagggttaaatagtgaaacaaaatttagtgtaccagtttgccttagacatcagctgtttattaggttaagacttcaataggacattgggatggcaaaggagaagaatataaataaaactgtttacatatgtttactgttatttttcttggctctaggttaagttcagcaaacatttcatatttaatgggaaatctagaagaaatatgttctttccagcaaatgctcgtacagtctttagaagaatgcaccaagtaagtaagatgctaaaaatttgcaacactcaggttggtataattggtatttaaaggattaagtgtgaagtaattttagaattcacatttctaaagatgcaaacttaagttattttaaatcttttgggtaaatcagcttttacagtaaaagctgtattttagactgtctagtttgtatagcaggaatcttcagagaaagactcaagaatggtgatttttaaggtgttccatggaggaagagtcgggatgaagagcctctgggagagaaaggagaatggcctgacaccaggaccactgaggggacaagtggctcagctccttgtgtgccctgagtgctgcgcagggggccttgaaggccaggtctttccccaatatcctgcagcttgcctgctgtttctggccttccagaagcagatacagtgcttctagaaataacatattaggttggtgcaaaagtaattgtggttttggattgtgaattttaaatcataactaggctcagacacatctttattaatcaagaccattccagtcaacacattttcaccagtgagaaataagttttattcttgtagcgtaaaaatctgtgcttcaggatttgacaaactcttggaaagcactttctgcatcctgctggttgtggaagcgttttccctgcaaaaagttgtcgagatgcttgaagaaatggtagttggttggtgagaggtcaggtgaatatggcagatgaggcaaaacttcacagcccaatttgttccacttttgaagtgttggttgtgtgacgtgcggtcaggcgctgttgtggagaagaattgggcccttcctgttgaccaatgccggctgcaggcattgtagttttcaaagcatctcatcgatttgctgagcatacttctcagatgtaatggttttgtggagattcagaaagttgtagtggatcagactggcacagaccaccagacagtgaccaggacctttttttggtgcaagtttggctttgggaagtgctttggaacttctcggtccaaccactgagctggttgtcgtataagaaccacttttcggcgtatgtcacaatctgattgagaaatggttcattgttgtgtagaataagagaagatgacacttcaagatgatgatttttttgattctcgctcagctcatgaggtacccacttaccgagctttttcaccttttcaaattgcttcaaatgccgatcaactgtagaacagtcaacgttgagttctttagcagcttctcgtgtagttgtaagaggatcagcttcagtgattgctctcatttggtcgttgtcaacttctgatggccggccactacgctcctcaccttcaaggccctcatctcctctgcaaaacttcttgacccaccactgcactgtgtgtttgttagcagttcctgggccaaatgcgttgttgatgttggaaattgtctccactgctttacgacttactttgaactcgaataagaaaattgctcaaatttgccttttgtctaacatttccatagtctaaaataaacagcaagtaataagtcgttagcaaaaaaaccatcaagcgagaaatacgcattaaaatgatgtataaccacatttatttaagaacatgttccaatatcaaatggcaaatttcaacaatgcagaaaccacaaatatgtttgcagcaacctgatgtaacatgctatgctgatgaactagggctttgaggctttgtcacttttccaaaattttcctttggagggacagaggcatgttctgaataatcagccatcagtttttttctgtgtgactattttattttcttggtttacatcagacattaaaggatatttgttaatttcctgccaggtgacttagaacagtagtgcacatggaagcttttaggtttcagtagtctatcaggtgaggtttctttacttgtgggtttgatgaaggtgacacattttatttttaaattatctttgatctttattcatataacccccagaaaagactacagtacattatttccttggatttcggttggtctctggtcttcccttcagcttgtgcctatttaggttttgaacgtggtgagggagtggccttccttctgtgccactagttcttgcagttcatgacagtttaccaaccatgatgaaaatactttgttcccttacctttttggctgggctttgaggttttgtcaaggcactttatactggactatcgatatggcaaggaaagctgaatgccagagtaacagaatattattagaaaccgtaagtgaatattctatagaacttaagactgtactttcaacccatctgcaggccattgtttttacttttatagcatttttggtttgcataaagtggcattacttacatgaccatgaaagaatagcttgggaatcactttgattttcttttggtgaatgaaggtcatttgctgataattcaaagtctttgtaagagttcatattgtgctcaagatggaagtaaatgcttgcctctgtttttctcattggctgtagataatgtggtctaacaaattattacagtatattttaaaaatacagtttgcagtacctctgttgggcattatatcagccctgcgaattattatcctcacattactcgttaaaaagctgaaataaaggcagtaaagtaatcgcttgaagccatgtgtttactaaggcttcagtccttatgttatctcagaatttggtatggcttaggtattattttgatcaagtttctcaaattttatgctacatgtatacgaggtgttagagttccacggggaaatggaatgtactagacgaagttttctttctcagctatttctcttctttttattatgaatattctgaaattttcatcatttccattttaagacttactttcgtctttttgtcctatatgtgaaatttctgtaccattttacagtttaccaaatgccatatatatgtagcagtttcatactcattctttttttttttttgatacagaatcttgctctgttgcccaggctggagtgcactggtgcgatctcagctcactgcaacctctgcctcctgagttcaagtgattctcctgcctcagcctcccgagtagctgggattacaggcgtgcgccaccatgcccagctaatttttatgtatttttagtagagacggggtttcaccatgttggtcaggctggtcatgagctcctgacctcaaatgaaccacccgcctcagcctcccaaagtgttgggattacaggcgtgagcaaccacgcctggccttcatattcattatttcttttgatttttttttttcgtctctacacagacttgattcgtagatgtccaggccctttcacagctgcctgttggttagacccaggagttggcaaactatgggctgggtcagattccgcctaccacctgttttctataaacaaagtttcactggcacgtgctgtactttttcattcacccattgttaatggctgtgtttgtactacagtggcagcagtggagttgtgatagaaactgtctggctcacatacctcaaatatttactccttggctttttatagaaagttggctgacccccaggtgagatgtgctttcttccttggggcctcgacctggccctaacctctccattccctgtgcgttctgaggcccatgtttgttttctcagtatttttgccatgtaggacttctgtcttccgtcttgaaaactgaagtttctatctggtgtcatttttcttcaggcagaggaacactttagttttttgtaattcaggtgtgttactgacaaacatgatcttggattttgttgtctgaaaattgctgccttcgttcctgaagatttttttttttcccatggatactgaactctgggtaacagatttgttgtttcagcatttgaaggatattgctccactgtcttttggccttcactgtatctgttgattgtatctgatgatgacctccattatattctgatcagcacaatttcagatagttgttccccgtccgcttcctagatttttgcctttattttaggtttttggcattttgacggtgattatctcgggtgtggttttctgacttctcgaacttgaaaatttatgtcttttaccaaatgtggggaatttgcgggcattatttcttcaaatattttgctgctttactgtttctactctgccttggggctccagttacacccatgtagaccttttgctggaggtcctggatttgctcgttgctttctgacctggtctctgctctgttcttcaggttgaatggcgtctgctgtgtcctaagtgttcactgtctgcctctctactctcttgttcgtccccgtgcaacaagtttttagtttgagaatttttttcagttctagaatttgtttcgcttaaaaaaagtgtttagttctctgctaagattttatatttgttcattcactacaagaatatttttctttatatcctttagcaataattagaataactgctttaaggtcccatctgctgattctttattgtgaggatgggttacgtcttcatgattctttttatttctagtgactttgaattgtgtcctgtttactgtgggttgtagactcttgatcatgttaggtttccctgaagagtattgatttgcttgtttgacaggcagttaacttggtcaggctcaaattgccaactctccctttggcagatgctcaaatctcagtccacttattttagactcagctgatctgaagttggccttgcaagttctgttctgccgtcagccagagatttgggcagaatttagagacagaattcagggtcacactcaccgtgggtttcccccagcttcccagcaactctggtagaaccaaaccctgtggatttttgttggagttttagctgttccacataacaaagttggctgccattagcttaatagttgagaaagcaggaggtgccctgcccgttcttttttccaaatgtccatccttccccagaatatacctgatgctaactaaaaagtgattcaggcaggtctcaatcgatagaggtttacgtagctgcagttgaggacgtgccaggtaacaggagcatttgtgctttttccaaagctttgagaagttcagtatttaaaggggaaagaacaagcaggaggggaaaaaagggaggctggggagcagtgaggcagatgcttaaacattgttgtgagcctccgattggcctcagtaagcctgcattttacacgggaaagggggagtagaggaaagtcagttgtgcgtttttctcagggttctctttcacgggaagggtgatttctgctcttgtccttgtctgtacctatgaagataagctggtacttgacattgccagggtgagatacaatagaactcggttttagggctagtttttagtgggggacatatgttctgatagatttaggggctcacaagaaatctccttgtgagcactttgtgaggaaggccatctggggagctatgtggccttctgtagttgtgggcacctggcgtatggatgaggccatgacacagggttgtggaatgacagctctctgttcggcaacaaaaggcagacagtgttgcacagttcagttcccaagcttcactttcccactggcatagtgagtttgggtcccaagattctgttatctttcatgctacttttgagtgcctctaggcagttactttctatatgttttttaaagtttcgatgttatttgcaggcgagtcagtttgataggagtaatttggctatagccagatttatagaacccatttccttttagtttttcaaatcacagttcttcctttcatcagctgtagagggctccttgcaagcatgctttgtctaggctttcagttcaaaacaatagaaactgcaatctgccttccatgcccttgtgccatttgctgcattagtagcggcacactgtcatttgtgttgtgaggttgtgatagctggaatgtgcccagtttgcctagagcagctttctcaggtatgcgtgcattcggcgcttgtgcacacgctgccaccacgtgcgtgatgctggctggctgctgatagagcctgtcctggtggagcttatagtctggtgagggagacagataattgaaaattgtataaatagttagaaagctacaattgcagaccttcttacgaaagaaatcatatcaggcaccaagagcaaacttcaggggaagatcactgagcactgaggggtaaatgggaggtaaccaggcaaaaaacgagaggaggtttttcctcacaccagcacttcgtcaattgtctgacactgagtttccagtggttcagttctattcggacatttgtctcccacgagactgccacatttcaaacccagctgcaaatggggtgcccaagctatatactcctacctgactgagtacagatttgagggttcccatgactcccttcaggtttgataatttgctggaatgacccatgtatgtaactcaggagagtgcttgacttcctggtaccagtttattatgaaggatgcaactcagaatgagatggatagaagaaagatgtagggtaagggatgggagcagagtttctaggccctctgggtgcagcacctccgtgctttcagcaacccaaaatctctccaagccctgtccttggtggtttctaatgtaggctctgttaggtagacatgcatgattgactagatcactggacattgctgagtggcatgatctccagccccttgtcctccctttaggttgctggttggggctgaaagttcctgtgatcatggtggtctttgtgacacctagcccccatcctgtaagctgtctaggggccgacccagagttacctcgttagcatagactcgggtatgacggaaaggggttcatgatgggtaacaaaagacacttctgtcactcagaaaattccaggggctttgggagccagggacagtttatctgatatcacaggagagagagcaccctgaggtgggcattggctgtggctggagcctgtgaatggagaggagtggaacagtaggagcccggacgggcaggcgagatcaggtcctggagactttgattggatcttaggtgactgtcaagagtagttggaagccgctgatggatttgaagcttggcagtatcatagtcggcactcttctgtaaaaggaaccgtatgctctgtgatgagtggtctgggtggggcagagggcaggaggacacagagactccagaaaggaggatattgaattttgtcgagattcttttccgtgttaaataaatatccgttaccttaaaagccactgacttataatcattcagtggtaattttgtggaggtgtttataaaagttacttagcaagtctgtttttgcttaggcattgtagttagtgcttctgggatccacggctggttgtaggcagcgtcttctcccagaaccactctgaaccaggaagtaggtcactactttcacatacactcatgcctgcatgcattcattctcccggaaccactctgaaccaggaagtgtgggtcaccaccttcacatacactcatgcatgcatgcattcattctgtttttgtttttcccccagaatgaccctatgcctagaattcttttgtagcttatatgactttttccaagcattcctttatccccaaaagggatctctttgtctgtggttgccactgtagttgatacttccaaagtgggaggagtgccctggggccttgtcctcctggggtccttgtgtggtcctggaaggtgcagcgggtgatttgcttagcactggggcagaagcctagatggcattccatagaaagcactagttaagatggcataaaagagttagtctcattataaaatatccagaagctgtagaataggacagagtgaaaaaccaccaataaactttttacccagatgtaattattgttgatactgccttccacttctctaagctttggtgtatgggagaacacatgcataattagggccaggattgagggcctgcctctagttaagataagatagtgagtgctctctcaggagagcctgcctgttgcatttgggcagtgaggtaacctgatttgacctcagtatggggcaggtgtgaatagcacaggcagaggcttctccttcctagatgtccagtacagaagacattacatgttttgctgcaaattaaatgattgcagatgtgaaaagaagttatcccagaagagagctgtagaagaattctaaccactttaatgtcattaggagagtttttcaaatactttaacggcagctcatgtctgtctgatggctgccttactataaatatgtacagtgaacttccatgtacagacctactatttattgaattcttagtgtgttcctggtattttttcagttattaactcattttatcctttaaaggaccccatgaggcaggtgtttaaagataagaaagctaggacaccaagagggtgagggatgtgcccaaggttacacaactggtaactggggcctcagatttggagacaggttgtcttcattcgaggtatgtatgtgaaaggttgattctgagagtccctgattcatagttccacctctttcagttggcagtgcttttcgcaggcctggcagcttctcaccccaccctctgctgccctaaggcagccccagcgagagcccccagccagttaggttcctctcccagggccaggcccagcagcagctggagcccaggcccccttctcctgttgggggcagggcccctgcctcactttgggacaagaaagccttagtggggagaaataagatagtgagtgctctctcaggatagcatttgaaatgcagttttccttcaaactattgttctatgtgtcggagaattccctgtactacatgatttactgtagaccctgttacagtatgatttagagagtctttggactagtctgggaatgtggaacagtggtttgtaaaaaattgcctctatgggaaaatgaattcttggaatctaatagtatcttttaaacgagtttttaaaataaaactgataagttgggaatttgcttctagtttatgatagaaaggaggttaaattctgttgaaaatagaacctcagaagccctcttatggaacatccttgttgtaccaaattttattcttacttattttgatggtgactcagtggtgttgtaatacttcccctaaagaaatactaaaatacccagtaactctccgtctctttgtttagatgccagcgcatgggctggcaaacagtggagatagcaggatttgccctgttcccgtctcagatgtacagctcttgaaatagtgagggtgcctggatcactgtaccccagagtctccaccaagcctgggactaccacactaagcttgttgtgtgtaactgttgcttggggcagctgcgaccatttcaccattcctgcttgagtgttctgggtgctttccccaccccgggtccccagcctcccccgatccctatactttgtgctgctttggcgatgttcagggccacccgatgacctctcgcaacccagttatcacagttcaaatgtctcagagcattttggctctgctgcatgccaccatgtgatacatgggacgccttttcctcatggagtttcacataggtttctgatggttctgccgtgttctctggctacctgggagatcacaggatgccacgcctgtggaggactgtgagggaagcctacccttcttgtagctcaagttgaaccattgtggtgctggttcatgggtgctattagtttagagggcaaggtggtggtgaattccatctccagtcctttactcagattgttctaatatgttgtacattttctgtaagatgatagtgaaaacagtacatcaagagaaaaattttcttctctagagactcattctcagcatatttgttgtttgaactgtttttaaataaatcggttaactgcaatgtttgtaattttcagtttctattctggtgacagtttttttaaaaatgtgattttgagtcaagttgtttgagaggatatgggtgccactaacatgaaggccgggctcagaagaggattcgggctaaggcgctgagtcactaacatgaaggccgggctcagaagaggattcgggctaaggcgctgagtcgctaacatgaaggccggcctcagaagaggattcgggctaaggcgctgagtcgctaacatgaaggccgggctcagaagaggattcgggctaaggcgctgagtcactaacgtgaaggctggcctcagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggctcagaagaggattcgggctaaggcgctgagttccgtttggggttgctgtgcatttcagttggagatgtcacaggggagggtggaagcggatactgggagctgcagacttcccacccggcctactgcatgtgtgggaagaggtgtggcccaggtaaaggttaggtttggattgacagctctcctggtcacctgcctcatgttgcttgcccatgtctgtcccagtgtcctcatctataaagcaggggtgctggtgtcacccacccagagtcttgcggaggtaaagtggcctggtacttacggaaccatctgcaaatgctcggggccctacttggcgtctggagctgagttctcctgcagcctctgttctgccagggccctccctgtgcaccatttataacttcagttgtgaaaatgtaacttcgcactggctttggagggccctgagtgagctggctggtgttcgtgaaagaagatctgttttcagtcacattggtgagggacttttttcctcacccttcccatttctgcagctttgtcttcacttgatttcactttctgcccttaaactcggggacattttatgactgtctttaactgggggatatttttcctgtggaaggtggggtcatggtgctttcttttcagtgctgcgtttctcttggctctgtcgtttggggatgtctgacaggcagttgactagccatggaatcaggttggaagtagagaatgatttaatgaacttcatgaatggtgtaatgaattggtatgatatttcattcgttgtctggatctttttaatgtcgatattttaattatttttttcctaaaatagctggaggcaacttatttttaaccgccagctagttaagccatcattgcctgtatttggaatggtagaaaacaaccaaatgtgtctttagtcttattcttatcctacactaatcagttccttgattagtaggctgtagctatggaggaggcggtagctacggcataaaccaaagaaggcaggaaggtttcacttggaaggcgatggagaaatagaccaaacgttcaggaaagaaacattttggatgattaaggaagctttataaatggcatgtagggaggcacagtgattggaactgcgggcgctttgatgtttttagccaccatgccttctttcatagagggttacctatggcatgttctccctgcccacactcaggttctgtcctgagcctgctccggttctcagttgatgcagtatgggctccaccatccctggtctttcagtgtcacaaccagttgttagctcctgcctctgaagtcagcctttctggatcagatctttcttgattgttcagcttgtcttttcgtgtttgtgccgatctctgtggagacctttagttggcgtgcttcaggaattcactggcatctcctccttcctcctcttccctgctcactcgctctcttcgtattacccacctgttgatttctttttagaaacctttagtgtatctttaactcttccttttcccccaccttgaatcatttgccgagctacctcttctgtgcctgacctgtcctgaacgctgtagttcaggtcttgtgggttttcatggtgtctgtgcgctaacctaactgggccctgacttctagttggctcctgttctgtccagcttctccaccagcactggtcctcctgaaatggttcatcccagaaactgggggtgacaccgctttattcatttattcaccagctggtcttcaagacgtttggacaggacctgttaaaattgtggcaatttttgcttcttgaaaacagctaatttagattggttccaaagttgtaataatctacagatgtccctctacagattggacctcctttttggcctctgtcctcaggccttggcttatgagcctttcttgttgctgcctggtggggctgaaagtgggattttccccccacccagctctccttactattccctttgtttggaatcacttctgcttatcttcttactaaaatcctacttaatccttcagtcccagtgaacataccaattcttagtacagccttccctttgtctcttgtgttttgattgaatgtatgtcttgattttattttaatggtaaatgcctttcaatgtattacagacatcagtagactgagttcccatttgttgacttgtatatgataggacttcagtgtagtgtatcaaagaaaatatccaatgtgtttataagtatttaatgtaattgttataatagttaaatatcatgtaatgattttgttcaaaagttaattataaagcctaagataatagggaggaggtggagcaagatagccaaatagaaacctccactgattgtcctccccacaggaacaccaaattgaacaactctccacacgaagaaataccttcttaagaatcagaatcaggtgagtgatcacggtgcctggttctaacttcatatcactgaaggagaaactgaagagggtaggaaagacagtcttaaattgctgatactactgctccctcaacttcggcagcagccacgtagcacagagagaaaacctgtgcacttcggagagggggagggctcagtagttgtgagactttgtattggaactcagtgctgccctgtcacagtggaaagcaacattgggcacagaggtagcatttagaccagtcctagccagaaggctagtccctggtcccagcagttggaacctgagttctggcaggccccgccactgtgggctaaaatgacctggggttctaaataaacttgaaagagagtctaggccacaaggactgcacttcctggctaagacctagtgttgtgctggggctctgagccagtggccttggggggcctgcaacctagtgagacctcagccggggcagccaagggaggccttgcaccaccctcccacagccacaggcagtgcagcctgcagctccaggagagactcctcccacaaccacaggcagtgcagcctgcagctccaggagagactcctcccacaaccacaggcagtgcagcctgcagctccaggagagactcctcccacaaccacaggcagtgcagcctgcagctccagtgagactcctcccacaaccacaggcagtgcagcctgcacctccaggagagactccttccttctgctagagaataagaggagaggaaagacggctttgtcttgcagcttggataccagctcagccacagcaggatagagcatcaggcagaaccctgaggctcccggacgacatttatagacataccttggaccaaaagggaacccactgcttggaagggaagcacccagttcctgtcaggatccatcatctgctgactaaagagtccttgggccctgagtaatcagcagtggtacccaggcagaactcaccatgggtcttgcatgagactcaaagacgagctggcttcaaatgtgacccagagcacattcccagctgtggtggctacagggagggactcctgcttgagaaaaggagaggagactttgtcttgcagcgtaggtatctgcccagccacagtgaggtggaacatcaagtgggctcttgggagtccccagtttcaggccttggctgttagacatgatttcgggacctgctgtgggctagaaggcagcccactgctctgaaaggagagtctcaggcctggtggcattcaccacaaactgactgaagagtccttgggccttgaaggaacattagcaataaacaggcagtacttgctgcaggcccggtggtggctacagggagaggtttcctgcttatggaaaaggggagtgaagagtgggaaggactttttcatgtggcttgggtgccacaagaaatattcaactgcagtagaatagtgcaccagctagattcctaaggtttcagcttccgggctctggctcgcagatggcatctctagacctgcccggagccaaggagaactcaccgtcctgaaggaaaggacacgtgcccatctggctttgccacctgccgattgtagtgccccagggtcttgagcaaacataggcagtagttaggaagtggttaccatgggccttgggtgcagtccagtgctttgctggcttcaggtgtgaaccagtgcagtcccaatggtggtgactacaggggtattgtgtcatccttctctagctccagctactcatctcacacacacacacccctctctctgtctttctctctctctgtttgggagagagtaagggaagagagcaaagagtctctgcctagtaattgaaaattcttctggattttgttcaagaacaccgtggtggttcctatgtgaatcagcaagagtcacagcattactgcgtgtggggtgccccaatttaatgcagatacagctgcagtgagaccaaaaacttaaattgcaacacccaagtccctttgaatactggaaagccttcccaagaaggatgggtacaaacaagcctaggctgtgaagactacaataaacacctagctcttcaacgcccagtgcccagacactgacaaacatccacaagcatgaagtccatccaggaaaacaggaactcgccaaataaagctaccagtaaacaattctggagagacagatatgtgacctttcagacagagaattaaaaagtagctattttgaggaaacaatgaaattcaagatgacacagagaaggaaatcagaatcctatcagataaatttaaagagattgaaatatgaaagaatcaagcagaaattctggagttgaaaaatgtagttgacgtactgaaaaatgcatcaaagtctcttagcagaattgatcaagcagaggaaagaattagtgagcttgaagacaggccatctaaaaatacacagaagagactaaagaaagaatcaaaaacaatgaagcatgcctacaagatgtagaaaatagccccaaaagggcaaatccaggagttattggccttaaggaggaagtaaagagagacataggggtagaaagtttattcaaagagataacagatagcttcccaaacagagagaaaggtatcaatattcaagtacaagaaggttatattaataaaacacgaagtagatttaacccgtagaagactaccttatgggatttaataagcaaactcccataggtcaatgatgaagaaaggatcctaaaagcagagagagaaacaaataccatacaaagatgctccagtacatctggcagcagacttctcagtggaaagcttccaggccaggagactgtgggcctgacatatttaaattgctgaaagcaaaaaccttttatcctaggatagtatatctagcaaaaatattcttcaaacatgaaggagaaataaaaactttcccaaacaaaagttgagggattttattaacaccagccctgttctacaagaaatgctaaagggagttcttcaatctgaaagaaaataatgttagtgagcaataagaaatcacctgaaggtacaaaactcactggtaatagtactcagaagaatacagaatagtataacactatgtgtaaactactcatatcttgagtagaaaggttaaaagatgaactgataaaaaactacaagttttcaagacagtacagtaagatataagtagaaacaacaaaaagttaaaaagcacaaggacaaagttaaagtgtagagtttttaattaatgttctgtttccttgcttgttacattgtttacacaatcaatgttgtcatttaaaaataatgggttttattatttggaagtccatggtaacctcaaattaagaaacatacaatagatccataaaaaataaaaagcaagaaattaaaacataaaaccagagagaatcacctttactaaaaggaagacaggaaggaaaaaaggaagagaagattgcaaaacaagaaaacaaatgacaaaatggcaagagtaagtccatggttatgaataataacattgaacttaaatgaactaaactctgcaatcaagagccgtagagtggctgaatggattaaaaaaaaccaaaaagacaaaaaacccaatgatctataaagacacctatagactggaaataaaggaatggaaaaagatactccatgcaaataggaaccaaaaagagcaggagtagctagacttatatcaaacaaaatagatttcaagacaaaagctagagacaaagaaagtcattatataatgataaaggggtcaattcagcaagaggatatagcagttgtaaatatgcatccaacattggagcacccagataatataaagcaagtattattagaactaaagataaaccccaatacaataatagctagagatgtcaacacaccactttcagcactggacagatctttgatacagaaaagcaacaaagacacttgactttatctgtactttagaacaaatcaatctaaagatacttacagaacatttcctctagtggcttcagaatgcacattcttttcttagcacatggatcattcttaaggatcatctatattaagcacaaaacaagtcttaaaatttttttaaaaatgagattcatctcttaaaaaaatataattttatcaagattcttctgaccacaatggaataaaactagaaatcaataatgaggaattttggaaactatgcagacacatggaaattaaacagtgtgctcctgaatgaccagtgggtcaatgaagaaattaagaaaatttaaaaatttcttgaaacaagtgatcgtggaaacacagcataccaaaacctatggggtacagcaaaagctgtattaagaggaagtttgtagctgtaagcaactacatcaaaaagtagaaaaacttcaaataaacaaccttaatgatgcatcttaacaagaaaagcaggagcaaaccaaacccaaaattgtagaaggaaaataataaagattacagtggaagtaaatgaatttgaaatattacaaaagatcgatgaaaccaaaagtggcttttttgaaaaaataaaattgacaaacctttagtcagactaagaaaaaagagaagacccaaataaataatttttcttttttgtttctgattttaaaactgatactgcagaaattcagactcactagaggctactgtgaacaactgtatgccagtaaattggagaacttagaagctttggtagtcaacaagagagacctgccagaggtcatgtggttacaggggccccgtgtccctgtgtgtgtgtgtgcatgtgtgtgtgtgtgtctatctccaccctgagtgggagcaggaggctacttgtgaagtctcatctctgaaggccatctgttgatcacgacaggctgctgggttccttgcggctggagatgtgtatggaggttcccccagcacattgctctgtcttcatgggcatctcagtttccatctgaaatcacttgttgatgaactgagaaccattcctctgtctagttagcagtatcactaggagtaaacatgttacgggggaaactgcttagcatttgatttctcaagtgttttttctgagacccagtaatcttctgggtaaggaaaaaaaacccttgggtaccccctttcaccttgtgctgttgctgttactgtgaagatgtagatggtatgtgtgactctagctgtcatcagatcattcatggacacaatgcaacatcacacctgttagattatggctttggttctgccaggaggcctggtgggagcagctggcatgatgcgtgctgcctctcatgactcatgtgcaccatcctgctgcccaaggccttgatgtagcccctgtggggtgccctgtctgcatgttatcacactctgaagagcagcctatggagcacaagagagaaccgaggggaacatcccctcctttaattctgaactcatattctgtaatggtgatttctgtgagtctggctggttgtcgtgtgaattcaggtgtctaggcagcgttatgtgtggaatatgttggcacgttatgctcgagtcctagggctcagctgacctttatgagctttatctgctactgaattaatgaacaagggctttatcagccatgaaactttggtgatggcagtgacagaaaattcttgggagaattggtctgggactgaaagaggtaataaaaatctagagcctaggctcagtgcggtgaattaaataggaaaaaccactcgtaccgtgaattgttcgtttataagctatgctgaaatatgacttaattttcattaattgatgaaatatcagaaatgaaaatcagtttatccagatttccttttctgaatggatcggggctgtggcactggaccaggtaggagatgaaatcttagcatagcccatggcccagcactgagcagtatttctgcaatcctaagaatttaacccattgtgggtagcacatatccaataactttcctgtgccacatctctggcagtgttttctgtgcgtatacctttggcattccatcattacccagtgctcttcagtcctcctagtgaggcatgcagggtcctgtcattctagaagcccgcctcttcctgatatttcactgtgtctctgaggatgaacatcacctgctcagatgtcagaagattctcaaaacctgtgtgtcttaaagggcgtgttcttcctcctctgtaggctggcagcagtttgtagctcctgtcactgagactacataattgtcttcagtttacttctgtacaaaatgatagaactcactttaaggtagagactgtttcttaccctgtttttaatctgttcccagtgccttgtaatggtgctgcatacatatagtagttgaaattaatttgagtcagtgactaccctgcaaatggacagaactgtggctaatcccggtaggttgtggaaaccccgcttagctgttcacagttggaaatgggtctgcagcagtgcagatgctagcttactttgccttctgttgtgttttaataaactaaacagtaaagcaccataataactgcatgacacattcaggatttggaaacatggcttggatgaattagaccagtgttgttgagagcttgcattgatggaaacatgctgtatctgctagacaaatttcagtagcctctagccacgtggggctgtgaagctctggaaatgagattaacgcaactgaagaactgaatttttaatttttttaaaaaatttagttaaccttacttgaaatagctgcaggtggctagtggctgttggatttgagggtaaagaagcatggtagagaaggcaggtgggacagcctcccatctgcgcagagatctatatgtcaccgccaccgacaggaagacttgtgcatcctaacccttagcctccttgtgctgtgggcaaggtccctgctgttgcagaccccactaaattcccagtccgtgcaggtaactgttgtgcttctgtgagcccccgccagtactctgggtggggacatgtcttgctcagacagagatcaaaggagagctaagagagggagagagatggacagttaaatattgaaggagggcgttggcctttttttacacagcacagggaagagactagtatgtggagggagcacttacatttggtagatgttcttacacagatcagccacctgaacgtgtgtgggatatttttattacctatattttacatttctattgtctgtattatttaccgtaactacatttgacatctacatattgctatgttttagaagcagaggtttattttcacctctttcctgaaggccatgttttataaaactgacatgttatctagtctagaagggaaggcccagctgggcatggtggtgcatgcctgtaatcccagctactcgggaggctgagacacgagaatcgcttgaaccgggaaggcggaggttgcagtgagctgagatggtgccattacactccagcctgggtaacaagagagaaactccatctcaaaaaaaaaaaaaaaaaaaaaaagaagacccattgtgctgggaatgcttgagtctgaggagagaaaacggtgggtggtgggatttggcacctctgtcacagcgttacttcctgtgcttttctgtctccacagctattataggacgtactgataacagctcagtaaattttcttaaattgatgagaacaggaacagtctttttgagcctcggttaacagttactaagaaatgaataaaaaatggttgaaaaacagggagaagaccaagttagcataaattttgagtgctctgtgttttgaacatgaggtttttcctaatacttgtgacttgctgattctcctgactatgactttctccagccagtacttagccgcggagcggaaagcagtgctcatgaaggtggaggcacacccagagactgcatggaggtggaaccgggaagtccggggtctgaggtcctgcctgcagggttgaaaggcatgcctgccagcagacacatttgggagccagagtgtgctgtggtctgaatgtgtttccccagatcatctgttactacagatgatcaccaattggatggtattaaaaggtgggccttggaggtgggtaggttgtgaggatgcagccctcatgaataggatcagcagccttgtaacagctgtgagggagctgttttgccccttccccgctgtgaggatgcaataggggaccacctgcgggtgccttgatcttaggcttccaacctccagagctgtgggcagtgcatttctgttgttggaaaattacccagtccgcggtgttctgttcccagcaggggcggactgaggccgtgtgcttatcggtggggacagcagagcagaagcagtgtccccatgagttgtaggcctggaccttagacccaggctccagccacctttgtgttggatgctgacgtctttcatttttttttgcattcctctgtcattttggtcacgtacctgctctgggaacttcccgaggagcaagtgcatgccaggcagttaatccatgtgaatgctcacggttgactcagatggagacagttagaggaagcgatttccacccccgtttcaaggggtgcttcagtgtttctgggctctggtgctgaggagccccatgctgttcctcattctcggtgtgaacaggtgtttctcactcagagctcttcgcatccttgtttctgggcttctgaatgactctgctgttgtctggggcctcggtcttcttttggcctgtgtcgacgctcgtggacaccttcgctcttgtgccttgcactctttctgtttagtcgtgtgatgatttctttgattgacttctgcttatatttttggttttctgtatcatgaacttttattctgatgtggaatgactatcatatttcctttttctcctttgctccttcattcccctttttttaggcaaatgtatttgtcctttcatgccttcttataattaaggttggcacactaaaagcactttggaagtgctgtccgagagttgggactggttgactcttgttttctgtaggaatccctggtgttcatgtttttggtcactttttctctggctcccattccctaggtaggaggatgtaatccttctggtaatattgtgggtatctggggagcaaagacaccctggggtgcagggaaggtggtaagagttcacgtggttctcctgttttcagcacacgtgcccctgctccgggttgttgctgttgtccttcagaaactctgaggtctggagaggtgagcgtgtaccccgttaggcacacccaacactgaggcggcaccaccaggggccctgatgcccacagcttgtgccgacttgtcacccctcatgcagcttccagtgctggttctggtagtctcttcctcattctttttgttctcatgagtttatgcttcttggaaaagcctgttaactgtcaggatgctgtggatctggggaggagaggcacctgataggtgggcttgctttctagtctctaacctgaagggaaaggcggtttttgtattttttgttagtcttgatgttgctgctttggtagaaaacctcacagactgaataaccacattcaataattctccttattttatgcaaagctgaaggctctgtgacatctgtttttctcactgcccaaagaacttgggcctgagggttggttgggatgctgtgcagtctgaatgctgctggagaggacctggcagcacagctgctttctgggcgccccttctccttgctagactcaaggcagcaacacatgtgtgctgggatcggggcctctggttttcacagatgggtgcagagggaggttttccttactcagagtattatatgtctgtcagttagcagttgtcctgtctgtaaaactgatgactatttccctttgtgtcgcatttctccaggttgcccgaagctcagcagagagtcggaggctgctttttaaacctgatgccacagatgaaaaccctgtacctcacgtattgtgccaatcacccttctgcagtgaatgtcctcacggaacacaggtgcgcttgctaggcaccttggcaacagggagggtggatggctctgtgtccttcaaatagtgcatgaaatagtatgatgctaatagtcccttggttattaaagggtatgaattttaattacccctcaaaattagtgcttgagaagtactggtaagaagtctttaaaatgatggtgagtatttttgtaaaaagacaaatcttttcaatgttttccctacagcctgaagccctttggctaataggttgaaggggttagtaagtgttctggggtgtagccacaagcttagtcaagggtcctggaatcatatttcagttcttaaaactggaagtacatgagtccgagttacatcagctgtaacagaaagtatctcatttcagattaatacaggttttatacacaaaacattacattggagacccttagcttttcatcctgaaactaaaaacaagtgcaacagagaatgcacagacgttttgcttattttatgaagcaagacagtgtctgcttcctgcgaattggaggaagatgtttctcagctgtttcagttactgaggaggatctcagtcattagtgagtgttaagaattgatttgtttgaggattggcttggaggagaccacaccggggcttagagagctcagaggctcactttctgcttctaaaaagatttatattaatgttttacaaaaaattaatacaaagatttgtattaatattttacaaaaaatttcataatttcttttgaaaacagaaattcacacattttcaaaaccataaatggaaaagtattgttttagtagcataaagataaatgccattgtctttctaacttaagtatttaacttcagcttaaccgaacatttccactgaaagcctcgtcagtgaacaggtgttggttgcctcttcagaagcacatttggggctcaggtgtggcgctgcgtgggtgtcctaggacagctcagacatggcagcagggtggactcggctctggctgtggctgctcccttcaggctctgcagccttgggcagatttcctcctgtctctgggtttcagcttcctttcctgaaggaactcattcacaggggtgttacaagcattcaagctaaaactgtcagcaggtcaggtcagggtgaacgcaccaaatgctcagtgaatattctgttgtcttctattgtttcttcattttttaatttttttattttttaaaaaagaccctggatagttactgtttcctgggtgtgctcaaatataaaaggattaagattttttgaacttcctatttgttactaaagcatctgcagccctgaaaggaaacagcagccttgaacaatgtagtgaaaggaaaggaagttagaactcacagcagtggcagaaaaggaaaacccaaagaaccctccctctgcacgtcccgcttgggagcgtgggccatgtccgcagcatctccaagcgtccagcatgtttccagttatgtgctatgcccctacccctgggctgtgtccacagcgtctccaagcgtccagcatgtttctagttatgcgctatgcccctacccctgggaatttatacattgaatgagatttccagaaagcgcaatgcaagtgttaaatttgtatctctggaaattcttcaagaattgttgatggagtcatgaggaagatgaacagaaagttcatctttctgaggacctgtcctaaagatgacattgaaagtcactaggactgttagtttcctaaaatgcgaagccattcaagagcagtgcttgcgggcgtgtgctgtgttgatcctcttctctgttattaccttaatgagtgtgtttgtcaggtcttaatgtacgtgtagcattttcctgaagtaactagaagaaagaatacaggtgggtttttgagtcaggagggtctttgtgcctccttcccagggctgcccagagagtggaggggcaggctgaggcccgctcgggacagcagccccggggcaagtcaccattgctttagtgctgggagtcagagctgcggcgagaggaaggtcccccgagccagcaggtgccgccactgtggaacatgaagcttgtgtgccctcccgaggtccctgcaccacgagagttcccgctgtgttggccacagattcctccccaccccaaagacacagcagtgaattggggtcaggcttccctgtgccaaggctccttcctacctcctgcctttgtacttggattctttcttggtcctcttgccagcttttccatgtgtgtgacggtctttaagctgccacacctggggtagactaatctgctcatgctgtggagtaatttttaaggattggttcaagtgcagtgggttgaagtttaaagtcttatttgcatcctcactgtccttgtgttacttgggtttaagttctaagtgtgagccctgcgagcgcagaatgccaactctgaccgttttagcagctcagaccttctgcagcgtccagtgatggcagcaacacttgtccatggccagctattttgaatgaactatgggtgtcataatttagcctttgaaaatgatttttttcccagcagtttgttcctctgcacttggctccatgcttgcatgtgttttgtggctgccgtcagcccacagcactgtgtcggtaaggactgaggagacccactgtgtacgggctgctggcatcagcagaactgaagctgaaagagcagtctttggtcagagtagctgtaactagctgttttgttttattatggcactactttttttttttttaacttcaaactgaaactaaaacgatgatccacaaacatttataaaatttcatttcctttttaactgtatttgttctggcattgtaagagtgtcttgtggatattagaaggagttttgcttgcacatgtttcacttttttggcttctgggctttttttgagggagtggtgatgagggtaactgtttagttttgttagtttttctctgctgtaccgtagttaggaaatttcacaggtaaccctgaaatataaataatgacctgaatggatttttccttgattcttattttggtggaaaaggtacttatgtggattacatttaaaggagttgaaatatatttttagtatcataaagtttgattttcatgggactgcctgataaattctccaacacctagagaattgttggtaaaatataaattgctcctgtctgaagccctcatgtcactctattcatgctttaggaatggatagagtgagtaatgggaagaggagcacttctgagtaagaactgggcggaggggagggatgtgtgtgtgcggaacaggctgcccgtggtcagaggggccggccatgccatccacatagcaggggtccgcctggggtgcagagcgtcagctgttctgccggcagtgatggtgtgggcagtggccttcatgcaggccgtcgtctgtatcacttgcaaaattgtaggtctgccccacccagtgatgtttggagcattgatgtctgtgagtgcctgccctggtgcctagcatggtgagcagtcctgtggctcctcctctgtccttgtggtcctgctgtccacagagtgctcacagttgccccagctgagaaggggcgggggacagtggctgtagtggctgcagcagatgggagtctgtcctggaccctcctcagttccccacccatcttcccggggaaggtggatgctgaggaaagaaggcagaggacgtgtgcgtgtttagaaatgataggaacacatgcggtgtgctcatgggctcatgtcaatgcagcctgtacggtgagcaggacaccttgctgtgcaggtgttacccacagcaggcccctgaagatggcactgtgctttatttcagtaatctccagcctgggattgtctcaaggaaatgatttttggaaagcacaaagttacagacaaaagatgttgagttgtctgttgcccacaaaagtgcacttgctctcgtgcgtgcgtgctctctctcacaaagacagacaccacgtacacacactcggaagtactcttgacagtctctgtgctactaatttttaaaacagcatcaacacgatgggcagccttacagaaataattatgaagccttatatatggagttgataaaatgtttcttgtcttaatttttttacaagtggatatatgcaacattacccttttttataatttgctttagtattgataatatctgttaagtgtgtatatgtatgtgtttattggaagtatttcttgttggcaagggcagacagaggtgccgcacccacatcgttactgtttttacacagcataggactgcaccctggccttggttaatgagaccaccctggttttgtagaaagcgttgagatgtaagtggccttctcagaaggtcttacgtgcttaggaagtggaaggctggtttcctaatgactgtttggttttcagcatggtgtttgaatcggtttcattggaggacattctccctggctgccctggcaggggatccacatggaataaggagggtgagaagcgggaagggctggcaccaccctggctctcagtcctccttatgggaagctgtgtttaggttgaactctctgaaactgttaatgttcactatttgtggactcagtttcctctgggttagccaaaacactgtctgtcttttccccgggagcccttgatggttctggtgtccccgagacctctggcagtagccagcttggctggggtggtgcggtgggaggctcctgtgagaccagaaccggaaattggcttgtttctcagttttgctgttaggattttcatgtttattttaggacatcgtttacataatgaggatataaaagtatcttttccttttaagggaaaacctctagactaggaaaatttgttcctaggatttgtgccatgggtatcatttgaaccaagctctgctgactagagacccctatcttctaggatggggcgtggtgatggggcgggggtcacctgggtctcctggatgggatgtggtgactgagaagtcatcctggtctggacctggcatcggctgccagcgctggtgctgcctcccctcctttctgtgggctgtacactgtcagatgtgtggactgatggcacatgcaatttgagggacagcagacccagggcctgacagagacctcagagatcgccagtgaaggggtgttgcggtcaggtgactgtcagccttaacaaacgtgtgggtgaagagctggaccccccacagaagcctgcccgtgtcctctgccacagccatgggaactctgaggacaaagatgacacacatgaggacccactgtagggaaagataggcgaggcactgtgaaggggatggttgaagaggaatacagaaagttctaaaacttgtttctgactctttaattttgggatatgcactgtttctatgtccatacacagggacaccttccttccttacgtgttgtgaggattgaatgtaacaatgcttttgaagttctaaagcgtaaatcaacattcgctgtctgcacacagggacccctttcttcctcacgtattgtgaggattaaacttaaagcttttgaagttctgaagcctaaatcagcgtttgctctcttctcttgctgcttctcgtgctcctcaccccaagagccattgcctactcccaggctgagtgctggcagcacataggtggggcctgctcgctggacgaactcgcatctggggatgactaccatcagtgtgctctagctctttaccggagcagctcggtccttgttctaccaccttgagactctgagattattggaatccattctggctctgagtgtgcatgtttccattggatatgtctgcatggcactgatgtgctggaggacctcgccatcagtaggatctcatggagacccacatgtcctgtgctgtgtatagttattgttgctcatatgagagcaggaacgggaccccttagggatgggagtcccctttggcatttccagataagcagcgcagatttgggataaaagctggagccttccagatgttaaaagcaacacttatgtttcataaattctggctgttgctcatggagatgagagagccaccattgtctctcattgctaaccacgagtgtctctcttgccacttgctgcccagtgaggagttgggggagttcatggagaccaaaggtgccagcagccctgggattctcgtgctgaccacgggcctgagcaaacccttcatgcgcctggataaataccctacgctgctcaaagagctcgagagacacatggaggtactgcgctttcattctcttacttggagtccttaccaagggttagtggcatggtcagacttactgtgaaagaaagtattattcatgatttattttagaagccagaaccaacagagtttacaaagagttttgttaaatattatgtttttctccttattccagctctattagaaaacatttaccccttatctctcttttacccactgctgctgattgaaaagtttccaaaagctgaaacatgagaactgattttcagatagtgttgagatgtcttacctggatcatccagctacaaacaatgtgtgcataggttatagggtaatactgtactaatcatttgatgaatgattgtgctcttttaattttgaataacaggttgcagcctagcagaaatttgggttgaagttactctcttggcttgagttggcaaaccttttctataagggggcagactgtagggtcttcttcacggctacacagctctgccattttagatactgtatgtgagccgtggcagtgttccaataagactttattgatgaagcaagtgttggcttccccacccctgctgcttgtgactgttctcttccaacttatatttccccaaagtctaatggcttcgtgatttgctgaaagactgacactttaatgctgagggaaaaagggaatgttaagggttgaaaagtgttagaaaagtttcaagctggtctgtagaaagtacctttttaagaaaagcttttccttatgaaagctaattgtatgtttcttttactcaaaggattatcatacagatagacaagatattcaaaaatccatggctgccttcaaaaacctttcagtaagtgattaagcatattgttttcccccccagacattattgtgacaaatgaatgtaaaagaattatcaactgaaaaagtcaaatgattaaaaaatgacttgtgctgacatgaaagaaaaacagagtcggcattctgtggctggtaaactccttttagtggactatgatagaataattatttaaattttttaaagtcactgtgtaattgatgttagatctactttaaaattgtttaaaacatttttttacccttcattcatgttgtctttaatgatttattgcaaaacagaacaatggtggttccattttctctgctgttgtgttgtcttaccaactgcgttttggaaatatatggccttattttatagcacaagttatactttctgtttcttcttttcagtcttccatattggcaaacacgaacaaaaccagaatgaaaatacagttcttgtcctgtccacatttcttttttgtacaagtggcaaaatgtgctctatctttctaaaataatacttagtattccagagcagttgtgtgtgttgcttctcttaacttggtttcatacttctaagcaaatactttcaattccctataattaagcaaatcgctcaataaattatctgtctgaagaagtaagatataaagcaataattgtcttaaggatgatacaaagcaatgtggccggaacttaacattctgaaagtttatgtctgttaacagtgttgttctgtgtctgtcaggcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggtactgctgcccacatgcacgcaccagggtttctgtcccactcttaggagctcatagcagaagattttaaaggcatctcaagcgatgaaaaatgtctaatagaagctctatcttataatttgtgagctactttttattcttgacacaggagagaggcttatggcatgttagagaggcttagagctgagtgtggacttgttgatcagtttgatccagctgaagtcagtgtggcccgaagcccacgtgaactgaaggatagatagtgtgcagaaagacttgcaggagtcctgtgcacacatccgcatggagctgtatgcgcttatctggccagcaactttgtaccaaggctcactctcacagggacctgctgctctcaatgctttcgggtcattatactttcctgtgaaagtatgctagctgacatatgcttacaggagtcacagttttcttacaggtttggtttaagtgagagatcaacccagatttttgggacatacccacccacacagtgaaaatcgagcagtttgtttcatgattcacattgacatacattcaatgggtcactgaacaggcacctctttctgaattttattctacctttgcaaaaataacatgatcaaaacatgcgaaatgactcatttttgaacacaagactccaaggagaataagaaaactaaaacttcaaacttatatagtgtgttttcctttccacctgtaaaatatcaccccttctacatagtcttgtagtttgggtaccataagaaaccatgattataaaaacttcacatcttttcagaagaagtttctttttgagtcatgctcttttaaactttaatctgtggaaacatttcccaaagtgtgttctttataatattagatctatacagcactggtgggtgttactccaaaatgcttcagagtggttctgatcacgactgaacgtaattagtggaaaagattctttatgatagagctcctcagagacttggctgtgaatgttcccaatgtatgttgtgattcttcaagaggggaatatagcaagtcgttctcagtgacttctttaaagtacggaagactcttttctcaaggtgctttgcataagcctaatgttctgaggaatatacttggggaaactaattcctaggactgatttcacttttttgggccgtagtttaaatgtcaacatgtgaaaaggactgtggcatttttttgtctctttttggattcttaggaacttttttctttcacttatggtctctttggcttttatcttactgaagcaaatgatttttaatacataagtaatacttttaagtctgatgtaaaccaggtgatgtttatggggtggatgaaaacaacactgagtcgacatttgggaggtttgggaagtgccaggaattactagtagaccaaaattgattttaacattttatcctttctttagcttaaagactccacctgttccccctgaccccattaaaatttataggttctctcctttttctctgaaccagaaaaagaaaattttagcttacctgaaaatagttaatcacagagctgaactctttaaccaaatatagtttcaagatgttacacaggctaattgtgagtccaggatcttttaatcagtccgtttactttcttaccttttgttttttgaagaatttggaagtccttctctttacctatatgttaaagctctctcataatcatatgttaagacttaatacagaatttatcataattgtttccatttaatttacctgataaaacttgatagaaatacctaaacgagaaatatcatgtaatgtttcatagggcctagtataaataagtgaagtatttgtgctcacatttgttaagtagatgttttttaagaaatgttttggatttctttttttgtattaggaaaagaatgaaagatatcttctactcttcccaaatgttttgctaatgttgtctgccagtcctaggatgagtggctttatctatcaggtaaaacacaatttaaatttatattttattgtggatctgaggataatttcaaactggctttgaattttgtgttaaatattacgtgtatctatctgtgtatgtgctgtgtgtgtagtgctgtatattcagatatggacgtacagctcctgtttgtgtttcgttgtgactgcaagcatatcctatgttaatttcaaaaaaggaaagaagtgtaaactgtagagcaacctcataaggacacagactactgtggcacaagtcagtctctgtcattgccttctgtcgtttcatgcaaaataccttgctcctccttgctatggttttattctgtgaaattggttcaagtagggcttgtgggttagtggggtagtgtagactaagatcttgtgtcagtggcacggcaccgcccaaatgcatcagcaaacagaaagtgatgtaagggtgtaagtagcagtgtgtgatcgttgaacctttttaatttttgtttccctgcttctctttgagaaaatgtgacagcagatttgggaaggaggtgcaagggtgagcagggccttttctgttgcgacagtggtttatagtggtggtatatgaaggagctggtattttcgctgtctgtctagtagatgcacttggcaggtttcattcttctttttctgggaagttacagaggctcatatccttcccatcaactttctgaggactggccagtcaccacgtaaccactgcagcagaagccgccacttcgtgttctctgggttgcatttcattgtagcacgtgttgttttgtgttggcgcagcaaggacgttcaagatccctaagcagacactatgccctcacagaggctctgccgacacccagagaggacttgtggccatacgcttacaccaacacacgtgctttagaattggtgaatcacatatgtaggaacagactcaggaaagtgaggctgtagtttgttaggccactgctgaagagaggtgatctgtggctaggatagtgcccactacagtttcccccaaactagcagctacttctgtgttaaatgaccttgataaacctaaatctctgtcctttctggtcagcactatctggcttccgattttatatccccagaatctcattccagtggctggaggcaggggccttctctaacctaaggagagaagaggttgtcacttgtggcaggcttgagtctctgcctgtgtggctggtgcttacactggatttgcccttgatgtgttgacagactgctggagctcatctcaacaacaggattttatttttccattcttagcacagtggtgacccatggtctctgtatcattggtatccgtttctaccattagaacactggctttgggggatgccaaaaagtgttcggtccagccacagtcatagtgttctatacaccgatgttcagaggggctaggttaaacacagttgtgcggtttcattttctgtaggacttacagctgttaaagtacttatatgcattacgaatcttggaaaggagttcacagtgtgtagcattttttaaatacgcttggccacagaagtgtccagcagtctcctcttccaccggccatgctttaggatgagatttctcagcctgggcactgctgacgttctggactggatcgttcatggccaggggctgggggtctcggtgagactgtcctgggcactgtagggtatcagcagcctctctggcccttacttgctggaggtctgagcccctgccaggttgtggcactgccacccattctctgtgggggcacgttccccacaccagttgagcagcactccgtctggaggtgcttatgtagaatcctgctccgcagctgatggagtgctccccaggcagcgctgcccagacgcccactgcctcttcctgcggacttggtgggccaccatgtactgtggtttctgtcagctgtgccaggatgttttgtgttcacttctgacttgtttgtaatgatcactttgtaccccctttctggtatctttccattgacatttcctggtgcagttaccgatttcttctgttttcagggagcactggtttgccaaccattttgtgcattgtgtgcagcatttagcacaactacttattttctgttttacaaagtagaatgttatgaaattcttgttcttgcctcaatttcccacccttattttgactttaaacttggaacttcctctgcatttctttacgaggaaaatacatggttcttttctgcaaaaacatcatttaaaacaactgttatacacggtagttttttaaaaatcataatgtgtgatgtcttttgtcctggtgtctatgtttagtagcagctcatcagatacagtgtgtgtttgggcttgtcactctgtcccttgtcgccagttgagtttcttgcttacagtacagtattataatttattatttgagataaaaatttttgtattatacacacatctgctacaaatgagctttttttggttcacaaacacagttcctccaccaattctaaaatcatttaatattgactttaataatggtacctttttctagaaaagcactaattgtttttttttttgtgggggggggtcttttttagggaaagcttccaacgacaggaatgacaatcacaaagcttgaggacagtgaaaatcatagaaatgcatttgaaatatcaggtgataggcacaagctgtgtgagtgctgtgtctcggggaggagaggcagcttgtccccgcgtgcagattcttgcttgcgtatttcagaaggtggtgtttaagcgctgagtggaattctggggggtgtgcacgcacgtgctttttacctgtgtttccactcggcctattttttccttctctcctatagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccgtaaggacttggtgcttctcctccttccagactccaggcgtggcatcccgtggctgagctgtcagcaagtgatcagttgctttaaaacctaatcaatatttggataaaaagtgcaaaacacttgcttcacatttctctgcagatctttggccctcttcgtgcagtagtgaattgttttccaatgagtgttctcgagaaacaaccctgaattgtgcctcctcacgcacagttcagaggtgcttgggtgggaagctgcttctgctccgtgtggccctagaagactgatttaggggagttttacactcaactatagatgatttttctgagaattttaactgtttattatgcttcatttaagaaaacaaaaaataaatgattatgatgatgaaaagggccagactcatgttgaaggcattaaaagaatttatgacacactgttgattttaagaaattgaggtgtcttttacttagaaaagctcaacaagtctttggatatttagagacttttttttttttttttttttttttttttacaacttttcagaatagatgaacactgaagcttcagtgtttaaacctctcctggtgttttgtgctcaagaagttggtatcgggttgttttaacagtcgtcatctttatcaagtaatacggaaaaactgggcagagcttttaaagaatgaatgacgatgacacaggcgttttctgcttacagatttcctcacatccttattaggctattaggatcagctctgtcgtgtgctcagttttcatgttttcttcttcatgtgaaggttgtagctcaagaaggattgctgtactctgatattctcatcagagtttcagagtccatctgatttctttcagcagtaaagattgtaactactcattggcttttagctagcatttcatttttaatggctctaccattttaaaattctccattctttcatggagatcagtttatcccagggacgtgtgtgtacacgtgtgtttataaagaacagtggatgagctgcttcactcaggttttcaacagcagcctgaaactctacttcatacaattttatatcaagtcagcttttctctgtggccagaccctccgtcttagtgtttctttcactggtggctgggaaggcatcccttcagcggggaaggcactgtgcctcatgtttaaaatgttctgcattctcctacagagtttcttgtgtgggatgatgtattctgtgatccaactctgaccagctgaaatcattttctaattttagcataaagcatacttcctttgactttttcaagaaaggagaaacaaaaccagacactgctttgacgttgttgctagaagggatgtcttacataattttatccatctatacattatttcctatgaaaagatgaccttacagtggcttcatagcatgacctgcatctcacacaattccctcccccatgcagggactagaatgtgatcgttgcaggaagttgatggcttctattcttgaaattgtggcattagctgccgtccctctcagcctgtgttttgaaggtcgcgcacttcctcagaatgccggccccactccgtttccagttcacagcgccacacagcttgttctcccattaaatgcaccttactattgttggctaatttgaggtcattattggctgattttgagaatgacttatttaacttttctcatttaactgtcattgtgatggaatattttgggttttccaggaatataaaatgcattaatggcacaccgctctaagaagttaatttttgattaactttgttttgattaaagttgagttttctaagaacataattggttttaataccagggtttggcagtgttcagtaaagatccagatggtaaacgttctctgctttacaggttcaggcctcttgcagctgtactctgcccttggaacacaacagcagttttagacaggcacaggcctgcctgtgtgccaggaaaacttttttaaaaaacaaaactaggcgatcaggccttagtttcgcccagtactttatcaccaggtgaagaataatacgtggctgggggggaatcaccttccttcttacagccacatgccctgtgtgcttttgtgaaattctcatctttttactagatgaagtaccttttttctataaatgttactccgtagctaataaatgtggctagtggatgtcttttgagtgctggggccccagctagagctgcccctcctgtctggggcagacgccgtgaggagccccacgctcggcccaggtggcgcgagctagtgtttggccccaaaaactgactgctgagagccagagatacgaatgaaatgataaatcctgaggtttatttcacatggagtgtttaaagagcagaaggaagtgcgtgataagtgccctttcgcggtgagcacgcgagtctcatgttctctgcccttcccgctctgtgcccttggcagctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccctggagcctgagctgcctgcggcccgcgcctcccctccggccctcagctgctctctgctacaaggaggtgaggtcccttgaccactcaaacagccagatgacggtgagcatgcctcgggccctgggtgtgcccacgtgctgggccttctgtgtacagcaaaatgcaccctaactcctagagaactgagaagggggggtctgccttggttctctggttatctgctctgctgctgagaggcccgtggtaacctgtgtgggaaggcgatgtgcagggtccccctcctttctgccatgcacaggggggcctttactgcacttgccggaggagtgtgccgccaggggccaggagctggaaaggcgctgagcccaggtggctttcactccctgtgtgtgaggccatcgctcagcatctgcacgctgtctgctgcgtctaacgacccctcctctaggttggggatcctgtccaggagccctgcattttgtcatccagaagccatttgagatgaagagaacatttactaatacaaatgaaaaacaatcacttaggcggtttccccctttgatgcataagaaatcatgatgcggtctttgcttgtctctgttctcatccggcatttttatatttgctaggcgcaaataaagtacgattccaatgaataaatagaagtgttaacacttccttacacttttacctaaaccagcttggatgaggaaaggaagtgtctttagaaatctgttctgagaagtactttcacctgaggaagctgataattgagatgagagttgttttcataagcagttgagcgtgcatggtggtgaggtatgaggagtggcggtgagagtgtgggtatcgtgcgcgtcagtgtgagcagcagtgcccgttggtggggtgtgagtgagcgtgaggatggtgacacgctcttgcctggcattgtgcctctgtgtctggtcaaggccacatttgccaagggaactggagcagactttttctacattcttgccggcagccctgggggttttaaggcccacaggaaagtactgtatgagaaattaggatctgtgcttttcattttttgttctgagtctttgtttttatgatatctttcaggtaatcatgtgtgcaagtcagaatttccattttctatcatgggaagttacttgaagaatgttgctgttccttattgtatactttagtgtgcacagtctaaagaaaaagtgagctactacaagaactggtggagactgaattactagggaagaaaattgggataaaactgttgggcaaagaagtagaaagggcaacggaaggggtattgaagtgaagataaacaattttttttgataagtctggctgcatttgctttgccaactccacactgggagagaagggctcacaccgagcagctgccgtccagtgttgctgagcaccgcccagcagtagcgtggagagtgatcttgcagggtgtgagaagaggacatggaggctcgtggaggccgctctgcagcccgctctgcctggctctggctcaggtgtgctgtgtgctctgtgaccctctgcgcctgcaggtgccctcggagcacgtgaggggcgggcgttggctcttcaaggctctccatctcaatttgcttcgaattagggaagccatgagcacatgtgtataaatgtgtcttctggaacagattgctgctgcatttctaagagctttccaattttttatagaaatacttttgtttaactttttgaaggctattttagattcagagtttgttacgtggctgtattgggtgatgctggggtttgggcttctggggtacctattacccaaataggaaacattgtacccaatgggtagcttttcaaaactcacccccatcaccttccgccttttggagtccccagggtctgtcatttccatggtcatgtccatgtgtacccattgtttagctcccaagaaaagacttttaaagataattttaaaaaccaagctttgtttcctctgtttccagcctggttcattccatagcacatctcatcttctgagtcttggtctcgcgtttagcattcgtgatggtttatgtcgttggggtgatgcagaaaccagcctttttttgatatcggtatttaacacgtgcttgacagttgacaccttacctgctctgttgggacttgctttgctcactttgttttttgccgtcgtcttctgtgcttgtttgaaaagctgtttgaagaggtaaggggtgggccattccgttgtgaacactctgagctggtgtgcatgtggcccctgcacagcagccctggccgagcttggctgtgctcctggcactcagagtcaggtagctgagcactcgctcccttttcttctccctgaaacttcaaatattttcttaaagcaattattttttacttatctgtcatttaatgacaaccttagtttcctcctctctttccagttagctgtgccaggggataggtctgtcctagggagcagctgccccctcctctcctcctccctcaggagcgtgcaggatgtctgtgcacaccagcgccagcctgcctcctggtgacacctctcatcacaggactaacaggacccaaatgacacgaggggttttattagaattaaaaaaaaaaaattagccaatgactaatactgaaaatgccctattgatttttaaaaattaacgttcagaagctggtaaagaaaaatcaaagtaggaaaaggcgagaagctcttatcagtggctataataatttggggttttatacctttacagcagcctttctgatatgccagtgaaaatgattggctttagagtatgttagcattttcttttgtctttccctaggatcttagtaagagccctaagaccatgaaaaagctgctgcccaagcgcaaacctgaacggaagccttcagatgaggagttcgcgtcccggaaaagtgagtacctgcggtccgtgtggtggaggacgtggcctcctggtcacgtaggccatggctttcctgggatagagggaggcttggtggctttctgaagactccaaacaaaagtaaggtctgccccttgaggcagtgataggaataagccacgtaacatttacccaagcaagcaggagaagcgcctttgtgtcagtggtgaagcctccgtgccagtcccggcaccactgccttatagccccttcctcatccaggagctggggccggacctggagggctctcctgctcttctggttctccctctcgcctataagatattccacccacacttcctgaagtgccagcatctcccaaagcaccctgtgtctgttagaagcgtgacctgctgtgttctcctgtgggtagcacccacccgtgctgttctcttgctggtctctctgctgttggacctgtcctgtctgctcctcaggcctaggggtctgactcagctctgggttcctatgtggcctcgcagcaagcacctggcacctgttaggtgctcggtagatagcttttgaataagtggagctcttttcagaagtaagtgattttcctgggggtgactgctgggaaggggtgcacgtgaacagattgctgtggactgatgggtgcagcccagggagagagagccagctctgggaaagttgcaggatctgtcctacagggctctgccctgccccgcccctgtgtctgagctcagcctttgttggtcctttgccttcactgctcacttcctccagcctcaggaggaggcccagcagccgtcccacacgctcactgtgccatgccactgctggcctcccctcaccgccaccttatcatcaatcagcccagtgaggtgaccgtgctggggtgttcattcttttcttgtccttgtcacctgatgtccatggcagtataagtcaccatcctgactgtccttctccttaggtagtccaggtccctgaccaccagggcccctgatgagatggtgaggccctggggtctagtgattgaagtggagctggtgctggatgcctgctctgttgcttactggctgtgccggggcttctctctgagagggctgttctgtgggccacttccttcagcagatccaggggcagcactgagctgggccgggggccggctgcagctgagaccatcgttcatggacgcgtgcttcatcagcaccttcgtgggctgggtgggaaggatacagtgtggccgaaagagatccctgttctcatagagcctatgttttagtaggaggatacagacaagaaacaaaacaagtgaacaatgtgtgggccatggagtgctgcagagacccagtggggaggacaggtgggagattcggtgccagggcgccatttgagcagcctcctggggctgaggaagcaggccaagcaggtgtctggggaggagctctccaggcctggttgcagagaccctgagcaggaaccccaggctgtgcccaagggacagtgcgctgtgtgggcccaagctcccctggcagagcgggaggtagcacagcaccctgagcagcaggcagccagagtccggttccatagacaagatgatgggcccgggttttcacaggaccacgggctgccgtgtggggaacagacaggcacggatggccacgtcgacactgagagttgtcggccttttgttttcatctggctggcgtgtggaaacacgaaaatgttttaattttcatttcttgttttagcgagattggacattttttcttagaactcttcttgttttgtgacttccttattcctatctcctgcccttttttcagtttgagagtggggatactaattttcttacgggttggtaggataatcattataaagttaggatgttcgccgtttttccaaatgtgttgcaaatatttttatttgcatttattttattttattttgaatataactcatgaattttgtagaaaacagttatctgacaagaaaatcaagggcagattatcttacttggtcactttggtcgagttgatgtctgcattgcattcgtctcgccagttgccctagaggcctttcagttcgactgtgaactgttgcgcatctcttgacaggcacagctgctttggaagaagatgctcagattctgaaagtcattgaagcttactgcaccagcgccaaaacaaggcaaacactcaattcaagtaagtttagcaataaggcctgggaagtgtggtggtttattctgtttagtttcaaattacagtctgaaggaacctgttgtggtaggccccttgcacagcccatgcgcctgacctcccagtgagtgatgtttcagtcaggggtggcaggcaggacagcagctgagcttcaggtccctaaattcatgcagctgcgtctgagctgtgggcacaattgctgtgtgattttctagataaaattatactaggaaatatttaaatagaaggtattgccagaattcataatgcttttgctaagagaagacgtgtttagaagatagtggaagattagttcagttatttcagctatttaaactgttggtgtagtactggaatttttggtttttattttgttattattttttagtttcttagaaatatccaaaatacaaaccttgagcaaggtttcttttagcctttctaaaaaataattgcttttaaaaattttttggaaatttacaactaatttattcagcagatttcagaaccacaggatttacgtgtgtctgatgtacagtgtcttaaatgaaaaacttttttctattaaggtggcttttttttttctttttggagacggagtctcgctctgtcacccaggctggagtgcagtagcgtgatcttggctcactgcaacctctgcctcctgggttcaagtgattcttctatctcagcctcctgagttcctgggattacaggtgcgcaccaccacgcccggctaatttttttgtgtttttagtaaagatggggtttcaccctttgggccaggctggtcttgaactcctgacctcaggtgatctgcccgcctcagcctcccagagtgctgggattacaggcgtgagacacagtgctcggccctaaggtggctttttttctttaaatttttcctccggtgttgccagtgaagcacagcagggtggcggctgatgcagcgtgcctgtcatttaccctgctggcatctgcgtgcccacaacagctgacatgtgggcacgtgctgctggggcctcggacaccacaggtggtccttttgagaactggatgatttctgtattatctcagcatagaaactgatgtatcctcaaatttaggacttggtgccctttccagctcgactgtcacttaatctcacttgctcgttttgttaatcacctgcagtgtggtggttccaattagtgtcatgtattgtttaatgctgagaaaaggagagagagggaagaggacttctcaactgctttagcttttatcaaagacggctgcagctgtgaagataggatgagcagggtaaatccttcacggaatctcgattatccagaagcttctttttttttaaccattttcagtattttactggtgtcgtaccatatcccgtctatgacattaagactttttgccaagggtcaacactgttggtttttttgtccatactttagtgaaaaatatccatttgtagtgactgcttatcagaataggagagaaatagagaaacggaaaggcctgggtaacccatcagaaggtggaataaatatgtgtataatcacacaataacgtctaagtacaaattgttgtgatgaaaggtactacatttttataatttgatattgatcatgttttaagtaataggctgtaaaatgtggccataaatttttggattttgaatttgagatttttttgtcatctcaatttcagttacttgaaataaaattttaaccaagtagtcttagatgaacagaccaggttcagttggccacccaaccgtgtctgtgagttctgcatttgtgaattcaaccaactgcagataactactcagaaaaaagaaacaataaaaagtaacaatataacagtaaaaaataatacaaataaaaaataattatacttataacagctatttatatggcatttacattgtattaggtactataatttagaaatgactcaaagtatatgggaggttgtgtgtaggtacaatgcaaacaccatgccatcttatatcagggactggagcgtctgaggattttggtgtccaaggggagtcctggaaccaatcccctgtgggtgagggccgactgagggctgagctttgtatgtgtcatagtgcccaccacatttcttcatgaccagggtcctgtgatacgctgcggcttcacggcccctggctgcctaaggggaatggcccacaattccttttcttttcttgtcacattgcctgtattctgtacttccatttctcctgtgcaagaaaagcattgaacgatacattgatttttgtttttaattcatattatgggcaaaccactctggggcttcagggagcttgcagtcatatatgccctttaaacctaacactcaaaactagggagtaataggagaaattgctcgcttgtgctggaaaggtggtatacttactcaaggtgtctggaaatgggatcatagtgaaagcagctctttttacattaaatgcttagtaaaacgggttttagaaggataatatattttacctaaaatgcagctctgttcaatacacacatttggatgccaagaagattttgtaaaccaaacttccttggtattgatttctaactccaggaagtaacggccctcacagtctgttatgatgtagttctcgcagtctgagaacagaggtcaatttgatagaagcaggagtagggaggggccagggctactgtgatttgccttcacctagcgaggggcatccccgcctctgcatggagggagaccctggcggcccagcctgcctctcagcccaggtgcctggccatgggcagtgctcatagttgccagccactcgtgattatttctctcctgacatgttgtgccacttcctctgtcattctccttttaacactgggacgttgccagttcatgtctctcttcctgacagcagagggtctgcattggggtggccggtgttgccagcagacccagcttcccactgcaccctgcctgcgggctaagctccagcgcgccctgggagcagggggtgggttctggggctgtgggccctgcccaatccttttctgccctctgagttctcacagtggttattgattgatcaggtaagtccagacccactctcaggtttatggtcttggcaaagagccagctgaaaaagcccgtcagaattcctttgaaattattttgcatttgatacatctgtttattgataggaaacaatttttaattagccacataaatggcacctttcccaaatgatgtcctaaatgagactatttgttaattgaatgtggaatagaattgattaattgccacatgtctatagaataatcttttggacatgggtgtgatttgtaaaagatttcttaaatgagggctttagagcaatatctttttttaaaaaagcagtttgaaacattgtatattaggtttaattagataataatcgatctagttttattctaagggttttgctaagttcgttattgtgaaacccagccgtatataaggaaaaatatgcattgttgccaatttttaacactattttctcttttccttctcttcccatcaccttttgcttttgttccatgttttggttgtggctcttcctgtcgttctcctcctcaccccctgcctgtcgcgcctgtccctccgcccgcccgtcttagcatggcaaggcactgacctgatgcataatcacgtcttggctgatgatgaccaaccaagcctagactccctggggcgtcgcagtagcctttctcgtttggagccttcagacctctcggaagactctgactatgacagtatatggacagcccatagttacagaatgggttctacatctcgtaagagctgttgctcatatatctctcaccagaactaatgcacttctgagcttttcttaacaaatgcttgttgtatcgcagcctgcttttcttagatgttttcttgctgttccttgtctcttttatgtgatattttaacaacttttgagagtgttcctgatatttcccattgtactttgtggaggcttaactgccgatgcgagtatacattcgaatgactgactattggagggaggtggtgtgttcacgtgagcctacatccgagggtgctcttcgtaaggggtagttgttgttttatagctccaaatggtttttttattctcagtgtagcaactgtttgatttctttctggatacagctgtatgaacacttttctattttatactgaaatcacacaggtttgtgatctaagtgccagaaccatggaggagactctggccttatctgtagggacctaaattttttaagtgctatgaacactgatcaagtagttgtggagagatgagaagaatatatgcagcaaaggtgctgtgagcccagttccaacggctgtgttctggtaatcgtgcagaacagcatgtgggctctgggccttggcaggtgcacagacgggcgggcgtcacgtgtgttcagagcttgtctccacctcacggctctgtgctcttctgtgtgctgcgttgtggccgtgaagtgggagctctcctttccaaaggcagagcttactgtcatggctcagatgttcactcgcatcttcaccccaaacttccctgaattgcagtgatttctgttataaggcacatagcaagcctgtaccactctacagtaaaatctctacactaacagtttaaagcccgaaagctgaagcattcagcctctgcaagtgtagactactggactgtagtagaggcatttggaatacttacaaagtcaagtgctgtggcttcagttcccccggctccccacccctgacatccatacttatgttgtctggaagagccatggacacatcattattttcagcaaccagctgcagtgaaactccatttacagcaaccccatagtataaaaccacaatgcctcattgtaatgggatattgaagttcattgaagaattactaggttgccatgtggctcacttatttaaaaaaaaaaaaaaaaaactcacccgttttcctgggatttgttgtaaggagttttcactggcctcactcagaccaatttctgcttcaaaaagcactgaatgtgacctgttgcattcagttgtagcatcaaatccacacctagtcattgcttgaggggccaaattgtgttctgtcccatgcacgctctatttggtgttaaaatggaaccttacggttgtgttttaagtattcattgaaaccagcttcagaaaacaagatgccatagtaaattgagaataacattttttccttcttcagggtggctgtaattccaggtggccgtgatttctttcttccccactgcccactccttcgccaaacccacgtattcagtgttctgatcttgtttgtgcagagtgaactctgatgcagtatcagtcttgtcctgggagccgggtcctgctgctcacaagcccagagctgccagggagctcctggcagtagcacgttgtttagaaagttgggtggcttcattcagcatggaacaagctaatggcacaggagacatcagggcagctgttaattccaaatatttgttcccaagtagctactgaactgctcacaccattggaagattttgtattttcataccaattagtaaaaataagaacattgaggagcagtcagagcccagtgttaatctccggcagagatggggtttatgtatgttcagccagatagtaaatgggatttttggagaaataagataactacaaagtttctatacttactataagtggatttagaagcgattttggttttgtattacatacggtagtcctctgcgtcagggagcacttttttgtttgcctcgagactactcattagcgcactggctaagctgcctttgccttctcgtaggcgtgggttgcctgtgtcatgggctgtgtagaccacaacactcaaacacagttgctgcacttggattttcctttaataccaagtatcatttggttatcttactgggacattttcattgatattctatacaccaaagttttgacggtttaccatcattccattttgtaccagttaaaggcattttgatgatgctttttcttgatgctaagatcactgcagaagaataacctgaccttttctttgcatttgttttgaatgtctaacaccattagcttttgtgatctggttaagaagtattagtgccacaagcctgaaaagacagttctcctgtggcagtggcgatgtggcatccagagggccattgtttctacttttgtgggacttcagtcatgctgataatagaatcttctgttcatacaattctgtaatatttatttgtacagttagtattctaatgaaaggatgaagagtctgaactagaaggtaggtttaagccatcaccaggcctttgcaaatggcctaaatggtgttccctttgaaataacgcttgccacaagtatataataagctatattaattgtgttttgcataaaattgccaaaacacagtaatgtgtatatagtggtataagatcttgaaaaaaatctctataattgtgctctttatctgtgaatgggaaaagccatttttagtaggtgactaccatttgaaaaactcaattggatgtatatctgaatgttgcattgtattgtacagtatgcatattattgtttgtggttgcatatggcaatgaagtgtttgttttatattaaaaaaaacctgttatgtacagttgaaataaattttgcatttgctagcccgtggcttttaatatttgttacatgggggaggggaatagcatagtttgcagtgtaatataatttggctcttctacctgaacggaacatcttccaaaggcaggcaggtgatagatagaacccttctgtctgccctgatagaaaagcttgcactctcttagattagccgtgttctggacaagacgaagtcactccttgtacatttcttatttcatctctttcccgtttcttaagaagctttcagtcactggcgggtttgtcttcagaaagaagcattattttttgtgtgtgcgcataaatgggaaaaagcacaactttaaaatgtttttatttagactaaggccagtttttaatttttgttttataaagtgcttatccagctaagagagtaatgaagcaaaataaagggaaaggaaacgaagtacctggtggcaggtatagtgataggacaaggtgcagacagtaaatgtagaaaactctctcagcacaagttgggagttttcctaagaaaagtaaattagacccttagagccataaataacaaaatggcctagatgacttttggagagagattactaaatcgtttttaagtgtagttgtattttgctccactgtgaatgttatttgattttcagttgattagagatgcagattttagaaaagataatgaatttaagaaggtgaattatcctgcacatgtcctggttcactggccagatagacaggtgttctcttctgatgaacttaccctgtttttaggcttttggtacaggcaggcttacacaagcatgcatgcacaccacactggtgcctgggctggacagttgcgctgcgttgctcctggagcagttagttgtgtgtcgtcagataaggccccagagtggtgtctaacagccaagcgtggtggtcgcgagctggcactcggggccccaggggttgatcagcactgtgttgctgctgtagccagtcatctcgtctatgaaatggaaatgctgggttagatctgtgtttcttaaacgaagttccatagttctctagagatgtgtgactatttggggtgggggaggggcagggttctcagacatccctaaaatgttaagttttgtgctcatgttaacacacatgtgtaccagccttctgtggctcacacctctgagtgttgctgtggggtcctggtgccccctggggtctccagtcgtgtggcacacagcagcccctgagagtggaatgcttgctgcaggatttttcagcactgggcaggcagacaccgagcatctacaggcacattcttggagtcctcgagtttgagaagtgctggattggtgttaagtataaattatttcattatattcgtgtttttcttactcccacctccatacggaaataagaaccaaccagctgttttgtgtatgtggttatagaaatagattataagctgatctagcacttctcaaaatgttagccacaaaaccacaagatgttaataatgatatttaaaagaaaaaaagttcagcactcaaatgcatttcagaaatgctgaatgaaagttaagtgagtatttttatggcagacttcatcagagcctgtactgtgctaagggtgcgctgtgattctccgagaagtgtagcccacaagatttcccgaaacgatgtgttgtggaacccctctcatctcccagaaacaaaacagtttgggaaacacagatcttgactgtgctagaaccatcatgaatgtgttcatctctgtctgagcctctgttatggattttaaataaagcgagagaacattatcggatcattctgctgttaaattgtttttccattctaggtaactcagggaataatgtgctatgatgtctctaaaaacacttaataatttctgagataacttgttaaatctgctttctaaaacatcgttctttaaagaagtagtcaacttacgtaaacctggctagagaacatttctttgttgttttttgaaaggtagtaaaaacttttcaatcattttagaaaaactgtatgttgaaaactaggcagattattagaattgcataatttctaggcgtgttaataatcctcatttacaagcttcctagttcgccatcagatccgtaaatggcatttttcacattggtgcatttcaggaatcaagcagtacatcctatctgtgatacaacattttccaccttacatttgtgtatccctaaatccttctcgcatgctttaagtgtagctgtagaaataagacctgtgccgggcacatacagtaaccgtaccagttcttagaggcttagttcctccaatcatgctacataatggaatgacttttacctttatgacttcatctgttaaaagatatttacaaaatgtaatatttaaatcctcagaacagctccagagaattagttttgccgtgctttgtaagtcatgaaattgagactcagtgcttaagtgctgtgcccaggttaactgaaaagactcaccacgaggggcgtcctggttctggctggaggcagtggacacgtggctcatggcctcacaactcccgtacggaagtcgaccccgtgtctgacccatttctttacaaagttgacattctttgtgatcctattttatgtcattcgaaaatgttaatgttggaaacagatgatataaacaggttgtctaggaagctagaagagacaaaaataattgaaatacagaatttactttgcctgatccgcagttacataactttttccagtgtgtctcattagtgaatccatttgaagaaatgtgtagcaaacaatgtgagatacacaagtgatgcttttgtgaatttgactctgaaacagtcatcaactgtctgggctcaaagcaggacaactggataattggtgggaaaattagttgactaaaatgtgcgatgttatcagtggacttctctttgcagggaagagtaagtgaagccatttgatttcttcacatgtggtataaatatctgaatctttatgaatattctggattttctttgtttcattttttattttctatgaaatttctgtatcttttgggcaaatagcacatgaattaacattttctggtagaaacatgggtaccctttgtatttgtatgagaaacactggcagcttctccacctggctggcaccccatgctctgctgtaatatccctcccacatcagtttccttcctaagcagtatcttcccgtgtggcccacgtgtctcagcagcattacccgttagccaggaagggcccaccagaaggcagcccagggcccactaccctcagggtcctctcccgtggcctcttggagcacaggcacctggagtgtcaggagtccttgcagcccaaagggctgtctccgtccttgtctcctggacctgtagagattcctagggctgatactaccagcctaatgttttaaaaaacgtttttctgaaatcatatcttgcagtcctgtctgaatcttctgtccgaaaagttattcccgagacataggtcaccgtgtgtgtgggtgggtggactgtggcccaggggacgcatgtgaggagctgggccctctccttcactccctgacagtgtcaggtctgctgctgccagctggtagcacagtggagacacaacagcatgagggggagggagggtcgcctttgaaggggcatttggcccactttaacaacagccgcaggtgtgccagccatggcttgtgactgaattttaagtgctacatttgatcctaagatcctgcagttaccctcattttccattatcggtgtggcaagtgtctcctgaagcttgtgccaggtgacagagcagcacttggttgctttcccaggacgtcatcttatcttcttatgcccgcgaggatgaaggagcagtgtcttgattttgttcagtccctgaatttccagtttcccaggggttccattctgaggagtggagcaggttttgcagacgcacaaggggcagcacctggccagtgagctccaggcctggttcctgttgcacgctgctgtggaaataacagtggtgccctcgcgtgtcaggaacgtcttatgagacatcttaagctttggcatcatccttaaccttgttctgctcaggggagcctaagcgtgcagtaaaatgctggtgaagccattcatttttttttttttttttttttttgagacggagtctcgctctgtcgcccaggctggagtgcagtggtgcaatctcggctcactgcaagctccaccaccaggcttcacaccattctcctgcctcagcctcccgagtagctgggactataggcgcctgccaccacgcccggctaattttttgtatttttagtagagacggggtttcaccatgttaaccaggttggtctcgatctcctgacctcgtgatccacccgcctccgcctcccaaagtgctgggattacaggcgtgagccacggcacccggctgaagccattctttaaaatcccgtcttcataaaacattcgtattgtactgagctttcctgtgacagtgaggctgcacagcaagtgcctttcttatgatctgacaaacttttaggaacaagcaaaaggcgggccagaagaaagacccagcaagcggaagcactgtagtttccatagttagcgagcgtgtctccaacatgagtgtcccttcttcatggagaaatgtttctcatggtaccgcttgcaggtgcttgtgttctgtgatagattatagccttctgatttgcatctggcataatttttcaaaaatataaatggtacacgttgtaccatataatcttcaagaaaatattttctttaagaaaagattttctcccttgcatcattaaatacaatttgattctcttcctcaccttttaaaatgagtattttgatttcctaatttctaaagtacatattttgcaacatttattgagggcctttcccatataagctcttgtgtaggtgttggttaaatgacagaaatgttctgacattgtgagcagtttgctttcatttagaaaaatgtttatattttaggaaatataaagttttcataaaggaccaaataatgttattttttctaaaccatgtgctatgatgctgtaatatcttgattattaaatgttgctgtagagtaaaatgtttttattgccagatctttgatgtataaacactcactgtatatgttctgattggtctcatatgtctttgctgaaactcttggaataatggctcaaaatgggatgaatatccagagcagtacagtcacaacctttaacttcctccctgttgaaaatgctggggtttcaacaatccgtaattccgatttgaaaagggctacagtttccttccctctctggctttggtcatgaggaggcctgggctcggtagacagaggtgaagagaactggtaaaagatgccctcctctagcttgcctggatgaacgtttttaaatgcataattgctagaacttaatatttaagtgacatggtatagtcaagttgtttttcttcattctgccatggtattcgcctgaggtttatttattattttttcatgatcctaggttcacgcaaagaatctgctccacaagttttgcttccagaagaagagaaaattatagtggaagaaactaaaagtaatggtcagacagtgatagaagaaaagtaagatgtcttccggtattctaaagcagatgtttgacctctgcggtggggtagtagagtccagacaactccctgagggcgggggtatggcttcagaagcttcactttttttttttttgagacggagtgtcactcttgtcacccaggctggagtgcaatggtgcgatctcagctcactgcaacctccaccttccgggttcaagcggttctcctgcctcagcctcccgagtagctgggattacaggcctgtgccaccacgcctggctaatttttgtatttttagtagaaacgagttttcaccctgttggccaggctggtctcaaactcctgacctcaggtgatctgcccgcctcggcctcccaaaatgctgggattacaggtgtgagccactgtgcctggccagagcttcacttttaaaatgtcttcataggctgaagttgcccttgactaggcttgaacctgccatgcacagaggttggcagtttttagttgtgaatgtagacagtacatgggtaaggcagagcagctccgtgtcctcctctcagcatcgtagtgtctcctggtaagttttcgtgtgtcctctccatgcctcaccttgttcatgtgtgtgtgttctgtttcctgtttcaggagtcttgtggataccgtatatgcattaaaggatgaagttcaagaattaagacaggtacgtcataatccatctttaaatcttttttttcttttcaaatgggagaaaagaagaaaattacattaaaaataagctggctgggtacggtggctcacacctataatcccagcactttagaaggccgaggtggacagatcacctgaggtcaggagttcaagaccaacctcaccaacatggcaaaaacccatctctactgaaaatacgaaaattagctgggcatagcggcaggtgcctgtaacccagctacttgggaggctgaggcaggagaattgcttgaacctaggaggcggaggttgctgtgagccgagattgtgccactgcactccagtctgagccacagagcaagactccgtctcaaataaaaataaaaagctgattgtccataagcaaaaaactaaaaggaggtcatgtctttgagaagtccagcagataaaataattggttgtctctaaagtgacttgtttaaactcttttttttttcttaacaatactgattttgatgtcataaaacatcgcaaattctgttggaagaataatttaaaatatcgaaagttctgtctggtgacaaatcctgcgaggcgcccctgagattagcctctgccactgcatggtccttggctcccgaagccaggttagcgagccagaagtggcgactaaccaagggtgttctgggtattgcacggaatgtgagtatgagcagctttggtcctctgcccagctaggcgagggaaggttggggtgttcattgcacggaatgtgagtacgagcggctttggtcctctgcccagctaggtgagggaaggttggggtgttcttttggccgaggaacagcctgagaagagttgtggtctgggatagagagctgagagcaggttgctgtgtggaactggacatgtgctgtcattctaagcagtgtccgcaggtcttccaggtacacctttgcctggctggcaggcttccatgttcacgctttgcccctaccggcagcaggcatctgtttgtgcatgcctcctacgtccgagacatgcctgggttcagctgcacagagcaggtgctcgcccacttgctcctgcacctgtcagtggctgttacttccagtcctttctgtaactctggaaggtggttataaatggacaaaaaggctggataggagctgtctcgtccgcagtttccagctattttcttacggtatgttctatagagattcattcatggacttaataagagccattaggaccatttccatcccgggaacagcagcacagtcaggagcaccgctgccaccctgtccaggtgtttgaccttcgtggatccccacgacctcagagcccataggcagctcacgtgggatttcatgaatcgaggccttagctcctcaaggatacacatttggggaaaggaagccctacgcgatgccaaagatagtgaacaccctgtggtctgcttaatttacaggacaacaaaaagatgaagaaatctctagaggaagaacagagagcccgcaaagacctggagaagctggtgaggaaagtcctgaagaacatgaatgatcctgcctgggatgagaccaatctataagggatgtcctcagttctttctgttgaagaccagttctgaggtgaagctgggcacccctgacccaagtcggggtgcactcaggaccacagggcagggctgggtggggcgccaccttgctctctgtatatagaaaagctggagcttattctgcgaatggagacgatcaaaccatgactgatgaatccagacaggagggattgactctgaggacctgagctacatcaatccactctgtgaacatctcagttacctcattctgcaataagttcagtgactgactaaaagtcttgtttttccagactttgaattgaatatataaatattatatatacatgtttcttgtaaatatcccattttgaatgcatacctgtggtggttctgtccgggctaatccccatgctagaatgtcctttccagctacgtgaataagaagtcccatgcccgcatccaccggaagcagaagcctggtggatgcctggttcgttccgcagcaccagggcctccaccgtgctgtggcagcaccccccatgtcggtatttctaaataaccttatttatacctgcagagatacacttcagtcccattcagaagtcttctcttaaagcagcattacagtcccagacctgcgggtttctgagggcaacttgctggctgacagactcagtcttgacctcaaggaaggcccatacggcactgccgcatccacctagaggtgtttgctcttgtccgctgtctgagtactgtgattctcagatgagtttgctgcgttttgggaggacacagacggttctgtataggctagttcagtaacaacaaaatacactgttttgtcttccctcaaagagagatcttactagaacctgtaaatagaatgtattatttattataagtcactgcagctgatgaaaacagatggaggccatgctgcaggctgatactgatgggtggagttttgtcatcaggccagcctcatcccgaggtctcctccaccattggccgtagccagcaggcttcagtgctcaccgaaagtaaaatcccctccttcagcaagaataaagcaatatacaccttaggttccactaagtaacataggcataagcagggaacgtttcccccactgtgttccagtgcagaggagacgaagcctgtcctcaccgcggctcgctgggcccaggctggctctggaaagcctgtgcggtcctgggcaggaagcccggcccgtggagcaggttttcgttctgcttcagcaataaataagggtgaccacagggactttgcttttggtttcctttcctgtgaaaaggttggttttaaagtgagatacacttttccgtagaacaagtgttctatctttaaaaacccaaattgcagcaccgtggattactggtctcagaacaactcattgcgcatcagatttgactctctgattttctgtctattggccaaattgccctttaactgcacctgaatcctttgtgtactgatgcctttgagctgggcaccttgggagagtgttgtgttgctgtttacggttcttccttgcccttgctaattacagtctctggtgcccagcaagcccctttggcttccttccgtgactggtcacgttgtctgcctgggctcagcgtggacctgccccatgctgcagaacctggcctcacctggacttttcactagaattgccagcttcctcaacttagcagatcattcactcatgcgggcacaagcaaagatcaacactttcttttttggtaagcttgagttttacaagttattttttggtgatgcgtaagacattgcagtgggaaaccattcaacttgagtttattggagtttgctgttgtagcaggttttaactcaggaacaactcttgtctgatctctccgcccctctgccgggaggcgacattaactgtcctctcggagccggtagcgttgctgtccgagtccccaggacggatctcctgcagacctgccttaatgctcagatcgaagtatttcacaagaatacttgtgtttttaacagcccttcccctggacggtgcggccatgagggcctcatgttacggcattgccttttctttctgtggatccagtatcttcctcggctttttagggagcaggaaaaatgcgtctgagagcaactctttttaaaaacctgccctgttgtatataactgtgtctgtttcaccgtgtgacctcccaagggggtgggaacttgatataaacgtttaaaggggccacgatttgcccgagggttactcctttgctctcaccttgtatggatgaggagatgaagccatttcttatcctgtagatgtgaagcactttcagttttcagcgatgttggaatgtagcatcagaagctcgttccttcacactcagtggcgtctgtgcttgtccacatgcgctgggcgtctgggaccttgaatgcctgccctggttgtgtggactccttaatgccaatcatttcttcacttctctgggacacccagggcgcctgttgacaagtgtggagaaactcctaatttaaatgtcacagacaatgtcctagtgttgactactacaatgttgatgctacactgttgtaattattaaactgattatttttcttatgtcaca

SEQ ID NO: 333 - DNA, 23580 bp, Homo sapiens
ccagtttgttgttttacctaaaaggtgttttccacgtggagtgggactgagaggcacaggtggctgaggggacccgcctgggatgtgaggcgcaggtgagtcgatgaacgccccctcctggtgtgagccgcccgctccccaaacgacgtccccagggccccgcccgtgctgacctctcctgttttccaggtgtgctcggccccttcatctgtcagctgcagcaatggaatacgtgctggaagtgaagaactctccgcggcacctcctgaagcaattcacaggtatggagggaaggcgccaggggggcgggtggggtgggggagcagttgggggggggcacagggaggagctgtttgagcccctggcgcggacagggggtcctggtcccagacctggctaggagggcaaggcagcaaaatgtgtgttcaggaaataacctgggaaaacgctgtgaagacttcatttttgaaaattttattacaaaatacacccgaacctgaggttttctagatgaagaaatacatttaactatttccagggctttaacaggtcaaaggcattttgtccatgaggcgctgaagatccacttcaactacttcataacttttattgcaggagtgacttttttaattaaggaaaaatatttatcagcaatgaagaagttccaccttccctttccccacccgggcaactgacccggaggcagacactcaccactgggactggaaggaaccaccggtgtgggatgtggcttctcccacaggtgccgttaatgtgcatagatgggggatgacagtgacttatggtcaggaaaaggaagattctggaagtttgcacctcccccgggaggcaggagatgccaccttccatggctcaggtttacctgctacttgaatgtttttttctcaatggatcttgtgttcatgcaatgcttttataaaacaacaacaacaaaaacaaaaaaaaacccaagaaaatcggatgggcgtggtggcctgtaatcccagcactttgagaagccaaggcaggtgggccacctgaggtcaggagttccagaccagcctggccaacatggcgaaaccccatctctactaaaaatacaaaaattagccgagcgtggtggcgggttgcctgtaatcccagctacttggaaggctgaggcaggagaatcacttgaacccgggaggcagagattgcagtgagctgagattgtgccactccactccagcctgggcgacaaagcgagactccgcctcaaaaacaaacaaaccaagaaaatggaagaaaaagaaaacaaattagattgttttgggttgttacctttgttgggaaggtaggctagggagcacctctcaggctggccaagatgctggcagccactgagcacctgcccacagcagcacctggccctgcagctctcgcagcgggacagggcggcccaggtgccaggaatgtgtggcatctgccagactgcgaggccttccaaggccaccaggccaccagactttgtcacaccaggggggcagctatctctttggacaggaagaggggtgtccacaagaggggtctttgcagttccctatccagatgcacccagggtggagtgggaggcctgcgcctggggccccgagggaacgggccgctcttgtggacggctggggtggcccctctcatattctggcaagatggcctgtagccagggcaagcacgggggagaaagcgctccctcttccaggcccttgggggccaccctcctggtttctgcttcagggctgtaagcagtgcagctgttgtgtgtacaagctgctgctgctgggcctggccaccccgtctgtgaggggctgtcaggggctgctggaggctggtgccacttctcagggtgcatgggactggtgggggtcatctcaggtgtgccaggtcacccaaggcactgcccaagctgaccctgggctggagtcatctcaccttgccatggccatgcccaggacccagctcctggtgtctgcaggcgacactcctgtgtgctccccacacagcctgtcctcgtgaactgaagaacgcatgcaggggcgtcagcattgtctttatcattctttgcacactgtggcgtggctgttttgcaactgtttctattcctttaggggtgtagggaggctgtgaaatgacaaggtcagggtcttcctggcttggagttggctcaggtgtcagcaccaccggtggcctcagcgggcaggtggggagctggaacctttagccacagtggctggccctggccctgcagctcaggccctctctgccacccacccctgggtctgaacccaagaagcagcctagaggaattcctcctgtccttctctgcgcaactttgcagatgtggaagagactctgtggccgggtgcagtgcagactctggcctccaagcccacccactctgcagcctcttcccatgtgggtgcagagccctgcacgcctccccttccacgcagccctgctgggcttccccatgtccacactcactcatccgggacaggaggcagctgggcctccagacagccccctagcaggtgatggcctgaggctggctcccagggcaccatgttcacatggccctggatggcgggtgacctgggggtgaaagagcggaaatgaggatgggaggatgacaggtggcccctggggaagaggcgtgtgtggggccactcagccctggctggaggctctgccttactgcggggatacagcctcggctgctgcctgtcagctgctgcctaaagattaatgtcaattctctccctaaataaaatagtttctgcaaaagtgcttttaaactgtgacacactttccacaccggtgtgagttcttctctgagtggcttgtatgaaagagtggggactcgaagccactgcttcttctccacaggctcgggggtctgtggacatatttggactctctgtgtccgaatccccgggatctgtggtcctgcacaccccagatccccatccgtggttcacacgtgctccaggcaggaaggccacacacatgagcctctgcacacacagggatccgtggccctgcacgccccagatccccatccgtggttcacacgcgctccaggcaggaaggccacacacacgagcctctgcacacaccatgccagctccctgaacctgctgtgatccctgcccagcttcctcctcctcctccttctcacctctccttccgtgttctgatgctcaaactccgggagaactggtgtcttctgtccaaagataacttgacatgcagcttcaagctcagtgtcaagaaaatgggtctccaggttcagagatttttatgttgtttatgacatctgctgtgaagacacattcagccggattccaggtggtgtcacagctcacagacagaaaggggtgtgcagtctgggcccgctgaaggtcctgggggtgctggtggcaatcgtgaccgcaggcacgtctctggagttcccacacatttcctgtcaccactgtactcagaatcttgtcttctcttcccgcctggaccatctttggaaacctgtctgtggttgggtcttgctgtccgtggccacgctgccaggaaccctcagctgggacattctagtgggccgccgggcagtgtggcttggaggtgtcccctggaggccagcctgatgcctgcctttctaggggagcagctcccagcagggaagctgagcctcagaagtgctggaagcctccacggtgctgtgaggtcatggctgctgagtctgccagctgcttctccaggaggcgaccatggtctgtcccctgctaattgactgcttcatcgggaaacgaggtggcagagggacttggatggggagtcacactgaggacccggcgctgccctgagagagtctctgggcttgactcctcccctaggaagaattcctgcaagtgtgcgtttcacagagagagggcaagggaggtggatggagcacaggaaggagaaacgccagggaatcgtcagccacacttaaaatggtgacgcctccccacctggatcatcagccacgtttaaaacgatgatgcctcactgcctgggtcggaaagccctggcctcagatctgcacctctctaggcaccatgcccctcctgaacctttcctctcctgctgcagaagcagcaaaatgcagagtgaagagactttccatggccttggagaaaaataacggaacgtttaccaccgtgctggcgtgggcgtgttagaagcctcaggaggtggctggcgggaagtgggatgagcgagggaatgaatggcagccccactgtccctggggagcggtggcttccctgggcttgctatccacgcagacggggtgacgggacagattcatgggatgagctttgaaacctcactccacgggcccccatctcacctggcacccctcagccagggtggcttctcccaggaagcactcggctcattttagattgattggtttaaccccagtctcgtttcagtagatcaggaagaacgtggttgccccgccatcctgaggcagcgcctccccgttcccctagcctggcccagccgatggctcctctccctcttcccagccacgctgtcatgactctgggagagcacagggagagagccaggcagtgagccctgcgctccagccgtcctggctgtggtgtggggggtgtggagggcctactggagataccactgctggtgccagtggccgggagtccagtacctgtgcagtgggcgagctgccagtgatgtttctagagggagcagggagctgcatcagccctgccgatcccccaccatgtgggaagcccacctcggcccccttggcagctgtgacctggtgcctgcccagaaagcctcagcttactccaacctcaaagcctgttaggggttgtggaggagggtggagggccgggctaggaatggaaatgcgtgagagacttttcagggtctactggatttttaaaatgcatggcgacattgtggaggtgcgtgcaggaaaataacggtgggtgtggagggaaaatgggacaccggaggaggcgcgggaggactgccgggattcgacggctgggcggtcagatgcgatggggactgaacttttaaaatgagaaagaatgtatgaacgtttgtgtagtgatattgaagagaacaaatcactttatgaataaaaataatgcttcgttcagtggcatatttcctgcccagtctgtttgctgaaattaaacatccgctgtcacctggagcaagtcttcagaaacctttgttctcctggctctgtgagcagatgcctctgtgctgctggggcttctcctcccgtgtctggggacggtggggagggcgcctggcactgtggagacagcaggaccctgaagccagaggtctctgtggatcccggctccgctgcgtccaagctggtgggatcttgggtttcgtctggatcttcccagatggggtggaagagcgttcgggcatcacgagctgggtgctggctggtgtctgctggggtggaggagactgcgggcagtgtgagcctgtctggtggggtggagactgcgggcaacgcgagcctggcgctggtgggtgtctggtggggtggaagagactgcgggcagtgtgagcctgtctggtggggtggagactgcgggcaacgcgagcctggggctggtgggtgtctggtggggtggaggagaccgcgggcagcgtgaggctgtctggtggggtggaggagacggtgggcagcgtgagcctggcgctggtgggtgtctggtggggtggaagagactgcgggcagtgcgagcctgtctggtggggtggaggagaccacgggcagcgcgaggctgtctggtggggtggagactgcgggcaacgcgagcctggtgctggcgggtgtctggtcgggtggaagagactgcgggcagtgcgagcctgtctggtggggtggaggagaccacgggcagtgcgagcctgtctggtggggtggagactgcgggcaacgtgagcctggcgctggcgggtgtctggtggggtggaggagactgcgggcagtgcgatcctggcgctggcgggtgtttgctgtgcagctgctgtcatcacctgcgtcagaaagtggaggcagtggcggactctgtgggtagtgtttgtgaagttctggcgctgtgtccaccctggaattgcactccaggaaaaaggccgtggtgcctggatgccctgggagcaaagccctcctagtcacccactgtagacacatgggctgctgcatagaacgtgggggaccatctggccagccacagcccgagaccagtcacccaccccaggcccctctgagcctggctgtgcagtacctgcctgctgctatggggcctcttccggcctcccccgacctctccctacatggtaggtcagctcaaatcacacacagccaccccatgcaactgagggaggagagggtggcagcagccggtgacttcagcctgccctgtgcactctgccttggcaggtgcggcatcgcctcggcagggctcccgtgtccatgatgcttctgacagaggatgagggctgcagccgcagcatttgcaaacctggaatgggggtgtcttgagaaggggaacctgaaagactaaatcaaccctaaggaacacaaatggggctcctcaagggtcaagaaggccgggcagctcccctcccggcccctgtcccagtggaacaacttacagaggggccagggaagacccccagtggcttgggtgcagccttggcctggggcatggagcctggctttgtgggactgcagtccacccagcaaaggtctctgcgggcaccctgggccctcacctgcaggaacccccttcatcatccagcccagtccctcggtggcccatggccgatcaaggcagccacatccctcggggctgaacatgtgtgaggctgctgaactcctctggaaagggtcgtctgccaggagctctccccgccctgcttcctttacctcccacggcgcgccgcacactcattgtcttccctttttctccctttgggtcaaaactggcattaaactttctgtccttttgattcaagttttaaaattctgaaataatcctcaggccatgctgctaattctaactcctgtatgcttaagtgtgaaataattacacgttccctcccgaactcccaagcagccattgtgtgagccccgcgcttctgtgggctctgtcgtgcgccgtgcctggcgctgctgcgcggaaatgtattatctcctaatcgttagaggcccctgcattattctgtgtaattaacttgacattattttgctcagaaatttaattcattctggatcttagtttcaaataaagatttgcaggatgcgtaattgagaaaataacaaaaccacaacacaaacccacagctgctccccacaccggttcccaggttctttagcggagagcagagtggctttgttttcgggggtgacacttgtgtatgtctgtgcttttgcagtgtgtgacgttcctctgtatgacatttgtgactacaacgtctccagggaccgatgccaggagctcgggtgctgcttctacgaaggcgtctgctacaagaaagcggttcccagtgagtagacgccccggccaccccgtggcggaagccgaggtagctggtgaccatgccgaccactgccctgcctgtctcccttcctcggggtctctgtttgctggaaacacctttgtattgttctctggccaactcttctgctccgtcttagtggggacagtagacttggagtggggtttgggctggagggcctgtgaatgtgacgtaagccaccataggggttccattcccagatgggctgagcagggcatggacggggacaaatggaggcccccttcatggaggaatttggccattctgggtggttgcagaggctggatttggggaaatagtgctgcagaaacatggggcgccggcagggcccgggccagtggccgggtgtggggtgagcccatcagggtggagcggaccttgtccaccaggggctctgtgagcttggccctgactggggattccgtgggctgcttcaacgtcagactagaagccagaccagacgtgaggatctgctggaagcccctcaagcagcacggggtgaagtgaggacaacaggcaaccagtgggtgggtaagggcgccggaggcgttgccactccccatccccgtgaaggcttccggagggaggcgcgcccttcagaggaccatggctagttgtaaaatgtgttcgaagggaggtgggagaaggttaagaaaccaggatggcctgcgcgtgaagggcgttgggctcccacctcctcagcatattctcgcctgtgagtgcactggcctgcgccgctgaggtcttctcatttccaaaccctcatcaaggtccacgtgaagcttcatgtgtttccttgtcctgtggaggccccttttggaaatgagggtaaaggggctctttgtgctgcgtggggaggggtggacagcagcacggaggggagcagcctgcacagcacgccctcgggagggaacagtgcagcccttaccggtggagatgatggacgtggctgatgagctctcacagctctaggcttccttggagatgagttccaaaccctccctgtcctaagccactcttttctccacccccaccaccccaaagtgagtaaaggcccctggctttgtgcagctcagggccacttcttcttccttttacttctttctcctgcatttcccgctagactgagccttcagagaccaggcaccaggtcctcttcgttccctgtatctagtagggcttagaaagtcgggaaacgttagtgactgatgggaatgagtgactgatggaaatttccaagtagtgacctgctggtggaacctagcacaagcttggctgctcaccgcttgcaaagcctgtaacaaatgaagggaaagtgactttatttccaaagctagcagtggggaagtggctgacttgcgcttccaactttaggctgggaagaggggcttaaaaagaggcactcagaatgggaggcacatgggaggggtgcttctacaaggtctgagggtctcgttccagtggctgtcgcaagccacagcccacctggagcgggaggtgtcatcatcttgatggctggttgtagactcaccgccttcaggtgatctctggcattttgcagctggttctctatgcttggtctatctcaagatgagcccctagaacttgtaagtaagcccataattaaataccagcacacagttagataaatgtgcatggggctagggggcgcgtggtgagaaagggagaccatggtgttgcaaagaaagtacatttcaaggctatattttaagactaaggagaacaaaagttttttgcagtaagctttctgcatcgtgagactaggggaagaagagaaaaaggaaaaaaaaagttttaaaactcattttcaggctacactgtttgattacgtggggactgcccagtcctacagacgtaaagccttaagccagctcctctgagatgaaagggatattctgggcacaaaatcagtcaagaaagaaagtgctgatgggattctggcttgctccagagagggtgtctgtcctgcttcgtggtgaggatttggcacctcatcaaaagaagatgaattttcgctcctcagagacaaatgagaggtcacaatggataccactgatagttgggaaggttttctgatgacgacggctcctgcagatcctggctttagagactcgggaccagacccctcgctgtcccagcctccacttccaggagcctctgggattcccaggatctcacgccttcctctgactacagataaaatcggttggaaattgcttcagctattatttttaccaagatactataccataaaattcaccttttaaagtatacaattcagtggcttttagtatattcacagttgtacagtcatcaccactaactccagaacatttgtaccactccagaaagaaccctcacgcccattagcagtcgtgtcctatccttccctctctctggcccctggcagccactcatctgtctatggacttccgtattatggacatttcatataaatggaaccacatgatttgtggttctttcactcacgtagttctcaaggttcgttcgtgttgtagtagctatcagtacttcctttctgtttattgcggagtcattgtccactgtataggtatgccgcattttgttgacccatctatcggtttatagacatgtgggttgtttccactttttggctattataaatgatgctgctcagaacatttgtatataggtttttgtgcaaacatgttttttattctcttgggtatattcctaggggtggaattgctggatcatatgttaactctatgcttaaatttttagggaacttcccaactgttttgcaaggtggctagatcattttccagtccaatcagcagcgtatgcgagttccaatttctccacattcttgccaacacttgttgtggtccttttgtttacagccattgtaatgggtgtgaagttgtatctcattgtggttttgattcatattattctaatgaataatgatgttcaccattgttgcattttttttttttttttttttggctatttggatatcttctctggaagaaaagtctattcaagtcctttgcccagttttaaattgggttaattgtctttttattatggagttgtatgggttctttatatattctagatattaaactcttattagaaatgtgacttgcaaatactttctattattctcttacatgtcttttctttttcttgatagtgtcctttgaagcacaaatatttttaatttttatgaagtccattttatccatttttccttttgttgcttgtgctttggtgtcacatctaagaaaccattgcctaatccaaggttgcaaatatttatacctgtaatatcttctaagagttttatacttataactcttacattttggtctttttatcctttttgagttaacttttgtatctggtgcaaggaaggtttccaacttcattattttgcatatggatattcagttgtcccagcatcatttgttgagaagattctttttccctgattaagttgacacccttgttgagaatcagttgcccataaaaatgagagtttatttctagattctcaattctattctgttcatctatatgtctatccttagccggtgccacagttttgattactgtagctttgcagtaaattttgaaatcagaatgtgtgagtgcttcaactttgttcttctttttcaagattattttggctgttatgggtcccttgcatttccagatcaaatttagcttgtcaatttctgcagaaaagaggtcctttggcaatttgattggggttgtgttgaatctgtatataatttgggaagtattgccatcttaacacaatattaagtgttctggtccatgaacaggggtagtctttctatttatttcggtctttaatttttttcaatattttatagttttcagtgtactgatcttgagctttttaaattaaatttattccaaagtattttactgtttttaatgttactataaatggaattgttttgttcattttcagattgtctattgccagcatatagaaatataattgatttttgtatgctgatcttgtatctggcaaccttgttgaacttgctcattctattagttttctagttgattccttaggattttttgcatacaagatcatggcatctgaaaatatagttttacttcttttttcctaatctgaatgccttttagttcattttcttgcctagtttctgactaaaacctccagtacaatgatgaatagaactaggaagagcagaagctttgtcttgttcctgatcttaagaagaaactttcagtgtttcaccattaaatacagtggtaactgtgggttttactagatgccatgtatctattaatagtaaatgcaagatacaacttggaaacacacgagttgagaaagctcccttctcttcctgctttgttgagtgtttttatcatgaaagggtgttggatttttttttcaaattctttttctgcatctattgagcaccttaatggtgctctttattacttcatgtggatttgacttactgtctacttttctttcatttcatcctaagagactccctttggtatttcgtataaagaagctttgccagagatgaatatcctgactttgtttatctggaatgtcttaatttacccttcaattttgaagcatagagttgctgtatataaaattgctggttgatagtcttcctgacagccctttgaatgttttatctcattgccttctggcctgcatggtttctgatgagaaactgctgtaaatcttaaggctcctttgtatataatgtgtcacttctcttatgctgctttcaagattctctctttgtcttttgcagtttgccaggtgtctgggtgtggatctctctgagtttatcctactcagagttcactgagcttcttggatgtatagattaatgttaaccaaacttaggaagtttttaccattatttcttcaaatattctttctgttatctttctcctctccctctggactttcattatgtgtatttgatagactttatggtatcccacagacctctaaggctgtattaatttttcttggttatattttcttcccttctgttacttaaactggataacctcattgacctatcttcaagtttactgattgttttgcctgctcaaatctgctgttgagcatctccagtgaattttcatttctgttattgtactctcaacttcagaatttctttttggtcttaataatgtctatatttctattgatatcttctatttgatgaatgtattagtcattttttacactgctataaagaactacctaagaccgggtaatttataaaggaaagaggtttaattgactcacagttctgcatggctagggaggcctcaggaaacttacaatcatgccagaaggcaaaggtgaagcaagacatgtcttacgtggcagcaaggttgtgggaagggaactgccaaacacttttaaaccatcggatcttgtgagaactcagtatcatgagactatcatggagtaaactgcccccatgagccaaccacctcccaccaggtccctcgcttgacatgtgagaattacaattcgagatgagatttgagtgggtcacagagccaaatcatatcaataaaatattttccttttacttttatttagttccttagacatgatttcttctagttctttgaatatgcttaaaatggttgatttaaagtctttgtcaagtaagtccaatgtctgtgcttcctcagtgatgatttctattaatggcattttttatgtatatggccatactttctcatttctttgtatgtttgacatttttctttcttgaaaattggacattttaggtaagataatatagcacctctgagaatcgggttctttcacctccccaggttttattgttgctgctgtttgttgttgtggttgtttgatgactttcctgaactaactcagtaaagtctttattctttgtggtgtgtgaccactaaaaagtcttcttgggtagctactagacaaaaattccttagatgcctggaaacacaagcctctcagactttgcataggggttctgtgtgcgtgctgaggcacaccttcaacaaagtcagaatatttctagctctgccttagctttcacttcctgcttatgcagatccttaagtcagccagaagtgaggtcccagggccaccataggtctttccttgcaaagcccacagcactggacatgtccatggccctctagattcccaggaatgtgacagagcatttcagagctctctatgcacatctcatttcccagattttcatgctaagcttgttagttagcctcttgttttccctcaactgctaaccaacactttagccagtaaaacaattttcagttgcttctgattatttataacaaatgcctggggaaaaagctgttctcaccgaatgagctcagatcaaataaagctgatattccaaggaagcaccagacagatcaaataatgacaactctccgacgatggggctttgaaggaggtcccaccctgttctgcccgctgcagtggctgccaggctgctggctttaccatgattacaggctgttgattttcaagctaccatggagctggagggtgggcaggagagatgggaacagggctagataaaaggtccaagcttgctcttttactgagattcagctgtttgcctcaaacaaacagatttctgcaagcttttggttaatttccagacttctgaaaaactttcctctggtgatttttgccagtgttctcattgtttttatggaggaagaaattggcaggggggttctcgctctgctgtttttgctggtatcaccctgaaagttaattatgggctttactgaagccctagtccggttgtacataatcagttagtgagagttacaagatgtagtgctttttcccgaaggagtccattatccttcacctgactcacctgtctcatcgtaaaacccatgccctttagccagaatcttacttgagagatctttttgggttccaggccttccagtgttgaacggcctctcatatggcttcattccagcagctcgtcctctgaggcatgtggcagtactcctgaagccaagctcatggcagtgggtgctgacttggccatggtttgctgcattggcacttgtcatcatcttgtttttgttgtgtgaaattgaggtttgctgctcacgttgcacatgcagagagcagcagatgctcacagtcgtgctcagttcatttccatcatagagttggacttcttacagaactccagtttccaaggcacttataccacttagtttttctgagaagtgtaccatgtaaggctcctgaaagtggcaatcgttagcatccaaaaggtatttaagtttattctttcaatcttctccatataatgattagtgatcccaatttcctcacatcccaatgaagcagagatccaaccgtgtaaagtggtgtaaatgcatcactccaggaagatcacagcgaggaagggaactcacgtccaagctgctactgccgctgcttttgccacctctcccatcccctgagcacctttttatctgtaccgtgcaggtgctggcctgtttgtaagtgttggcatgtatgtcgaacatggcttaagttagaacaatcgccgcatgcctgtcatccattttaaaagtgagccttaatccctatagcagcttcatgactggtgttataaggaacccagaagagaacacaagctctcaagaaagtttttgacttggagagggctcactgttttgcaagggggtatatcatttttgcatggaagcaaccattaagttctttccatcattctaactttaacagctgggttgtgtgactgtgcttttcttgactcctggtttctttcgggcctgtaggaagagcctgggcagtgggccctgccttggggctctcactgtgccctcacattacttttcatttctttgacatctttctcattcaaaacgacgaatgaacctttgtgctgtgcaagttgtagtattcagtgacagggtattatgagctctttgtgcacataattccatgttatgaaaacctttcaccaacttcttaaattggctggtttgaagtgcacattgtgttatggcataatctgtattattaagaatatgaattgggaattagcattagatctttcagaaagaattgggaattcaaagagaaagacttgccttcattcttcagtcttgatttagggtatgttatttaacatgtcatttcttccaagtatctgacttcagtttcttcatgggacttgctgagatgatttcaaaacttttgtttaactatattttgggaacatttaccaagacgtttcttaaagaaaataatcctttcttcaattgctgctgttctgaaagataaaccagactttgtggtttatgataagccaaagatatggtctgtaataaatagtgttgctagacagacactgtacggagcgcatcattgaggttgagtctccatctttaggagcttggcatcaacgacaaagaacgtgagcacgtaggaagatacgggagatgtactgacggtgaaatactaagacgctgactaatatgtgtgtctctttaacaggacttcactcacataattttgaatttattccatgagccaagacacaaattcatactaaggaataaaacatttcctggagttcaagaatttcagggttaccttcttgcctcatgaacgctcttaattcaccctttcactttatttgtgcatttcaattcgatcgattctgtttgttgaacagcatttaagtgcagattctctgggcaagctctaggctacctctcagatccatcctctattgctgtgtgacaaattaccccaaaacttagtggcttaaagcaacttagaggctttgctgggtgggttgggtttggctgtctcatgagattgtggtcaagatgccaagtgaggctgcagtcacctgaaatcttggcgtcccagatgattcactttgctgggaagttgataccagatgttataggaagatgactcactttgctgggaagttggtaccagatgttataggaggcctcttctcctcgcatgagggctgcagtctttcccagagcaactggcccaagagagatcagggcagaagctgcaatgtcttttttacctggtctcgggggttagactctggcatctcctttggctccagggatcagcgttgttcagtgtgggaacatctatctagggtgtaaataccaggaggtgagaatcgggaggccatcctggaagctggttatggtagccccggatatttggaggtgagtctgccccactgtttcccctcctcaggtaagcaagtttccacgggacagtcctcacttaaagaaataaggcagctgattggaagaatgtttgacaagcagtttcccagtgtgctcctcggtacatgcacattcctgttatctgacagcttgcaaccccaagcctcgctcccttcctccagcctctctgtgaggaactcttatcgagcgcccattgggtacttcaccattccttactgaggtcacctcggtatgaggaaaatcgaggatgtgggttaccctcacaagctggcttcaatcccctctcagttttctgacttcagtccccatggaaagaatcctgggcacctcatccattgctggtggccctgtgatgagtccagggagtgcggatcccttcggaagctggctcatgtgcccaggaggccactttctctgcacctgcggccttgcttctggggtgggttgaattgtgtacacccaatgcatatgttgaagtttagatccctggtacctgtgaatgtgacctaatttagaaaaaagggtctttgcaggtgtaattaggtaagatgagatcatagtggagtagagtgagccctccatccaaaatggctggtgtccttgtaaaaagagaagagacacagagacagaggaaagacagccacgtgacaataggggcagagactgctgtgatgctaggaggaagccagggaggacccttcccgggagcctttgaaaagaacacggccctgctgacagtttgttcttggacttctggcctccagaaccatgagatgatcaatttctattgttttaagccccccagtgcatggtactttcttacagcatccctggcaaactgacacaccatccagggaaattacatctgatggtgttgttactgcttcacgacttggaagcagtttagcaggaggggaggtatgggaattgaagcaaatcgtgtcacctgcacttgatatttgcaagtcagccagtttctttgagagagtaagaaagcaattagagaagagactaatattgataataataacaacaataagaattactctgtatatgtgattagccaaccacttaagaactttacttgcattcattaaaaaattccttacatcaacctgacggaaggaacatagaagaacaaacagtagatgaggatattatttgaccaaggactctgagaggaatgatgctcgtgtacaaatgttaggacttgaggggtccaagtcctgaaccaatgagccgacggagatccagatatcagccctcggtgctgggcggtgctgcgcccctcaggcctcttgcacagacagggccctgcctgctgagcagtgggcagtctctcagaaagaggctcaggagggggctgagcagttcctcctcccagttacccccgtcttggagaggctgggagtgcactcacgcagggaaacccagggtggcggggctgcccctcgtggccacctggggaggcttgacttttgctgaggctgggttggagaaggcacgggaaacttggggattgcaggaaccccttttaatacaaggaagcccagtcaaggatttgtctatgatccaataagtgttttccttgtattcagtttaggggaggaattgacctgggcattgaggagccatttccagggagctggggagcacagcaggaacagaggggccagcgccatctctccacgcacccccaggggtcaggagccagcaccatctatcctccacacactcccgagggtcaggagccagcgccatctctcagcacaaccccgtgggtcaggagccagcgccgtctctcaatgcacccccgggggtcatgagccagcgccatctttccatgcactcccgggggtcaggacccagtgccgtctctccatgcactcccgggggtcagggtggtcacaaggtgtcctctgggtggcactgactaccacctggagctgcctttcacagggagccctcgcctgcctgcgggggcctttggagatgtccacagagctgagtctccaggagacgctggggagggtgggtgaggagtgctgaccatgggcagccgcgccgggagggcccgcacccgactctgggagggttgccttttcttcatcttcttccttttctatttacctggatcgaaatgacttcaaatcccaccatttttcagtttacatccacgtgttctctgccttgattgtgatcatcgctggggccttcgtcatcaccatcatctacaggtcggtccctttgttctttactgggagggtggggaggaggggactcacctctcctggccgcagcttcctgcctgcctgggctccttcgggcttggtgctgctggggtgactgagaacagctctccgtgagcctgggaaagggaactggccaggctcacggagggccccactgattttctccagagtgcttgttgatgaaaatcataacccatgtttagtgagcacctgtgcttgttgatgaaaatcataacccatgtttagtgagcacctgtgcttgttgatgaaaatcataacccatgtttagtgagcacctgtgcttgttgatgaaaatcataacccgtgtttagtgagcacctgtgcttgttgatgaaaatcataacccgtgtttagtgagcacctgtgcttgttgatgaaaatcataacccgtgtttagtgagcacctgtgcttgttgatgaaaatcataacccgtgtttagtgagcacctgtgcttgttgatgaacatcataacccgtgtttagtgagcacctgtgcttgttgatgaaaatcataacccgtgtttagtgagcacctgtgcttgttgatgaacatcataacccgtgtttagtgagcacctgtgcttgttgatgaacatcataacccgtgtttagtgagcacctgtgcttgttgatgaaaatcataacccgtgtttagtgagcacctgtgcttgttgatgaacatcataacccgtgtttagtgagcacctgtgcttgttgatgaacatcataacccgtgtttagtgagcacctgtgcttgttgatgaaaatcataacccgtgtttagtgagcacctgtgcttgttgatgaaaatcataacccgtgtttagtgagcacctgtgcttgttgatgaaaatcataacccgtgtttagtgagcacctgtgcttgttgatgaaaatcataacccgtgtttagtgagcatctgtgcttgttgatgaaaatcataacccgtgtttagtgagcacctgtgcttgttgatgaaaatcataacccgtgtttagtgagcacctgtgcttgttgatgaaaataataacccgtgtttagtgagcacctgtgcttgttgatgaaaatcataacccgtgtttagtgagcacctgtgcttgttgatgaaaatcataacccctgtttagtgagcacctgtgcttgttgatgaaaatcataacccgtgtttagtgagcacctgtgcttgttgatgaaaatcataacccgtgtttagtgagcacctgtgcttgttgatgaacatcataacccgtgtttagtgagcacctgtgcttgttgatgaacatcataacccgtgtttagtgagcacctgtgcttgttgatgaacatcataacccgtgtttagtgagcacctgtgcttgttgatgaacatcataacccatgtttagtgagcacctgtgcttgttgatgaaaatcataacccgtgtttagtgagcacctgtgcttgttgatgaaaatcataacccgtgtttagtgagcacctgtgcttgttgatgaaaatcataacccgtgtttagtgagcacctgtgcttgttgatgaaaatcataacccgtgtttagtgagcacctgtgcttgttgatgaaaatcataacccgtgtttagtgagcacctgtgcttgttgatgaaaatcataacccgtgtttagtgagcacctgtgcttgttgatgaaaatcataacccgtgtttagtgagcacctgtgcttgttgatgaaaatcataacccgtgtttagtgagcacctgtgcttgttgatgaaaatcataacccgtgtttagtgagcacctgtgcttgttgatgaacatcataacccgtgtttagtgagcacctaagactcttaagagctctgctcagccttttcagcccttgaagccactgacgatgtaagtgaacttactgtccccggactgggatgattgacgcagcatcgagggggtcccgaggctgatggatggggcagtgaggctctaactcaggctcccagttgtctcagagtccctgaacccaaggctgcctgcatctcttggcctgtggcctgcgtcctcattgcagggtgtcagggtttggaggtgtctcagagatgagtccactccctctcattttaatggtgaggaaatgcagacccggggggccaaggaagcaggtggctattcccagggcagggctggaatccagcatctcactccccggccaccaccttcaccatgagcccactctgtgtgcatacaagcccctgagattatttgagtctctttgtccaggaatgagtaaagccattttcctaccatgagtggtgctgtatgctgtcttatgtgtgttaatcatgaagatgagccggcagtagcctgcagtgcaacacacaccttccccctgcccggagctgtctttgggagtctagctgcctcatacagccatctgtttggagcctgcacaagaaactaaaatgaggctggatgtggtggctcatacttgtaatctcccagcactttgggaggctgaggtgggaggattacttgagcccgggagttggaggctgcagtgagccgtgtttgtgccattgcactccagcctggatgacagatcaaaactgtctcaaaaaaaaaaaaaaaaaaaagagagagagaaagaaacgaaaatgagaactattacatcaaagcatttaccttaaaaaataagtatgcatgatcaggaacctgtgttttcagagggatgtcctggtgggtgggagggaggaactggagagttttccatctgtaacttccctgactgtgataaaaccctcttcccatcagagtcattcaggagagcaggaaagaaaaggccatccctgtggatgtcgcgctgccacagaagtccagcgaaaaggcggagttggcctcatccagcagcaagttagggctgaagcctgcgagtcctgggcctccaagtgctgggccctcgatgaagagtgacgaggataaggatgatggtgagaagcttctggaatgatcctcagcctaaggtcaagggcgtggctctgttccctcgggagaccttccctgggaaggggctcaacatctacacaggcccttcaacctcagtgatcagtgttgcagtttgttcaaaattgtaatgtacccaacattggaggttcaggtttgcagggtggatgtggctgtcagtgtgagtttccttctgtgagtcttgtcctcccccttcccatccccttttgcctccctgtcatttcaccctctggcggggccctcattgttagtgtgggaagctcctggggagggggcaagagtcctgcagaaactgcacatttgatcaggtgacttcctgtggggaggctgcagggctgccatgggtactctctgtggcaccctggccacgtggtggtcttggttgtgcagggaggctgccaggctgctgtgggtattctctgtggtgccctggccgcctggtggtcgtggatgtgcggggaggctgcagggctgctgtgggtactctttgtggtgccctggccacgtggtggtcgtggttggagaggtggacgatcactctatgcctgcttcggtttccaggaaggaaagtttctcatatgttggtttacctgctttgggggcccttggaggttgccggttgcttttcctagatcagcaccttgccaggttagagaaagaaacatctcaaatggtaatccttatcttcagagatgtttgtacaggatacaaacggcctggccttacccattgttaccaaatagacttggctttacagggaccatcaggaaaatcaggaggcagggtaagagggcaacccacacttgatttcagatctggaatgcctggcccctaactgaggctgcgtctgtgcaaatgaggctttcctgcaggacagatgtttgcctggttaagggagcctcctgtgtagagagatgatgtgggaggaagagtgttttactgtcccctagaatgcaatgagaaacataggaggatacggccatccccaaaactggcttttgaatcaatcattgccaatcagacaccatgtagatgggttcaaagatcctgatgaaatcttttcgggactgctgaatattccatttgaaaaaacaattcttcttttctaaaaatctagtaacagggacaataacagaagccgaagaaactgaggactgactgagacgcatgaagaagtggagattgtcagaattatccaaatgaaatggtacagcaggtgcactgttaacagtgtgatggaatgaccacccaaagagaaaaaaataaaggtattttgaaaatt

SEQ ID NO: 334 - DNA, 179919 bp, Homo sapiens
gcggccgaggccggggggcggcggcgggcgcccgcaggttcccgagccgctcctgagaaggcgcctgacagcgggccggggcgcacggagaagcgggccgggccggacctgctgggccgcgccgagccaatcgccggcgccggccgctcgatgggcgaggcggcggcggcggcggcgggggccgcgggccgggccgccgctccgaggtgaaggcgcgcgcccctccccgcctgcctcccgggccgcagcgatgaattccgccgagcaaaccgttacgtggctcatcactctgggggtgctggagtcgcccaaaaaaaccatctcggacccggagggctttctgcaggcgtcgctgaaggatggggtggtcctctgcaggctgctggagcgcctgctccccgggaccatcgagaaagtaagtcccggcccgcgcccccgcccgcgccccccggtccggcccgctgcggcccgggatgcgcgcggagcacctgaggccggccgcgctcgggaaacccgtgcgccctcctttgtgcgcggagcggcggcgcggccggcgccaggaccgtggcgggagctcggggggcgccattgtgtgcggggcagggggagggggccggggagcggggtcggggggaggggcggcgcgggcggcgggggtccccgggaaggagagtgcaccgcagcgaggagacggggcttctgcgccgcccgaacgctaagttgcccctccgcgtggggggccggccccgctccctggcagcagccgcatcggaaaccgcgttccgacgcggtgcggctcactccgctggctttgtgtggacagttcttgccggtggcgttgcgtgagtttcgcctcccaggttaattgaccggttgctctgtatttttaaagaggcacgcatctgtagctgagggctgcgctgtgaaacgatctactactttcccctcgagaaaattccccacctatccgagccgagaggacggcagacacagggtctaagtcctggcactcttcaaggcttgttaaaattctagatttcgttctcaggtccctccctcgttctgaacagaacctttagtcctgcaggcactgcttctcccttccggctggtggttcccaggctggagcgtgtgaaccctgacccgaatctctggaagtgattaaagtttgttttcatcgcccacaagccggccagcagggccgaggaggcaggagagtttctaaaaacgatgtctccctgtagctcaaaatactaaaatcttattcccagggtgtttcttcggggggtggggtgggggtgggggtggccaatatatagcgttaagatcaacagttatttaaaaggtgttaaatatagaaattgaagtgtaccataattaggaagaaggatttcagtttttaagtggggtgtattggcccccatacaggatgacaacaacttgtaaataaaatgccacgtaagtgacttgaaaaagtaaaatgtttaatttttttcattcacatgtacatattctcttgctacattttaaatgaggtcagaaaacattttatttaatatgaatttggcttgcattccacttttagctatttttcttacttggaacatctttatgaaaacagaatctgcatattagagtgaatggctgcctgcctgtccatgaaataaaaatgttccttaaaaatgaacctgatgtcacagtgaaattatgatttaagacaggaggactgaggagcaggagctgactttcaaggcattcaaaatactttgctgtttggatactggtacctctggtaatgaaagacagatgttgaaaagtgttgaaatgcatgcaaagttcaccaaaataggcttaaataaaattctgttccatccctaagagcaaagctttaagaagtgtcatatgctgtattgataaaaacatgtcgccatcaaagaatatgttgtttggcatattaactgtattaatattgattggccgacttcaataatcattttcttttaaattatagaaagattttcctagaaaaccgtagcgttcatttcatctctaaaacaacaaagagaagaacgaataaaatgttgagcttgcagaagccaagttgaaacaactcaacatattctaaaactacagtcatctggaaatttcttaggtcagagctgtttttgattccccctgagctccagttggtttgtgttaaactgactctgtcacaatgaaagtttaatgtgaaggcagcgtattgtagacacagttactggttctctggagttcaaaggtaggtttttggagtaaaatattagccgttttctgcctctgagatccctgtgtttcagaagttttgtgagctttttccatttgctaggcagagttatctgggtttctttctttcttttctttttctctttctttctttctctctctctctctgtctctctctctctttctttctccttccttccttccttcgagatgggttcttgctatgttggccaggctggtcttgaactccgggcctcaagggattgtcccatctaggcctcccaaagtgctgggattacaggcgtgagccaccacgcccagccagttatctgggtttttggtgttttcatgcttaccagataatctatgccacaaagcacacatgctgaataacttttacttaaatgtgggaatgtgagtctgaggatgttttttccttaaaaagaagcatttggaaacttaactgaatgttcatgtggacatgacaggggcttcgcttgacctctgctgcaggagtgccctgacagccagtgagcggagggcaagtggcctgcagccttcgcctctgcaggctcacaacctggcatgggccatgaggctggggatgagggcagaactaaaacgtggctgggtgcctcgggcttcccatatgtcttttattaagaaaccatgccctaatgtgtttcttccattacgctcatttgttctgtttcagagttaggaagagggtggagggagcagagaggacgttcacggcgtgtcagattcttctgctcatttaaaggaaactttccacccaggttcccgctttgcttttaaggtggaaggttagacagtgagaagatggaattataaactttacatgaacagttcagaaaagagacacttttcattatactggacagatgttttctgctgtaggggagaggaaaatgggattaaaaagttttcgccttctctgtatctggagatcctgcactttggttttctccaggaggggtcaggatgtttggctgggctgcccatgtcttcggcttcccacactcctcccgtgagcagaggtcatgacgtctagggagccctggaagcccttttctcacaaattcactttaaacatccctagggtatttagtcaaaggaggtgaaatcaagatacatgaattgtagaggatggaaaatttctataagactaatacaacacattaaaatcatggaaatcatgaaatgctcttttaatttcacttgtgaatgcaacaaatgaagtctcttaactcactataaaaaactcaaggaacttggttctttctctgtgtgtcccaggagaacagaacacagagaaccttcctgtgtaatccatgtgatgtgctcccgagaaccctggctaggtgtttgtggaatgtaattgaaaatcagacgctgcctcgggtcttagtgctggatgtggaggcatttgtctctcagctctggaggcccaaagtctgggattaaggtacctgcagggcctcgtgccctcagaaggctccaaggaggggtctgtcccaggccactctcaggcttctggtagttcctggcttgtggcaacacaagtccaatcttcacatgatgtccgtgctgtggtttcttctctgtgtccaaattcctcctttttagcaggacatcagtggaattgcattaggggcaccctaccccagtatggcctcatcttaaccgattacatctgcattaacttcatttctgaataaggccccatcctgagatactgggggttaggacttcaaaatacgaatgctggaggagcacagttcagctcatgacaggttgtttctacatttgaaccagatcagtttattagctattgatctgattgcacaatgccaggtgctaggggagattgcaaaacctaaataatagagtcttgggggttccagtacagaaaatgtaactcgaaagacaagaacagcatgaggcagaaggaagtcaagagtcgtaatgtcagatatggatgagaaggagcaaaagaatcaaggagctaaaaagaccagcatttgagcaggtcagacccaagactttgctgacgtgtgggtaagaatatggtttgcatttcccaaactgtaacctggcagccctaggtgattttccacaggcttgcagaaaatcagcaaatctgatgttgcataggaaaaaaggaaatacttttttctaggtaaactggagactcactttctgctcagtgtcaggattctggggttggttaggggctggggtgaggagaagcagaagtgctcacctgctagaaatgtgccttttcttaggtcctttggccctaaaaagaacgtgatgagtgatcacatgtggtggtagggtaaggttctcactcaggcccgtgacctgtagccgtcataaagacttgttgattggctaagtcacttatagagaagttataatatggtatctccagactgtgtttttaaggagacttctttaaaccctgcaaactgaataactggttatatcaagttgcttctaactaaactaccctgaatatggttccagaatagtgaattttgcaataataaacatttccttttgaagcatgtgactttatagtcctgtctcaaccctgaaccagtgtgattcttgtttgggtttcaggcctagggaagaaggtagctggaactgcatttgctggctcactaaaaagaaagcaaacaaactgaaattcaatttaaatcaggagtgcctgaagagatttcctgagaaccagactagaaactagtgtttatgttggcatcacacagacacaggagagcacacacacaagcatacacacacgcatacatgcacacttgcacatgcatgtgcacacacgaacttatgcacacacgcatgcatgcctgcacaaacatgcacatacgtaaacacatgcatgtaaatacacacacacacagacacatgcgtgtacatagacacgcacacacgcacacacagacacgtctgacgggggttgagggagtgggggaaggagtgctggcacatgtggcattccattttctcaggggcagctgctctgtgaactctccaagcccagtccaaaggatgccatctcaggacccggccctcattctattaatagaagtcactccagaatctgcctgctcgcctcctttctttaggcactgcctgcctttctatacatcttaaaagagaataagatgtctgcccagcatggcaggcagcatgctcctctcgtttgcaggcgctgtccctcgcaatacccatactgcagatgaggaccctgaggtctggcagttagctttgccccaggtcatctggctgcactcggaggcggaagattccagctcaagactgtgagctttctcatggaaaacaagactgattctgccacctatactgaacttaggggaagattcgcaaccactgccttcagaaatttacaaaccagatcaggaaaggagacggaggcagcagtgtaactgagcacccaggggggacaaaagtgaggactggaggggctggctcaggtcaccggccacaggggcagagtgggagccctcaggagtgcctggagccactgcaggtgtctcacttctcgggacatctggaagcagctctgcccttcagtagacagaccccaaaggcacccagggtagggccccttgccctgggggaacctgcagaagctcctgcagaagtctgtgtctgggcctttctccccggccgcagaacgtgtgttccgtgttcctgtaccatccaataactcactgtagtttctgggcttccctactctgtagggcttaccagatttccacttagtccaagatttcaaactgtgtgcatctacaccacacacacttttaaaattcaagtactatgtacacacgaacatctctctccctttagaggccactgatcactctaaaatgtaaagagtggaggcgatgggggctgtgaggtgagtgggggcagagccgtttgttcttgtgtagggtggattttagccgtttggattggagtcttgtgtaggcttgacgcccacgcgtctctcactgcacgagggaggtggcagaggcacatcatccctttgggcacgcaactctaccacgtgcatcgctgggagatgggaggactggcatcccccgaacccacgggtccctgcctggagacactgggagacccggtcctctgcgtgcttcagagtcaggcacacctggctttgttcccgcagccatttgctctgtgacttccggcacctgtctaacctctcggagtcctagtttcttcctcctaaaaatgagatgaatgatatccactggtgggggcagtgaggtcattaccagggtaaatgagtagatgtgctgggcacaaagtcattcctcagtacgcagtagttactgttttgttgattgacactgaaaaccttccccatcgtgtccagaagactgtaagccaagatttgaacctcagagccatccaaatccaggaacacgggttaattctcacaacagggcagactcttgcaactttcgggggctggcagcctctgcatcccactctggacagaccaccattgtctgggttggtgggcctgctgaacgtggcttccagggccctctggtcagcgccagatctgggcgcagctgctgagtgcacacagctgctggttggggagcgggagggctgagcgggtggactcaggtttcgcttatataaagtttcatgcatcagcagggccgggagtcagagatgggaagtgagggccagcctgccccacctggtgtctgcagagagagggctttggggccgccccggtccgactgcttcccgggtacagcttctgacttctccctcctttatcagttctgtcaagttagggtaggagaattaatctcttgatgtttttatatttctaactttagctttgaatttttaaggtttgatgcaccaggctggcagttctcaactctgtttttgcaggatggtgtcatgtctgctggggtctcaaggcgaggcggtgaggggaactgaaatggaatgtgtgcacagtgtatttcaaacacatgtatgtgaattcatttaatcatcccttttaccaggttcctattgtgtgcgtgctagtgacccaatcacacgcatggaagcgcacgcatggatgccagccataccacctcttcaggcaggtcagaagagaaatgctaggatcttgggtataaagtatttgtgagttctcaggatgaaggaatgtagagtcatccagcccagacgcctccttttgcagatggcttcactgagggcacctgcatgtggttgtgtaagctgtgtactgcccggtcttgggagaaccgttcacactgtagtctaagcaaatggctccaaggcctgtgctgggaggcggccctgggatactgtgtatagaggtcagcctcccaggacacaaagcagagtggagaagggttggggtagacgatagaagtggccccaattctccaaccctcccatgcccctggcaaagtgaccttgtagcgcctccatcaagaggtaggagtctgcttcctcacttcttgaatctgagctgtgacttgttttggccaatggactgtggcagaagtggccagtgttagttcctagcccaggccttggaaaggcttgcacttttctgcactctctcaggccctgtgtctacctccgaggagaccccagggcttgggtgctggtggggtgtgatcacatggaggagaactcagttgtccctgctaggccatcctggacctatccacagccagccaacctcaaacattgaagagagcccagccagggtcagcaagctgcctgccctgcccagagcaggcacagctgcaccagcaggcccggaccaggctgactcaagccagccactgaggtttaccatggccatagataacaaatcacacacacacacatacatgcccgtgccattcttaactaggggacatgccgatatatgtaaatacagtccatcccaatcacaagagtgcttgtacctttgtttaaaataccctctatatcctttatttccttgataatttcctctctagtattttctctattctcattttttagaaatcttattaagactaatcagagataatatctattgagtgcatactgtatgccaggcactgttctaaggactttgcccataataatggatttaaccctcctcaccaccctataagggaggtggtgacaggatcgcccccattttcagattaggaaacggagctccagagcggctggtaactggccatcgttggctggtgggctgcgccccccccccccggccccgccccctgcccctgcggctgccaggcctgctgggttgagtctctcatttgctgacctttccacttgtatgtttcttctccttctgaaagacatttccttgactttatctcccaacttttctactaacattttttattttgacctactttggctattttttttttaatttctaaaagttcttttttctcgttatctggtttctctctgtttcttccctttcagtcagtcccttcctgtttctgggaagattcctctcttcctgtgaacattcattacagtttccttgaagggtgcttccttccctgcattcactgtctctgtttcctctgagtcctcttatgcaattctttttttccatgttggagatttactgaaacatcatgtgatctttcaagtgtgaggccctcaaaatgaccaggaagtcctgtgtgactgctggggcccagggacatgcaggtctcgccatggggcagcctggtgatgcccagaagtctgaacctgttggtctcttctccagcagccgtgagtctctccagagactcctccatctgctgcctatcagagcagtgtccatcctcaccttggctcctgtccatgctggccctctccatgttctggcctctttggttcacttttccccagagaataagcctcggacccctgcaaggatggcaagaggggtggccagctgtgatggggctggggcccctaggcctgcatctgactctcagacaggtggcttgtctaccacctgggagggtgcacttgccactggctactgggatgggaccttctagtctctgctgaagccccacccatcctccgtctgctccctgccttcataatggtggcctggggataggtgtcttctagttttttttgttttgttttgttttttagacagaatctcactctgtcacccaagctggagtccaatggcacgatctcggctcactccaacggccgcctcccgggttcaagtgattctcttgcccccgcctctcgagtagctgaggctacaggtgtgcgccaccatgcccggctaatttttgtatttttagtagagacagggtttcaccatgttggccaggctggtctcaaactcctaacctcacgtgatctgcctacctcggcctcccaaagtgctgggattacaggtgtgagccagtgcgcccaaccaggtgtcttctagttttattgaagatgatgcttgtgtttcttgttctcctggctgttttggagggattttttttcaagagaagtgaggctgaaataattttactgtactgctttggacctggaatctttccatgatgagaaaaagagagagagtgagaatatatgaatgaatatccatgtcctatgccctgggtttcatatctcttcttctgagtactttaaaattactagagaaaacaaaactggaagctggttatttgaaatgttcttttttttcttgttgcttggtattttgtgcataactttattattacacttggagcagctttttttttttttaggggctggtgatcatcctatcttttctctatagaagctatatataattcagaatcccaaaaagtgtatataaaagaaacgtaagcctcgtccagtttatattaaattgcctttgtctaaaatgggcatccacagctccaagtgtgtttggatttgcgtgttctctcgccatgaagccttgttctgacagtgtgatctattagcaacgcctttaaagtggcctggttttgattatttgtaaatattatggccagtgatggcttttctccctcaattctgagtgtctcactactaatttcctgtgccagaatactttttcaccaatgtcctgtccttaaagtagcttaagttcataagggacttttaagtacccatttgtagttagcagatttttcagatgtcttttgttaggaatacagattttctgaaaaagccttttgctttctgaacacatgccaaaagattgtggctttgtcattcactttaaggaagaatgctacagtgattttgataggaaattgggagattcagaggatattcctggttctgattgtgtctgtttggctcctcaggaagagggagagcctcacctgcccatgtggaatcagtccaggcctctgtttaccttgagcaatgtcattggggcttcctctgtggtgcttaggaaagtgccttaagacctgggtttgtctcactgatctcataaagcactggtgctggtgacagatgtcttctggtggaaacacattttctggttataatcatccctatttgttaaggatttttgtttcttttgaaaataggctttaaggctgggcgcggtggctcacgcctataatcctagcactttgggaggccgaggtaggcggatcacctgaggtcaggagctcaagaccagcctggccaacatggtaaaaccctgtctcttctaaaatacaaaaattagctgggcatgatggcgggtgcctgtaatcccagctacttgggaggctgagacgggagaatcacctgaatccgagagacagtggttgcagtgagccgagatcgtgccactgcactccagcctgggcagctgagcgagactccatctcaaaaaaaaaaaaaaagcctttaacaaaatagaatatggccaaattcttgtgacttgtgacaaaggttaaacttccagaaagtgccctagaagccataattttccatgataagagactagaatggaatgtctttcagactttatcaattgatgacaaatggagaaaaataaaagttcatttatggcacttctgaccaagctcatttccctagattgaatctgagtaattgcaatgtcagctatctagggttggctcttcaaacaaataacctggagtcataagcacactgtttatgaattcctcaaatgaaattctgggagtgagacaccactcaccctgcacatagtcaaatcttttgttgcctgtaatggagcttccaccttaagaaactagaaaaataagggcaaattaaactcaaattaagtagtaggagaaagagaataataaagaacagaatggagattagaaaattactagcgagaacaaacaaaactgaaaggtggttatttgagaagaatcaataacattgataaacctgtttgtggactgattaggaaaaacggggaaaagacagaaattaccaacgtaaggaatcaccacagatcttacagatatcgaaagataataagtggatatgaaaacattgttatgccaacaatttctacaacttagatgaaatggataactttcttggaagacacgaagctcactaaagaagaaattgataactttaataaccctacatctattacagaaataaatttgtagataaaattcttctcataaagaaaattccaggccagatagtttcactggtaaattctaccaagcttttaagaaaaaaataactgtaattttacacaagctcttctaggaaataaaaattgggccaggtgcagtggctcacatctgtaatcccagcattttaggagggaggattgcttgaggccaggagtttgagaccagcctgagcaacatagtgagaccctccccccatcactacaaaaaattttaaaaattagctggatgtgcctctggtcccagctacttaggaggctgaggtgggaggatcacctgagcctgggaggttgaggctgcagcgagccgtgatcacaccactgcacttcagcctgggtgccagagtgagactctgtttcagaaaaaaaaaaaaaaaaaaaaaaaaagaaggaaggaaggaagaaagattaatagtgaggttgtacttcccaaaccattctaagtggtaagcattatcctggtaacaaaacctgacaaaaatattataagaaaagactataggccaataacccctatgaacatagatgtaaaccttcaaaaaatttagcaaatcaatttcagcattacatgtaaaagataagatatcataaccaagaagcatttatctcaggaaataaaaatcaatcaatacaattcatgatattaacaaactaaaagagaaaaatccagaggattatctcaatggatggcagaaaaagcattcaatgcaatccaatccaacgtaaactcttggtaaacactcccagtgatctaggaatagaaggaaacttcctcaacatgctaaggggcatccatgaaaacctacagcctatgtgagactcaatggtgaaagactaaaagctttccccctaagatcaggaacaagacaggggtgttcactcttaccacttctgttcaaccttacactggaggtctcacccagtacaatcaagcaagaaaaagaaaccaaagccatctagattgaaaaggaagaagtaaagctgtctttatgtgtagactatatgattgtgtaggaaattgtataggatctacaaaatagctactagaactagtaagtcagctggatgtggtggctcacacctgtaatcccagctactcaggaggctgaggcaggagaatcgcctgaacctgggagttggaggttgcagtgagccaagattgtgccactgcactccagcctgggtgacagagcgagaccctgtctcaaacaagcaaacaaacaaacaaacaaacaaacaaaaaaccagtaagtcagtttagcaaggttgaagggttaatatacaaaatcagttgtatttctatatattagcaacaaatgatcagaaattgaaacttaaaataccatttacaatagcaaagaaatgaaagaaaagacaaatgcttaggaataaatctgacaaaagataagaaaaacatgtacactctcagcaacatatattgctgagtgaaatgaaagatctaagtaaatggggctatacataacattctgggtcagaagtcttgcttttaagctgttctattcatattgatctatagattcaacagagtcacaaccaaaatcccagaattttttcagtagaaattgataaatgattctaaagtgtctatggaaaggcaaagggcctagaaacaactttgaaatggaagaagagagttggaggacttggtttccagggttttcataaaacaacagtaatggagtcagcacaacgttgcaataaagatagagaaatagatcaacagaacagaatagaggtagaattagatccttaaagacatagacaactgattttcaacaaaggtgccaagacacttggctgtccaaaggacactcttttcagtaaatgatactggaacaagtagatacccatatttttaaagatgaactttgatctatacctcttagtatacaaaaattaactaaaaatgaatcatagatctaaatgtaaagcctaaaactaaaaaactcctagaagaaaatataagagaaaacatttgtgactttggactaggcaaatattttttatatatgacaccaaaaacatgatccatagaagaaagaattccataaaagaaagagtggacaaattggacttaatcaaaacaaaaagaacttctattatttaaaagacgctgttaagagaatgaaaagacagtctatatattggaagaaaatatttgcaaatcacatgtctgtttaaggatttgtggctagaatatgtaaagaactctcaaaacttaataaagagcctaattttaaaaatgggcaaatggtttgaatagacatttcaccacaaaatatgtacagatggcaaataagcactcaaaaagaagctcaacattatcagtcattagggaagtggaaatgaaacctgcaaggagatagataccactacacacgtatcatcacggctgaaatctaacagagtgatcctcccaagtgttagcgtgtatgtgagggaaccagcactctcatgcactgacagtgggaaggtaaaattgtacaactgcttcggaaaacagttgatccgtttcttaaaggagtaaacatacatctaccaaatgtttcagctattctactttgagatgtctgcccaagaaaatggaaacgatacggccataccacgccttgcacacaagtgttcataacagctgtatttttaatagccacaaactggaaataatgcagatgttttacagttggtgaatagataaacagattgtggtatattcctgtaatggaacacggctcagcaataagaaggaatattccatgacatggatgattctcaaaattatgctgaataaaagaagccagacaagaaagtacttaatgtatgattccatttatagaagatttctagtgacagaaagtaaatcagtgctcgcttggggacaatagctggggtaggagaaagtgattgtggagtagctcaaggagacctctgcgtgaggggcagagtcattaccttgcctcttgtgacagttccatcaggttgcactatgtcaaaacttatcaaagtgcacagtttacatatgagcagtttattgcatgtcagtgatacctcaatacggcatatgacagtctttaccctgagcataattacgtttttgttgagtgtaatggagctttaactcatgttatttgctgtcccctacttttgaacctaatcgtgaatttagaaaatgtatagaattttaatgtgcaatggtaaattgtgtacttatgttttattaggggaagtgatttattgacagttcatttattgatttatttgtttattttctcatcaaatctttactatgttccaaggatagtgctaggaactggagatttcgcagaaatagactcgcatactatttagtgggggagaataacgtgaaaagaattacacgaactgattgtatcacacatgagctatgtgcgctgaaggcaagagacagatttccaaacacgcagcagaagaaactatgccccttggcagatggggccccagtggcggtttggggaaggctgtcctcaagaagtggcatttgagttgccctctgactgatgcatagctgtcgtaagaggaggggcatgcacccctacacagaggggcccttcaaggcctggggcaagaggaggcctgctttgctgggagtggcgaggaaaggcctggatgggtagtgctggaaccgaggggacgcggagagacaggcagagccaggcagcacagggctggtgggcccttagtttgcaaaggttttgatacttttcaaatttttaagggaagaatgatatgatcagttctgtgctttgaaaacaatactctagccatagcgtggagaacagatgaaatgagcccaggatggaggatgtgaagatggttatgaaactcccacggttgcccatggagagctgtgggagcctgggctggagtggaggcagtgctgacaaggagatggggatggcaccaagggagcccaggagggtgcggcggcgggcagacagggggacagtgatttgggtgactcctgggtttctggttgcacaacaggatagatggggcggtcgcctgtgctggagccctgggcgaggcttacctaggtttggggcaaggagatcaggaatggattcagggttgggtgtgtcgttggaggcatccgcatagagctgttggagcttagaggccccctggactgaagcatacacgtgggactcgtagtacagagatatgtactgaagctgaaggacttgtgaggtttcttacagggcagttaaagtgcgaacgtgagaaggccaagggccagccttgggaagggtggagatgaataaccaggtggtgctgatgagcctgaagagagaaactaaggcagggtggtcagaggccattaggagacgggcagtgacctgaggtcaggggacgagagtgctggtgtgtttctgagaggtcaggtgagtgcaattcagaagattgtctgctggcttgggcctgtgctgggtgggaaggagggtgctattcctagctgttctaggacaactggccagcacacacccagagcccacatactggagcaatgcaggcatgcccaggactgaagagggggctgggagggagcctggcagtcgcagaggggagtggaaatgttggaatagagttgtggagtatgagagaggggtggactcagtgagggggtggaccgtgagccctgtggaaacccacccatggaggggtgcatgcacctgtagcaattggcagggaactgagcgggagattagggcactcattaactgtcttgaatgtttggttaagaggaagtgatcttcagtgagggtcagcgtgtttttcttgataaaggaggctctagcaaactgtatccctttcaaccgctttaggggagaatgtctgatattttttctttcctttcccacattttaaagtgtgttcttttccttcctgatggatgcatctggtggtttaaggccaataagtgttgcgttgagcctgaacagttgtttgttactctcaaaatgtctaagactttcatctccagcttatacatgtattgatgtcaggtgtttaatatttcccctttgattcatttgatagtgaatggcttctgaggtcaggatggggacactgccaaaactagctgctctctgctgagtctctgttttgcaggtgacatttgatagtctagatttgatatcattaaggtattttagggaagtcaatgtataagttttagaaagttcaggtgcatgttgaggactattgttgtgagaatgttatgaatacacttgtgtctctcctgggattgactttttctttccctttagaaaacgctcacagtgtattacatatcatgctaaatggatggagatgaagcaaatccaggggtgctcattgggaatatagttcctaaataactgcagtaaatgtaagtcatgtcctggggaattatttttctaactcaaagcatgaaaacatgaacaattcagttctgtctccatgtgtgggagaagtaaactcaccacttacttttttctttttaatccttttttttttagaggaaggtgggtagagagtgttattgggagtaggggtagggatattgagggaagggagaatgatatacacacacacatacatgtacacacataagtacacacacatctatgcatatacacacatgcatctgtacacacatgtatatatacacgtatatgcatacatatttatatatacacatgcacagatatacacatgcatatacacatatgtatgcacacatatacacatgtatatacacatgcatatatacacatatacatacatgctatctacacatttatacacgtgcatatgtacacatgtgcacgtgtatatatgtgtatatatgtgcacgtgtatgtatgtgtatatatgcgtgtatatgtgtatatatgtgtgcattatataatgcacacatatgcgcatatatacatacagtatatacacacctctatatgcacgtatctataaacacatatgcctatacacatggatatgcacatatgcagacatacacatgcacacacataaacatacttgaacacgtgcatatctatacacatgttgatacacgcatgtatatgtatgcacatatatacatacgtttcagcttatgggcggaaaatatctgggttggtttggttttcctccttttatagtcagaaatggcagagctgctcaacacgaacttttgtccatcacatacagaaatgtcagtgatgtcactgacatcagaattggcagtacatgtttttccaagttgtcttcaagtaagatggttcttccatcttttttttcttttgtctaggtggttatatggtttgtaaatttgggtgtatgtgagactgcccaaggacctgtggaaattgagtgctggacaccacccccagagttcctgatttcgtaggactgggatggggcagagaatctgcttttctttatatatatatatatatatatatatatatatatatatatatatatatatatttattatactttaagttctaggtacatgtgcacagtgtgcaggtttgttacatatgtatacatgtgccatgttggtgtgctgcacccattaactcctcatttacattaggtatatctcctaatgctatccctccctcctccccccaccccacaacaggccccggtgtgtgatattacccttcctgtgtccaagtgttctcattgttcagtgagtgagaacatgcggtgtttggttttttgtccttgcgatagtttgctgagaatgatggtttccagcttcatccatgtccctacaaaggacatgaactcatccttttttatggctgcatagtattccatggtgtatatgtgccacattttcttaatccagtctatcattgttggatatttgggttggttccaagtctttgctattgtgagtagtgccgcagtaaacatacgtgtgcatgtgtctttatagcagcatgatttatattcctttgggtatatacccagtaatgggatggctgggtcaaatagtatttctagttctagatccctgaggaattgccacactgtcttccacactggttgaactggtttacagtcccaccaacagtgtaaaagtgttcctatttctccacatcctctccagcacctgttgtttcctgactttttaatgattgccattctaattagtgtgagatagtatctcattgtggttttgatttgcatttctctgatggccagtgatgatgagcattttttcatgtgtctgttggctgcataaatgtcttcttttgagaagtgtctgttcatatccttcacccactttttgatggggttgtttgtttttttcttgtaaatttgtttgagttctttgtagattctggatattagccctttgtcagatgagtagattgcaaaaattttcttccattctgtaggttgcctgttcactctgatggtagtttcttttgctgtgcagaagctctttagtttaattagatcccatttgtcaattttggcttttgttgccattgcttttggtgttttagtcatgaagtccttgcccatgcctatgtcctgaatggtattgcctaggttttcttctagggtttttatggttttaggtctaacatttaagcctttaatccatcttgaattaatttttgtgtaaggtgtaaattttgtataaggatccagtttcagctttccacatatggctagccagttttcccagcaccatttgttaaatagggaatcctttccccatttcttgtttttgtcaggtttgtcaaagatcagatagttgtagatgtgtggtattatttctgagggctctgttctgttccattggtctgaatctctgttttggtaccagtaccatgctgttttggttactgtagccttgtagtatagtttgaagtcaggtagcgtgatgcctccagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcacaatattgattcttcctacccatgagcatggaatgttcctccatttgtttgtgtcctcttttatttcgttgagcagtggtttgtagttctccttgaagaggtccttcacatcccttgtaagttggaaggtattttgttctctttgaagcaattgtgaatgggagttcactcattatttggctctctgtttgtctgttattggtgaataagaatgcttgtgatttttgcacatcgattttgtatcctgagactttgctgaagttgcttatcagcttaaggagattttgggctgagacaatggggttttctaaatatacaatcatgtcatctgcaaacagggacaatttgacttcctcttttcctaattgaataccctttatttctttctccttcctgattgccctggctagaacttccaacactgtgttgaataggagtggtgagagagggcatccctgtcttgtgccagttttccaagggaatgcttccagtttttgcccattcagtatgatattggctgtgggtttgtcataaatagctcttattattttgagatacgtcccatcaatacctaatttattgagagtttttagcatgaagggctgttgaattttgttgaaggccttttctgcatctattgaaataatcatgtggtttttgtctttggttctgtttatatgctggattacgtttattgattttcgtatgttgaaccagccttgcatcccagggatgaagcccacttgatcatggtggataagctttttgatgtgctcctggattcggtttgccagtattttattgaggatttttgcatcaatgttcatcagggatattggtctaaaattctacagaactctccaccccaaatcaacagaatatacattcttctcagcaccacatcacacctattccaaaattgaccacatagttggaagtaaagcactcttcagcaaatgtaaaagaacagaaattataacaaactgtctctcagaccacagtgcaatcaaattagaactcaggattaagaaactcactcaaaactgctcaactacatggaaactgaacaacctgctcctgaatgactactgggtacataacaaaatgaaggcagaaataaagatgttctttgaaaccaatgagaacaaagacacaacataccagaatctctgggacacatttaaaggagtgtgtagagggaaatttatagcactaaatgcccacaagagaaagcaggaaagatctaaaactgacaccctaacatcacaattaaaaggactagagaagcaagagcaaacacattcaaaagctagcagaaggcaagaaataactaagatcagagcagagctgaaggagatagagacacaaaaaacccttcaaaaaatcaatgaatccaggagctggttttttgaaaagatcaacaaaattgatggaccgctagcaagactaataaagaagaaaagagagaagaatcaagtggacgcaataaaaaatgataaaggggatatcatcaccgatcccacagaaatgcaaactaccatcagagaatactataaatacctctacgcaaataaactagaaaatctagaagaaatggataaattcctcaacacatacaccctccaaagactaaaccaggaaggaattgaatctcttaatagaccaataacaggctctgaaattgaggcaataattaatagcttaccaaccaaaaaaagtccaggaccagacggattcacagccaaattctaccagaggtacaaggaggagctggtaccattccttctgaaactattccaatcaatggaaaagagagaatcctccctaactcattgtatgaggagaatctgcttttctaacaagttctcaggcagtgctggtgctgctggtcctggggccatgattgagaatcactgacctagcccactgagctcattagcccagcagcaccatgacctggaccagccagatggtgtgcatgacccttgaagcagacaggaggccacggtgtcctcacctgggcgtcttttccgtgcgtggcacaggctgctcactcaccttggtgtgccctccccatcctcatgcttaacaagtttcctaactagtaccttcttagttcaagacagagcagaccccgagtgctgcttcctcatgggcttttggagtatttaagcatggaggcagagagacagaaaggacatcctgcttgggttggaaggggactcggaaatttatctgaaaaattggaatcccatttgtttctgtgcataattttttaaaataaaaaagaatatgtttttttttcatacaacagaagagaaacaatctccattaagaggccaagctcaggaggtttgtacaagatttgatgaaatatgttacttaaattgaggcatgtatggagacatcagtgaaatattcaaattagggttgggaagaactatagctaaataagatattgagtcacaaaaaatgaacagaagatgaagtcacactgttttaggtaaagatgctttttaatgctgaggcttttaaagaagagtaaatcaaccatgttgcctggttgtgggaactaagggcagcctcagggaagagtctgggttgccagttcaaaaacacagctggggccaggcacggtggctcacgcctgtaatcccagcactttgagaggctgaggcaggaagatcacttgaggtcaggagttcgagaccagcctgaccaacatggagaaaccccatctctactaaaaatacaaaattagcctggtgtggtagcacatgcctgtaatcccagctactcggggggctaaggctggagaatcgcttgaactcgggaggcagaggttgcagtaagccaagatctcactatagcactccagccttggcaacaagagcgaaactctgtctcaaaaaaaacaaaaaaaaattagccgggtgtggtggctcatgcctgtaatcccagctacttgggaggctgaggtgggaggatcacttgaacccaggaggtggaggttgcagtgagccgagatcacaccactgccctccagcctggatgacagagcgagattgcatctcaaaaacaaaaaccaaaaaacacagctgggcgaacggctgctcatcaaggaagcagttcatgttgtggagttcagctgagccgtagcctctttctaactcgaaggggtggtgggttttgccatccttaaattgaggatgcccttgttttctgaaggtctgaagcagcctgcaccgctcgcaccgtcctttcggcaaaaccaaagacacattgctcaatttcagtccagcgtatgctttgcaattcagtggccaattgagggtccatttgtaaaaactgaatgtggagaaaatgatgacaattttgacaacaccccaccccaagtctggccataggagaaaacactgcatcatgtagagaaagagctgggtctggagaaccggctccagctggcacagaagctccttttctagatggttcattccctgtggctttgctgaagcctttggtgaccgtggctgctttcatgaatggcgctggaatcacctgacaaggatttccaagcagccatcatgaaaagggctcaaaaagcaatgacaggttctctggaaacaaatgaaacaatggaacatctcggcaaagaaataaaacttatgaaaaggaaattaaaagtatagaactgaatagaataatggaaataaaacactggatgggctcaaaggtacagtagagatggcagaagattgattagtgaacttgatcgaggactcatcaagggaggggctcagtgtagacaagagagaaaacagacctcagaaagcaagggctgcccagggcggcacacactgcaggacagcagacagtgtgggaacgacagcaggattcttcccttccctcgccggctccttgtctctccctctgtgtctctctgtgactctgtttctcccctttttgtctctctgtatctgtgacatcctctacctctctgtctctccctctctgtgtctatgtctctgtctctctcatctctgaactgtcagaatcacaggaggcctccagagcgtgttttgtcccccttggttgaagaatgaaagccaccctgtgaaacctgtggctcttgtgggtgcctgcgtggagcactggcgggtgcctgcgtggagcactggcgggtgcctgtgtggagcactggcgggtgcctgcgtggagcactggcggcagacaggggcctgatgtgggctgcaggagcaggccagctgcttaggggcaaacccaatttggggcctgcgattttccttagtgatagggaggcaggagctgtaaccagagcttgctctggacagcactggctgaactgatgcccatgcacagaggaaactgagccatgggcctgcaggtgggcagtcctgggagagcactgggaagcccatgggcagctggccgcaggcagagccagtggcaacaggatgcagccatcaatctcaacagggagggttgaaacttttaaggtaaaactaagacaatctttcatttgtctctcactttgtctacagtgatcatatttccaggtctttttcgggatagttcctgtcttaaacatccaattctcacattagaccaactatattactttttggtatattactttttgccatgtcagcatcactgaacttcacttttggtagccataatcaagtgatttattagagtgtcacaggcacaggtccttcgttcattaattcacaaataatataccaagtgcctgtctgtatatgccatctgttaagattcaaccgtcatccaaacagaccaaatatgctgcagctggagcgtgtattgtatagtgcagggagagattctgtaaacatcacacagaaatcaatgagacatttcatttaccagtgatatgtgtcatggaggaaaacagcaggtggcgggtgggaagtgccagcacctagggcggtggtgcaggtttacatcaggtcatcggggaggtgttactgagaagtgacatgaacagagacttgatgaatgggagcaaagaaaggaatgatgtgaagatctgggaggatggtgttgcaggcagagggaacagctagtgcgaggtcctggggtagaagcctgcctggcgagttccagaacagcagaggccagtgagagtggggagggtggtagctggctgacgaggtcaaggaaggaataagggagcgattgtgtagtacctgcttggccattcgaaggacttggccttttattattaaccttttttttgtttgttcgtttgtttgcttttttagaggcagggtctttttctattgcccaggagggagtgcagtggcagatcacagctcaatgtagccttgaactcctgggctccagtgaacctccagagtagctaggactacagcatacgtcaccatgcccagctaatttttaatgtttttatagagacagggtcttgctatgttgccccggctgatcttgaactcctggtttcaagtgattctcctgctttggcctcccaaaatgttgggattacatataagttctaggcatgaactaccacacccagcctggaccttattttttagagcagttttaggtttccagaagaactgagcaaaaagtactgagttcctatacactcccttctttcagcccacccactttcccccattattaacaccctacattagtatgatgcacctgttacaattgataagatgatactgatactttattattaactaaagttcacagtttccattagggttcactgtgtgttgtatgttctgtgggttttgacaagtgtataatgacatgtagccactgtataatatcatgcagagtagtttcactgccctgaagtcccctttactccgcctagtcatccctccctcaactcaacccctggcaactgttgatctttttaccgtccccatgttttttttttttaaattacatttactggtttattataagaatattgcaaaggctacagatgaagagacatgtagtgcgagctatgggggaagtgtcgcacagcttccatgccctccctgggtgtgcccccttcaggaacctctacgtattcagctgcctggaagctccaaaagttttatcttttccagaatgtcatatagttagaacaacacattctgtagcctttctgatcggcttctttcacttagcaatatgcatttaaggttcctccatattttttttttttatggattgatagcccatttctttctatcactgagtaatcccattgtatgatgtaccaccgttttttctccattcacctattgaagtacatcctggttgcttccaagtgttggtaattgtgaagaaagttgctataaacaaatgtgtgcagggttttgtgtggacatacgttttcagccccacgtgggtaaatataataccaaggagcacaattgctggatcatatggtaagcctacatttagctttgtaggagactgcccaactgccttctagtggctgcaccattttgcattcccaccagcaatgaatgcgagttccactgctccacattcttgccagcatttggtgttgacagttttgtggattttggccattctaataggtatgcagtggcatctccttgttttaatttacatttcttttataatatatgatgttggatatctttttatgtgcttatttaccatctgtgtatctttgttggtgtttttttcagatcttttgcccattttaaaaactaagttgttttattaatgagttttaagagttctttgtatattcagaataccagttattgattagatgtgttttgcaaatatctcctccctgttggtggcttgtcttcttgttctctcaaggacttcggcttttcctgagtgaaatggggaggttttaatggttttgagtggaggagtgacattacaggcaaattataaataatgatagtaatatgaaccaaatggaagatcagtttataagtggtttttaaaaaatgcatttcccaagtacagattgctacacatcttattcacaactatggccctattgatttcagcccaccctgctgatacttgagttttgggtaataatgatctttttgtcaacctttttattactcacagataatatgaaagtcccaactggcccatctttcatgcaagaggcttttatagcccacaagtgtccttggccaatgcttcctgccctctcttcctatcctctcacctctctctctagggcagccccaactgctatttatagagagatgtgcttaactgtggatgtcctcagctgtttccagtccccttatttcactttcttcctctgggtgaatggctccctcctgcttcaccatctcctctccaaaatgagcctgcctctttgcatgccttcaaatcccccacaagttaacatgtggatgaaaacagtttcttcctaggtggccgggttcagtcttctcttaggtggctctgagacttgaacttgcattaaacacagctttgaagcaaagactcttgagtgggaaaggccaggaacaaaacactgcatgactgcggagctcccactcttgccccctgacttcactgtgtgtggagctgggtggcagtaggacacttcagaagcaaatctgagtggtggaggcaaacaaaggcagggccgccataaaaaaccctagacgtctgagaacacaagtatgaacagcggagtagcactcgggactgcagggacaggagctgccattctcaccaaggtgccttggtcaagaataggacattgggttattggtgaggcagagtagatacaggaggcagcatcccggcagagaacagactgcttgtgctgagggtggacatgaccctgcctcattttgaaactcacccagacaatgactacacagctagtacccaccttggattcactagcacatttccgtcagaggccacagccttctccataggtgtctttaacaatgggcaataagaaaataatcaccagccatgctgaagtgcactcagtgggagagggaacatgccaaagggtgggaaacaatagagcaagggagcttaacaagaaagtgatgggcagctctgattcacagaatgccatgccatcatttacagtctgtttccattaggtcacaagcatgaaggtgaaagaaaaaagacaattattccacgtgaacaggtgaaagaacaatcttcgaccaccagactcaacttgagttgtcttatgaatctgtactgctctcagttttcttgtacccagattcttcaagggcacatggaatggtggctgccgatggaagtggcgagacctcaacggtgcccaccccagctgcacttgcttcctggggatctgcatcgctgcagcctaaccttgaggggtggcagggcaagtgctgtttcccagctcactctcattcaacaattaagatacaactgctacgttttcatctaacaatactgggagaacaaaatacgactcaatggtgaaatgtattctgggttatctgatgaagttttatctttaaatattttgttatccatttttggcattgctatgaatttgggactgttgccaccaactctgagggattttaaactgcttttagagtttgtgagaaccaagcctcaggggatgcatgagtcagttgaagcactgtagtcttgttggtctctctttgacatttcatgtctctggcatatctgaatttaggttgggaactggaggtttggtacacttgtatctattactacccttcataatctggccagttccatactcatggaaaacaatttgtttgttcccagatggctgcagcatttcatttagagttgggctttgggatttcttgaagaaggaatgcaaaagagaaacatgctttaaaaaaggtttaaatttcttccagtaaacgacttgcttagtatgctgaagactttttgggggagcagcttacttatctggtatttagcagtcaaatccttggcatttctgcctgttgcttcatgttttccaatggatttggaggaagagttgtcctggagacttccaagttagctccactgacctacattttcactccatttaacattattgactgtggaatgagccagagtgccgtggaagagcataattcctgatcagaagacagctgcaatttaattagaataaagcagtgactaccatgtaattaaaaattagatgaaccattgaatgctaagcggacttctagaaggtgaacttaggatttcaaacctaccactgcatctctgcatgacatggtggagatctgccctatgaagaccccagcacgctggcagcccatctgtcttgaggactgttttgtgacgggggagtcacgttggcctgaggggaagaataatagattgggagtggtcatcgtcttcttctctaatgtatttaataatacttgcacatgggacaacattcaaagggtacaataagtagagagagaaaagcaaatttcccttgttcccttgtcctccatgcccaattctctttccccgtagggaactcttgttaagtggcatatgcttgcagagacagctccatgcatttctaaacacctacatacattttcttcttgctttttttttttaaaaacacaaaaggtagatattatccacggtgttccccacgttccctaccacaccaaacataacttggagattgtgacatatcaggatataaagctgccccttttttaaaggctgtatggtagtggtgatagtctgtttgtggaagcattagaattcatttaatctgtcctctagattgtttccaatcgtttgccattacattgtgttctaattttagatgccgccaggaagctctccaggttagggccaggcagaaaacagatagatggcacactgaacagaggtggtttatgagacgatttatgaagtgagggcaggaagaaggacaacctagaagagatgggttaatgacagaaaagtcattaactctccctgaccccgaagcgaaaggtcaagggaaggagggtttctccagccagtgagagctgtagttacaggagaggctgcctgacaggagccatggtcttccgcgagtggtgtgttggtaaatgttaaacacctggctgtctgggaggggtggccctggcgtgtaccgtttgctgatttctgtgccgtaggtacttacaccagggctttaaaggcaccagtgtgacggggtgacacccatacagcccactgtgagccagctccagcatctactgctctaggcccctgcttcctgccagggcctcctattggctcaaccccaccagaagccagagagcagggaagcctggttgatgcagtcctcagaggctggtgcaggttggtgaaatccacgggctgtgtagttttggacctgacatttcagctgtctgagtccctgttttctcatctgtaaaataccagaactacctcaaaagttttctgtgaccctttcagctaaggttctttgtttcacttactccgtgatgagtggatttggtgacctaagtgagttaggtcatttagtgcacagttgctgactgtttaacatgagacatcggtgggccctgcagttagggagcttatgtctaatgagggagatgagatgtgcacaagtaggtccagccgtgttgtaggtctagctgtggacagaaccacatgcattcagaggaagtgatctttcatacctggggtgtgagatttgatggcaaagacctggggtgaccttcattctgtggttgggagtctgcattattctccaagtaggaaaaaaacagaacacttctagagtcagtctatatataccactaggttctctaagtatggtcctgataccatcaatgtctacagggaacttgttggaaatccaaattcttgggttccaccccaccttctgaatctgtgttactccaggtgattctgatgcatgtagatgtttaagaaacactgagttataccataccagtggttcccaaacctggctgaaaatcagaatcagatgaagactttaaacatacacacacatgtgcacactgacgctaggctcctgggctgtacttcagatctatgcagaatcagaatctccctggggagataaatacttctcagatgtgactattttctactggtgatcttaattgttgagataacattgaacctgtttaattatttgccttgctgatactgcttgttcttccttctgtagtggtttttttactcaaactctttcaaagtttgagagtctttaaattctgagaggtggcagctgtcttagtcggctctctgctttggttgagggtggagatgattgttcctgccctggagtagttggtaaggacttgacatgaaaactggatagctgtggatgcttctgaagtctgaccttaatgttgctttgtgattaatttgcagcaaattttcatatcacacacactgcttatcaaatattaagtacaaaaggcatactttgaaggaaaattgtaatgattctgggactatgtctctgcctggttagagttcttgatggaaaagcctggagtttattaccacggagaatttggcacaggatttctgaaaagtgaactgggcagagttgttggtcacttgaggcctgagttttctgaatatttctggagactacatgagaaagcagacttccccacccctttgaattgtgaaggctttgctgattataaataaagctatgaacattgctgtacatggctttcagtggacctatgctttcatctctcttgggtaaatacctaggaaaggaattgccggtcttagggtagatgtatatttaactttgcaagaaacggccagttttctaagcataccatttacactcccattagtcgtgtctgggaattccagttactttacatccttgccaacacttgatatattgtcagccctttccatttgatccattctggtggggtgcagtgttatctgtggttttaatttgcatttccctaatgactaaagagattgaactgtttttcacgtgctcactgaccattcgtttgtatagcttcttcagcgaaatattaaagggactttcagccatcttgtttgtatcacaatattccaaacatgtttttccaccacagcttcacccatgatctcagctgcccttttttactcgccatccttgagaacaccctggactgccaaaatggcacacctttgagatgcagttccatttgcctcttcacccttccaactcagaggtcacctttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacacccggctaattttttgtatttttagtagagacggggtttcaccgttttagccgggatggtctcgatctcctgacctcgtgatccgcccgcctcggcctcccaaagtgctgggattacaggcgtgagccaccgtgcccagccgaggtcaccttttatgctggttaagcctctagccctgccctatctctgcagaatttaggtttccctctgccatgcttctgtagtgctgagtctacatctccgtggccacacttgccatgctgtgtgcaagcttctgtgcgtctcactctttgcattcaccgtgcttatgccatcatctgccatggagtctaagcccaatattgctggattaatttattacccatttcatcctcccagccactctgtgcaaaaagatgtgttagccttaaatcagggacaaaggcatagacccaaggggtcaagtgacttgtccagtgtgacacaacatatttgttatacagccaggcactacttactataaagttttgactctttgacattacagttttccaaacaagtatgttttaggtacagtgttctttgacctagcttgctacaggtacccatgtacatgtacagaaatatttttcaagggatatgcaggcacaggatggttttaagggaatccacttccagaccctcaacttacatacacagtcacctaaaactgactagccttagaaggtgccaagccatggaagacatgaagctggttgggccgtcccatctcctctctcatgatggccattctcccaattcatacagaaaggcagactttgcacctgtcatcttcctgaggtgcactgctgcaagatggaaaacttccaggctatgtaacaaagagacaatgagaaatattgatggtattaagaagtcaatgactttaacgactgaaatgttgctactcaggggtttccacttcttagctttcacagaaatcaaaggagacctaatcaagatgttaataaatgatttaaaatatttttaacttacgagagaccatatctggactttgtccatgtaactcagaagacttcaaagagttaagatatatcatgacaaatctccttgcgttttcaagtatttatttttgtgaacaaagtttttccgggtttgcataaaaatcctccaagacaggaaaacaagcgatgctgggccatacctcactctagcaaaaagtgatagtcattcaggggtaaattaacaaactaaaaaaaaagccctatacatttcattaaaaaaaccatttctgtccgggtgcgatggctcacgcctgtaatcccagcactttgggagtctgaggcgggcagattgcttgagcccaggagttcaagtccagcctgggcaacatagtgagaccactatctctgaaaaaaaaaaagaaaagaaaagaaaaagaaatacacttccagataaaactttgctttttatatgtaataatttataaaaatggtaacatattgttttcatcatttgtgtactcataatagttgtgttaactcagttcagaaaaaaatcatagcaattagattcttatggcttaatactcttaaatgtagagtcaattatcattatttgtggtagttatgttctagaaagttaccttgatcattgaattactgacaaatgcaacactgctctgaggagaaatatagcgttaggatccacgaagactctggccagaacattttgccaaccaatcaatacataaccttgttttatgtgtatttttgtttgaagatagcttatttaatataaatttcttacaagtactcatatgcagtatttctttataataaacactgtgtttcagttacagcattatgtactcctatgactgtactagtttaattctcagtcataagtacacacatgcacacaatacacatacatatacagtactcacataacacggaatactgtgaacatgctttatactgtatagcacagtaataacaaatacataaagtcctgaaaaaagcattaagtgaagattaagcatttaaagttttatacacattaactaaagtcttactgtaatggagctgcaggatgtgtgatggtcagtgagtgcactgtggtttaccctatcaaccttagcttgccccatgaaaatcaaaagaggctggtggaactcaccctgcacaagaggaagatgtcagtaagagcagcacattgtgatctggcagagctaccttaggagtttgtcttttgcaacttgttgatggtgttggcaactgtctctcaaactggctagaaaaattggttcagccttgtctgcctggctttttgcctcaaatctttaagcatctcagaataagggataaatgcagtggaagtgaggtgcttaaatgtgaggccacgttcaagtacagggtcacattcttccatgtcattgaaaatgttttccaaggcagaattctattctgatattttggctgctgtgagaaggacaattcttggagtcttagggtgactttcatccctgactatgctcccatgttttgccatctcatccaggtttttgtttgtgggttctactgccttctctgacaaaatttcctccacatcttcttccttcatgtcattgaaaccttctccacttatttgccttgcaatatgcattgtttttttacattgttttttatattttctgaaacaccttcaaagccttgaaaagttttcacagagtctggccaaatgttttcccagcagttattgatagtagcctgcttgatgctgtcccacgctgtgccaacataatcaataatgctgcgtatagtgagtgatttccagtagtctgtcatggtggcttccttgttggcgtcaagagcctcacaagctttacaataaagttccctcgtgtagtgtgccttgaaagtttgtattatgccctgaggggctggacgagagatgtagtattgggggcatgaaaagaacttctttgttggggtgagcattttcaagttcatcgtgcaatgaactggggcattatccaaaattaataagacccagaaagcaaggtttttgccctagagatatcgttcaacttctggaatgaagcagtggtggaaccaatcccagaatatttcagataccagccatgcttttctgttctaccgccaatggactggcatgcagttcagatttttccctttaagggctcatgggttttgggctctgtacaccatcagaggtttgcacttaaagtcgcccttggcattggtgcacaatagcaaggttgaatgctttaaagtcaggggctcgtgtgaccatttacattacataggttcatttgccaacattcttataaaacaagcagtctcatcagcattgaaaacctgctctttaccataaccctttaacccttttcacgtataacacttagcagacattttaaaaattcttccgcagcctccttatggcagaacctgccttgcctgcaagtttaaaatttgatttcatgctgtaccgccttttgaaacgtgccagccagcctgcactggctgagaagggtttaatattttcctgaccttgggtaacatggctgtaaatttctttggctttcagcctcacaacaatactgctcactacactacaaaagtccatatatgactttttttattggttgtcgtctcatgaatccacaattttagctgcttttccatcttttccatagcttcatcacacactatagatgttactttagcactttctggagcagcctcatgtacagatgtgaatgcactgtattgttgattcattaacattgaactcatggccaacagcactataactcatgcccgaacaaagcttatctaacacatgtattttctctgttaagacacatcacagccttcttgcgcttagggacattagacagcatttcagcactacgtttgggggccatttgaaacagaaatcaccatcggaaagcatagaaatttgaaaaatgtgacactaagtagagtgagaagaggacatatgtttacagaatgagaactaaaaaaaaaaggcagagcatggccttattcaagcacagctgggaacgtgtacataaggtgatccaaatttttcactgttctgcttgtgtccatatatgactgagagtgcttcaagtattgatttttgggttacacataatttttagccaagtagctgagttcataaatacagactctttgaatgatgattgactgtatttgtagaggttacttgccaaaaaagagtgtgtttcaagcataaaaatagactatatgaggatacaactttttgggtgaagtggaatgaattaaaggagaaagaattaatgtctgacttgttcagaaactttttagatggagaaatgggtattatgtttctattacacttagattctattggatatattttttataaaggatgcaatggtttaatttaaaaatgtcatcagaatgtcagaaattacatcctttacaactatttaaaactatgaagaaaaaaattaggtattacctagatatgtgataatttttgaaaattattttaaagagcaaaacggattaggaagcagctttgcttttgccattccactgaaaaaatgtacagtttcgatggaaacatgtcagcacttgcttgaaggaatttttcaactatagaaagaaaaaagcttcatttcatcccttttggcattgctgaacacttggttttgatgtataattttaaaacacctgagcaccataaaatgaaaccacagtattcctgagtagcctggtgaaatgtcgtgattttctcctacagtacagaaggacaaaaatgcctttaatgtcctcaaatgctagagttctagatgacgcattagtttaaatgtcaacgcttaatgtcttcacatgtaatttggaacataagttttcttacagttaaaataatccttagagcaaaaaacaaaataaagtttttcgtatgcctcaggcttcttaaaattttctagtaattggtactgtttctggtttccttagtttcttgccgtgggtaaggtccaaacaccttacatgtgttgctggtggccctcacaattctaccttggactaaagcactagggagtctgtaggcgccttcctgcgctcctccactgcggtggatccacaatttcttctcagctgacttactggttttcatgttaactatttcggttaatcattcatgaagcgcgtggcttatatttgggaaaacattgcaccttaatcccaacatgcataatttatgttgcttaattattttaagtcattgcattagaatagtaactgcgctctccatgagcctaggctagaaagaagggaaaaaatcccaggttctctcccaacgatcaggggttactcaagccgcccgagttctctggggcccctctgggccaggctgcgtccacttgggagaggccgaggacctggcgccaagaggcggcggtgtctgcgctaggggccgagcgggtgcgctgtgtctgcggggccaggccaaggacctggagcagggaggaggccgagcgcggagccgggccttgtcggctgcgtccgcggggctagggtagagaccgaagactggacaggaggaggcggcggtggccgcgcgcggggccaaccggtgggctccctctaccggaccgaggcccagcactgggccagaggaggtggcagctcgccggcaaagcagggtgggctgcgtccgcgggggcgaacacccgacgctatccgaagacgtcccgcgcgggccggcgggggcgcggtctgaggacgtcacttccggcgccggggctcacttcctggtgcgggaaggggcagagattggtgcagccccggaggaagaaaaaagggtgaggagaagcagcggctgagcgggttggcatctggggcagcgggctcgctccaggccgtcgggggccgctcgccagcgtcgcccgctgtgttgggagcgcgggccgtgggcgtcgctcggccttgtccgcggcgtccccgctgccggccacggcgctcagcgcttgtgctctgtattgcaggtctaccccgagccccggagcgagagcgagtgcctgagcaacatccgcgagttcctgcgcggctgcggggcttccctgcggctggaggtgagcgcgggcggccacgggccgagggaggggccgggaagacggggttgggcccggggtgggtgcttcgctccagccggacctcctgcctcctccgcgcccggatccgaccctccccggctgctcgagagtccgggatgtgtggaacggggcgttgcgggtttgggtaatggccgggaggtggcggcgcgcgggccacccccagggcagggtggagtctgcgtgtggaaccccagacattgctctcgttccagtgaggaagagtggttctggtcgctggtggtgcaggtgacacacattttcaacaaccgtttatcaggggtgtgaaccgatttcttggcacctgcctcagcatgaactctgcttttagagattgtcatctaagggctggcatctaggtctgggtcaggccttagaatcctcagcaggtgatcaggcaaagtcgtgcagaaataaaatgggccagccctccgcctgcttctcccagccgcactcctttctctgctttttcttcctgagaccagaaattcggtggtttttccgtaccctcaacacttaatgtccagagaattcacattaaccagtatgtgacgtttataaaacatgctgtcggggaacatactgggcggggtctcgattccctgttgtaaaatgttgtgtcactttactaaacattgtcttttcagtctttcagtggcagtttctgggaatttaactctttcattttattttgctattgcgattcttcctacacttggggtagcactttaaatacagaaatctagctttgcttttcttgggatctgcttaagtggttgcagtcagtcctgtacttaagtcctgccgtttatgttgccactttgtcactcttaaccttagttttcttatctgtaaactgagatgggcaatatcaagctcccagataagagtacagtcggccctccgtatccaaggttacccacccgtgtattcagccaaccttggattggaaatactggaggagggggaaaccaattaaaaaaaaacaataaaaaacaacacagtataatgattatttacatatcatttataatgtactaggtagtgtatgaaacctagagatgatttaatgtttacgggactatgccattttatataaaagacttgagcatctgagggttttggtatccaccgggatcctggaaccaattccctgctgataaaaagggacaactgtatatgaaagcatctttgtagaacctgttatgtaggataacccaacagaggtttcccttcccgaagaatattttgctataggtttctcggaaaacctagaacatcaaatctgtgagggcaggttacatggaaagtttatttaattgaattagacatgtaggaattcatagattaaagtattactggcgttgtttatgattgtaaacacaaagaaatttattgttggtagtatttcatgttggcaaggaaattattacacgtaagtgaaagtgctaggggagattccaagaaacttagggccttttcaaaggggaaaaagacagtgtttcagtagtctttccctgataccctttgtcgtatcagctttgtcatttgtaatccagctgccttattggctgtgataatatgccttgctagtggcaggttttactttttcttcacctttgtgagggattttattatattatcctcttgaaactactgagttttgtttacgttaacatacttttgaaactcaattggcacattaagattatctgactttagtgtaaaactttttaaaaaagttttgttttaaagtaaattgaggctgggtgtggtggctcacgcctgtaatcccagcactttgggaggccgaggcgggtggatcacatgaggtcgggagttcgagaccagcctggccaacatggtgaaaccctgtctatacttaaacaaacccaaaaacaaaaattagcccggcgtggtggcgtgcacctgtagttccagttactcaggtggctgagacaggagaatcccttgaaccccggaggcagaggttgcagtgagctgagattgccactgcactccagcctgggtgacagagcaagactccctcaaaaaaaaaaaaaaaaaaaaaagtaaattgaatgttaaaaacttaccgtttttagttttccaaaggttgctgacatttcatacagtaactattgtttttataattaagagtttatttgaaggttttctggaagagagttttcactaacatattccaagcatctacaatagtgcttggcacataataggctttcaataaatatttgttactaatagaatgaacttgaggttgtaagtgatagcaagtgagtttcattttaaagtaaaaaattagttttgacttattttgtgctatttttaaagagtaaatatctcttccagtaaatttaagcaagaggcaaatgttagcattcttcaagcttagtgtgagtcacacttgtaattacctaggagataataaaaatgaaaatatgaaaacagcacatgaaaaacctgataaattgttcagtcattgtgttttttgggaagttaccctgagaagtcattttgtatgctatgcatccagctctggcttccagccttgtaaggtgatgtgaagggacagggctgggccctgaaggacttggtcatctcccatgcgggccacagtgcagcaatttcccagtgtttaagaattgcttagggagtcaggagggaagggccttgcacttgtgaaatatgttgtgggatttacacatttcattttcacaaaattctgaaaggtgggaaattgataagaaatgttttgaaactacagacacaaaacttaaaactaatagcttaaattctagattagcttttgttctatagttgtaaatgtcaaggtgcttttcttccaggggttagtttagactgaattgtgtttgtaacagattgtttttggtgtatatattcttatttactgtcagtttaagctctgctaagatttgttaaagggaaaaaggaagtaaacttggttaatatgtcagctgttttggtgcatgccctccttaattacctgtagaaaatcagatattatcccccaattgttttgattatgaaaatatttttataaattggttttaaaggaatattgtgtgagtcgcatttattggtaaactttgagaagcactgggttttaagctggaaaactttgaaatttggaaaattaaaaaaatttaattactgttggaaagcagtgcaacttggatgacttcattttcttataacttttttacttggcatgcttaaattttttttttttttccagttagggcaaaaaacccctaggcacacaatttctatttgtatctcaaaagcaaccaaaataataattattaataagaataatgatgatgttggctgggtgcagtggctcatgcctgtaatcctagcgctttgggaggctgaggcgggtagatcaccttaggtcaggagtttgagaccagcatgaccaacatggtgaaaccccatctctactaatcacgccactgccctccagcctggacaacagagcaaaactccgtctcaaaaaaagaaaaaaaaaatgatgatgatgatgatgtttgtagaatttcacttgaggataagtaacttactgaggcaaaccaagcaagtgataggacatttctttgcattttcttaggtaaacagctacagagaaattcagagtgatttctgtttccagtattttgctatgttactgtggaattctgattcaagtgttgtagctactgtaggatgtgtatgtgtgcatgtgtgtgtgtgcacatgcttgttcactgaaaaggtcacaatgaattagcttccaagatgttcccaccctatgcaacattgtctgattaggcatctgacaactagggaagcaggtgaaatgtaactggcaaaagcagattttatgttcctaggagaaagcttgtttggttaaagccatcacgcctgtaacatgtttaccagttttttatttcaagagctgaaagttaaggatataagattccagttaattgatacattattaagctcacattaataacgtggtttcaggaatattagcaacaaaattattataataaagctatggattttaacttagttctgtttgaaagaaagatgtctactgttcttgatacttagctatattcatacataatagaaaagggtaatcttgatggatagtttgatattaatgaggcttttttgcttaagaattgactgtgggctcacatacagtgttaccatcactacttgaaaggaaaacaaaacatttcagatgaaactgggtgagcctgttctcatagttgccaagagggaataaagccaatttgtcaagtgtaaggaaaccacagctctttcttgtcatagaccatttctggaatagttatgtttgatatgatagggatggtaaccctaatatattaataattgatctttccagctccttggcactgcaactaatactaaaattatctgcaggtttcacagttgctgttcatttatttaactgtttttctggaaaagtggaaagcatccaaaggcccaggtggttcagaacagaaatctgctcttttctcatcctcacccttggaagtttttggttggcttttggtctctcagatcaacagagcatgaaatgtagaccagctagtcacataaagcttgcctcatatccagtttcttttctttaattcttatattttgtttttaaattgacaaatagttgcatgtatttatggagtaacatcattatgttatggtatatgaatgcattgtggaatgattaagtcgggaatgaacatatccgttacctcacatacttcttatttctttgtggtaagaacatttaaaatctaatcttttagcaattttgaaatatactttaaattattgttaactgtagtcacctgctgtacaatagatcactaaaatttattcctcccgtccgactgaaattttgtaccctttgactaacatctcccctttccctgtctagctcctgtttcctccttcccagcctcctcagcatctggtaaccaccattctcttgtctgcttctgtgagttcagcttttttacactttacatataggtgagatcgtgcagtatttgtctttttgtgccctgctttctcttagcacaatgttctccaggttcattcattgttgttgcaaataacaggatttcctttttttaaaagtctgactagtattctattgtgtatatatcccacattttctttattctctcatctttcagtggacacttagattgattttatatcttggctgttgtgaatagtgctgccatgaaaatgggagtgcagacatctcttcaacatactgattttagtttctttggctatatacccagtagtgggattgctggatcatatgataattctgtttttagattttggaggaacctccatactgtttcccagaatggcttcaggaatttacattcccaccaacaatgtgcaaggcttatcttttctccacatccttgccaacacctgtcgcctttcatctttttgataatagccattctacagttgtgagatgctctcatgatttgaatgtgcatttctctgatcattagtgatgttgaacattttctaatctgttggccatttgtatgtctttggagaaatgtctgtttgggtcctttgctcatcattttttaatcaggtttttttttgttactgagtttttaaatatattttggatattagcttcttatcagatgtatggtttgcaaatactttctttccgttctgtgagttgtctcttaattctgttttgctgtgcataatcttttcagtttgatgaaatcccatttatcttatttttgcctctgttttcggtgcttttggggtcatatccaagaactcattgtccagaccaatgtcttggagctttccatggtgcttatttctggtagtttcatagtctcaggtcttacatttaagtctttagtccattttgagttcatttttgtatgtgttgtgagacaaggttccaatttaatttttctgcatgtggatatccaattttcccagcaccatatgttgaagactgtccttttcccattgggtgttcttggcacctttgtcaaaggtctattgactgtatcatgtgagtttaattctcagctctctattctgctctgttggtctgtgtgtctgcttttatgctagtgccatgctgttttggctgctatagcttggtaatacactttgaaatcaggtagtgtgatgcctccagctttgttctttttactcaagaatgctttagttattggggttttttttttttgtgattccatgtgaatttcaggattgtttttctatatctgtgaagaataccattgtaaatttggtagacattgcattgaatctgtggatcaccttggatgttttaacagtacaggttaagcatgctgactgatacggtttgcctgtgtccacacccagatctcatcttgaattgtaatctgcataatccccacgtctagggagagacctagggagagacccaggagattatggggattacaattcaagatgagatttggagttagagatcagcctgggctacgtggcaaaacctcatttctacaaagaaaaaaaaaatctattggacagtgctggatccagtagaatcctaggagatgggatcatgggggtgatttcccccatgctgttcttgtgataacgagggagttctcaggagatctgatggttttataaggggctcctccccctttgctcctcacccttctgtctcctgctgccctgtgaagaggtgcttttcgccatgattgtaagtttcctgtggcctcaccagccatgtggaactgtgagtcatttaaacctcttttctttataaattacccagtcttgggtatgtctttgtaacagtgtgaacgtggactaatgtacatgccaaacctgaaaatccaaaatgctccaaaatctgaaattctttgagtaccaatgtgacactcaaaggaaatgctcattggagtgttttggattttcaggatttgagatgctcaactgataactataatgaaaatatccctaaatctgaaatacaaaacacttctgatgtcaacttgtgtcacttctgagaatgtgtacatgatgctgagtagcacagagcatgcttgtggcatgggtgctaaatggttagcttggcacactcacagctagtaattgtgactttgatcttcagctgatttctccttttttgattcagggttattgctcactcctggtagctgcccatgattatcaggtatttgctttgcgggggacggtatagggggagggaatgtagtgcctgaccccaacccctttcctgggttgctgtcctgtgttgccactcgccagctgtgccatcaggaaaatgggtgtcacacgtgcttgccctttgtgtctgtcgtgaggattacataaattcatgcaaaactcttagaacagtgcctggtaagttggaggtgccaaagagacaatagctgttattatcatttgcattattattctttcgtgtagttggagccatatggtatattttaaatctttacccagggttccatattcattttttaaactgcagtaaatagagctatgtaagaagaaaatgaaaagctgtataatgctaccgtttagagataccagtgttaaaattagtatttcttttttggtaattttttttttaaccattgcaaatatgtaaatatatttttaaaatatccatgacatcatagatacatgtaatgttttataacatgctttaatttgatccagtgtgagtcttttcccatgttaaataattattttactactgattttaatggctgcctcttagttcctggtaataatccccatttttggatacagaggtggattctaagtttccacggttgtgaacagtggactgtgcaatggacatttctgtaccacacccttaatccttgattttctttgtaggacaaattccctgatagggcactgcaaggccaaaggtgggggctttcaaaggctttgaacacctgctaccatacagcttccagagaacttttgccagtagcagtacatgagagtactccttcctgtcctatggatgtcctgtggacagctgtcttgaatcttttatatattttctttcccttaggaagatggaaaacttgttatggataaacattttggcttttctatcttatatcttccacagtgctttatatttctggggagattgcaaactaaaataaatgtaagtcagtcaacatttcctgcattggacttttgaaagaggatgtgaaagaaaagctgctagaattggaaataaaagttgaaaaccctagaaatttgcagtgttatcagctgttgcacaagtaaccttgcatggcactgggtgggacattcttgggccactctgtacaagctggagttctggctgtaaatgcatcttgagacggtctgcaaaggtgagagggcaggttttcattttctcactttacagtcgagagacttcagaaggagttcaggtgggcagtccagcatcgtaaggagctgggataatttagtgagtgagaggttttggaaaagaaattgccttacctgtttctgaaacactcatcttccctgtgtatttctgaaggacaagttcttttattatactgctctgcctaatgctcagttctcttttagattttttttagccaagattgtgattaggatttcacccacaagaatagttaaaaatattaacacttttgaaagaattaaaatgtgggaaccacttactgaaactcaaaacttgttgatgcaggcttaataattaattgcaataaaaacagaagtaaatctatagtctgggatgggacgcccagccaagtgttgtctttgttctagattcagacagatgaggaggtaaactgtttattgaaacttggcattgaaggtttataagcaccaaagatatgtttgaggcattctttttagctgggcacccttctatactgttgataccaagcgtgaaacggttggtcacaacatagtgtttattgactgattcattgaataagctgttgaagcttattcctgtgtaggactttagttaaggaagttaagtaaaaatattgtttgggagaagaaatgagtaactattccctgaacattttgtaggtagtttaaagaaagacagtttccattcagatactgtaattgtgttttaatttcacctggcaagaagtgtcaagagatggccctctgtcttgtaccttagtgccttgctgtactgtcttgctgggtgaacatgaagtgttctggttatccaggctgcttttctagtgtagacagctagacttcccccttcgtttcagatctttggaatgtcttctttgtctagatcagcactgtgcagtaggaatatactgggagccacagatgcgattttaagttttttagtaactactttaaaaaagtgaagcaaagttaattttagttttcatttttaaatatttatttatttatttatttatttttgagacagagtctcactctattacccaggctggagtacagtggcgtgatcatggttcactgcagcccccaccccaccaagtaccttagactacaggcatgcaccactatgcctggctaatttttgtatttttttgtagagatgaggttttgccatgttgcccaggctgatctctaactcctgggctcaagcagtcttcccacctcagcctcccagagtgctgggattataggcatgagccgctgtacctggcctaaagttaattttaataatgcattctatttaacccagtgtatccataaaattatttcaacatgtaattgatacatattaatgaggtattttagtttcttcacattaagtctataaaatcgtgttggaatttgttatggccacagcacatctcggtttgtattagccacatttcagttgctcagcagcccatctgtgagtggcccccgtattgcgtgttgcgtttggattatttaagaggctggggaaatacggtgatctttgaaatgaaatgggacccaggtttgttgagaacaaattgtgtgtctaggcattttccttgtactgttttgttgaaacctcacgatgccctgcagagaagatggcagttccccacttagcagatcaggaggctgagacttgaagtggttcagaagtcacaggtcccggctcagccagtgaagagatgcggaatttgaactgagatgcatccactccactggctgggttcttcatacaagcatgctgctgcctagtgtggcattaggtgaggtgtttgacaacatcaaggcaatactcttaggctgactcctggcaaggcccatgggcaagttctcaggagaacttacctggtgacagggcctgcctcgtgggtgtgcgactagtgttgccacacagggccctgtgcttggtttcatgctctgctgttgccatcagaaactcttaagaattttttgataaggagctttgcatttccaattcgtgctggaccctgcaattgagtacttggtctagcctgctggtattgttcttagaggtctgtgatcaataacaggattaaacagcattttctgagtgcctattatggcctaggccccattatgaagtgtgtgttaacccggtttgaaagtagctgtctcaagttgttaccaccattttcctcacacgattgcatccgtgaccccaggcaagcggaatcgggataagaataaccctcaacaatccctgctactaaagaattgcttaaagtacttcctcctgataggaagttaagataatttgttgtctctcatgcattaaaaattgccacagcttccaaggcagccaccattttacctgtcagtgataaggacccgtgataatattggctatgggttttgtttttctaaaggatccttttgggaaagccatcctctccagtgttgggatgataaaaggatgggaagtcggagtcagcttgaacttaccaatcagagaacatgtaggggttgagtggaggggaagatcctctccaaggaattggagagaactttctactcacattacgtctaactagccagaggatgggcactgggactgtatacttgtaaggttccttcaaagcctgaattgtgtgagtcagtgatgcagctactttctagatgagctaccagtttaataataggacttagccccagattcctctccctttttggcccttgacatgggacacagatcccttagtagatgttcatgcctggcccatgtgggcagccgggtaagtctttccagtgcagctggtcagttggtctcacccaagagttgcatcacttgtatctccgctggttgttcagcaagtactggcagcacttaacacgtgcagtaaagcagtgaggctgttttgccaccgtgacaatgcagttgagttttgcctaacgtgaaaatactaagtttctgtgtattctctgctacccacaaccagaaggcttggaggaacaagcgttctggtttgtttatctgcatcccttccccttgataaagcaactgtgaatttggtcttcattagctgtagtctgttgaaccgactcagtatagccagggtagaggcagaaggaagtgtcctgcacagcggtacagctgagggcttcgtgctcctgagttcgtggcacaagagagggattcagtggtcagctctgcatagtctctcattttctagcaaatagaaaccagagtggatggcctcatatgtgtaagttctcatgagactcaaatggaaattagttgtccctgaggttcttcatgcttggctgattgaactagatggtttgagagggatattttgtagattaaagggtgagattagggctggggagaacaatggtggtagagtggccttaaagaccagcctccaggaaagcctctggcagttggagtccccactccctgccattaatcatctgtcacatctggttcatcttccttttactaaccccagaatcttggcttttctctttgcccaccaccattagcccaggctgtccacatccctcacctggatcactgcagcagctcctggccagtctatccttgcttttctccagactgtttttttctgaaacgcaaggctgattttggtcattttcctcctgactctgattttacctaatgtcttagaatgaaacccatgacccttggaagagatggggaataataggaagtgaggccagggagtcgtggggagcgagatcaggtggtcctgtaggtcctgtcttttcctccaagtgatatggagcctctgagggtgtttgggcagaggggagaagggatgtgatgtaagttttaacaggatcattttggctgtgttttgagtatagactgaaagactcaagggcaaaagcacggaaaccaaagaggacaggatggcaccaatccgggtgacctcccaggtgatggtggctggaaccacagtcccgtcagcataggtagcaggagagactgaattctagtttttatcaagagggtagagatgagatgatttacagatggactagatggggtatgcaggagaggagtcaaggaggaccaagggtttggcctgagcagttagaagaagttgtctttgggatggggaagtctggcagggccagatgtgggcactcagcttcagacatgctccatcaggatatctgtgagatgcctcagtgaagatcaggtctggacttcagggatgcggcctgggctgggatatcagcttcagacttcggcacaagcaggttctgattgtgtagagtgatgttcctgttagtctgtatcatgtggaagagtgtcttaaacacatattgtgggcaggtgctgtggggaggaggacatccatgcctcaaagagaatgaaggaatacctggtgaagggctgggggaggaagtgaggagatgttagtcccagaacattttaggcccgctagacgtgcgtactgacgttgctcatttcctggccaagctgtaaccacctgagtaaacggttggtttgttcttgggtcaggtgtatccacagcagtcattcagtgcgagggtacttaggtcctctttatcgtcagaaaatcacagagaagcaccatgcaaaaataggtttgtggtcatatagcgtgaaagttggcaaagatatgatctctgggctatttgtacgtgagcttagaagaaactgaggactcgtcatcaagttgtattttatatttcttttatccaataagacttgtacatagcttaaaagataaacaatacttagagcctcaaaaggaaacacagtcctcccgcactctccttatcccagaaacacactctcagctggtgtttcttcttggtctttacttcctcctttccatattgtatcctggcactgttgtttcttatcagttttagttaataactgtctaagatgagggtgtagctctttgtatcactcctatcccccagttcaggagaatcattctttgccctgcatgtgtgacatgatatcccttggtgcaatgttagttgttttagccaatgttttttcttagttataaatgacatgtgtgcattctgagcaaacagagtgttacaggcacacgtaaagggaaatgtccactcttctctctccctcctaaataccctaaccctgcttcctgcaggagccactgttgaatgctgaggcacacacggactctttttcaggaactgaggccatgctaggaatgctcttgtgcagtttgcctatttccactgagaatgtagtgcctttcctgggggcaccactgtggtgggcagcacaccagagcgtgacagcgacataaggcgctttccggaggacagaacaccagagccaccccttcctcacaggacacttgaacagtaaaactgaaccttcttgctgtgacagtgtggagttatggcaggagagcagggtgactgtccagcctcgataatgttccctccttggcagagtgaggtccttctgctcagtttgcctcttgaggagttgggtaccaggagcctgaggagagggtcctggcttacctaggtttttcctctctcgtccaggtcatagggagactgtcagggctgagatggccagggtagctggtggaaggtgctagccctcccctgtgcctgcttctctgcctctgccgctctcccgcttggtctcatctactctgtctctgcggtgtgcgacagctgtgtgaggccccactgtgcgacagctgtgtgaggcaggggtgtgggtcccctccaggcctgcccagccacctagcagctgttgccattccaggctcagagtccccgcctcctgcagatttcttcaagcttcatgctgccttgaggataaacacgagtggagagttgacacttttccttccatgtctttatgttctcagaatgttccaagaacttggaatattaacagggaaataccagggtttctgcatagaggtggataaaataggcaagaattgttcaggttcagtcttgaaaggtaatgattgaaaagggatatccttatagattatacagttttgaaggctatgaaagggtttcagtaaattgtccattcccacccccagaaaaaaatcacagaatcacaaaacttgggtttagttttttgaagcttgagagatgatttttgaaactaaacaaaggaaatattaaagatgtaaaaatggcatagttttgtggttttgatatgttgactccaagaaagtgatgctgtgttgagagaataggttccttgatgactgatcgccagtgaagtgtttatggaagccaggagtgttggatgacatgaggagggtaggtgacattgcttctataatatgttctttgatgcctgtgccagagaggatgcagacagcaactcagtattcacaatttgaagcagaccttatcatttctcttttaatcagtagttctgaactttttggtgttcagtaattcgggaagttggcttaggtaacaaataatgacaatagtagcggttaagtttggggatgcttactgtggggttgtgccaggcagaggcaaatccgtttaacatgtactagtttacttaatccttaaaaaagtcacttggcattgttgggaagagaagaaagtcgtgtgttaggagagaattgcagaggtcgttaatgccactgtattagtctgttctcacatggctataaatacctgagactgggtaatttataaagaaaagaggtttaatgggctcatggttccacagggtgtacaggaagcatgatgttgtcatctgccctgtttctggagaggcctcaggaaacttacaatcgtggtggaaggcaaaggggaagcaggctcgtcttaactggccggagcaggagcaagggagtggggaggtgccacacaccttgaaacaaccatatctcaccagcacacactcatcatcacgagaacagcaccaaggggaaatctgcccctcacgatccagtcacctcccaccaggccccacctccaacattggggattatacttcgacatgagaaccaagccacatcagccagaggcttcttcctggtccttgcgttggtaaccaggaccttgcttgtgagacattattggaagattttttggtggaattatatttttaactttggagtcattcttactgtaaaatatatttatgctgttacagtaatgaacatttaatgatcacctctgtttgctagacaccgttctagttgctggaggtggcttggtgagtaagggaggaggggccctgctcttagggagtgtaattctagttggggagacacttaagcaaaggaatgagcgtgtgaacaaataaaactgtcatgcgcaacaactgcagaatatcagggggtgaggtgagagagcacctgagtgctgacttagattgggtgatcagagcaggcccctctgcagaggtgacgcttttagagattgggtgatcagagaaggcccctctgcagaggtgacgcttttaggatttgctctcacagccaacgtgatacaagctagccactcttctttttttgtagacagagtcttgctctgttctccctgctggagtgcagtggtgtgatttcagcccactgtaacctctgcctcctgggatcaagcagtactcatgcctcaacctctcgagtagctgagattacaggcatgtaccaccatgcctggctaatttttgtatttttaatagagacgaggtcttgccatgttggccaggctggtcttgaactcctggccttaagtgatccacccgccttggcctcccaaagtgctgggattataggcgtgagccaccgtgcctggcgcagttagtcaatcttctgaggaagaccaaacgtggacgtcagaattgctcttctgttgaccattttcttccttcttactggaatttcttcttattttatctcttatgtagggaagctgggtgagaattgatcatgttactggcgttatcaacggccttgcacaaggctgctcactcaagccttcctgcctttactgaatgcagtgctaagtggccggggaaagtgctgtgtgttacccttaggccagattcactttctggaaggttctagaaggttccttgttgggagatgatggtggctaccccaagggtctggctccgctctgggaggacttgggagaactctgatgacggatggtgcccaggcccctggaagcagagcctgctgctgtgtgtttgaggtaaaaatgggagacctgcttgttgggtacttgggacaagaagtttgatttgggaatttaatttatggcagataacagataatcagtctcagtcttttctgttgcagatataaaaagcagcagtggttatctttaatttttaaaagcattttatcctttttctgttgtttgtgtccataagaaaaatgcatgcataccaaatatccatcataaaatagggaactaagaattttgtgtgcactggattttctttttttaaaattattgtttgaaatctgttaaacaagggcttgaactcaaatgaaagaactggcttttactttaagcttaagctcaccaatgcactcttagagttacttttgttcagggctctgtataaccaaatggaattagcctgaggaaggtacggttttttccacagcattttgtttgtgatgaggaggctaagatagtttaaactgtgtgagctggcactgttgtaaccataaagatttgaggtatttgggttttggttgtagccaagcctagcttgggagctgcgtgtgcaggagtacaggtgtctgaacagagtgtggctgctcagtgctggatgaggctctttggtgacagtctttgaaagcaaattaaaaaaaataaagtgaaaagcattaaaaataatttcactttgtttatagagttacactttaatatcgctccaggttacatgcttgaatctacaagtcctttcccttcatgctttgatcttttagttgaggaagttggctcattatgtatgtgttcaatttgcatgagcaatttttatgtgatggagtaaacatcagtgtgatctttgaagttagcttggtgaatgcttttctaattggggaaagctgttaaagtttgatttcaagagaaaaaggaatgagcctctaaaaacaaagctcttctgtggctgccatggtctgaatgtttgtgtctcctccccaaattcccatgttgaaatcctaacccccaaggtgacagtattaggaggtggggcctttggaggtgactaggctcatgaatggggttagtgctcatataaaagaggcctcagagagagacctctgcccccgtgccatgtgagtttgcagtgagttcatctgtgaagaaacaggccctcaccaaatactgaatcagtccatgccttgatcttggacttcccagttccagaactgtgagaatacatttctgtggcttatgagccgcccaggttatggtattttcttacagcagcctgaacggcccaaggcagtggcagagagcatcagtacacggtaccctgagaaaacacgttcgtaatcttgacgaggggctggtactctaaatacgtaagtagctcttacaagccagtaagggagattgtaacaaaatgaattcagttctttaaatggaagcactcactgatcagtgctctaggggcctttagagcatagtctctttggaaatgtggtcctggaagtatatattctcttaatatccctaaacgaaataaattcagttctataaatggaagcactcactgaatcagtgctctaggggcttttagagcatcgtctctgtggaaatgtggtcctggaagtatatattctcttaatatccctgaagtcatggcattctccagttccaagtcacgtggtggtgccgctctctaaggctgcaggtaagttggtgatcacctcatcctgtgacagtgtcacatcctctctgactgcttctgcccttcacactttttgggaaccatttcctcaaagaaactcaagccataataaaacttggttttaaaaaaccagcctcttttcttgcagtaaatttgaactgtcatttgcacacttagtaaaaacaccctacagactgggttaatagcagagagaggggtcctggtgctgtaaaccaaggcttggcagttttctgtaaaaagctagacagtaactatcttgtgggggctggggtggggcagacctctgtcacaattattctgccgttgttgtgcgacagcagccagagttggcatgtacaaactaggcatagctgttttctagtcagacattactgatgctgcctttttctcccgattatagtagctatgtgtgtagacaggttgagcatctcaaatatgaaaatccaaaatctgaaacgctcctggtcccaagcatttcagatgagggatgctcaacctgtgtatagaaataaaaactgcagaaaagtatatgaaaaaaccattccacttgtatcattaataagttacctttattaacgtgttgctgtatttccttccagcattttttaatgccatttgctcactctcaacccacaccttttttcttttcacagagttggtgtcagagtgcacacagatcctgccagttacctcccccagagcatgttgcgtttctgggcagaaacagcctagccatggttggggtggaatgcatactgcctgggagggctggccggtctcagagcctggcagcctggaggggtggtgtgcttggctagcttgtcttgatattttgcccccttttaaagtcttccagtcacttttatcttcacagagtagcagggtcatactggggagtcagaaccaggaaaattaccaggagtttgaccaattccaggcctctgtgtctgtcttgggaggatgctccaccttcgtacctactttgtggcatcagttggagatgctctgtagcgtaagctcagccccaggatgtggagggacagggcagagtgctcactggggacacagtgtattcactgattggaagcctgtgaaatttcatccacggattgctttcccaggaggttggcaatttggaaagcacattttggatgtgctgttagggtcagctttaagtcggcttgtgtttcatggctgccaagtgagcatggagaccactgcctctccccacattgaatggagatgtctcgtgtttgaggatgtcatttgctacctgcagcacctggtcttggagggttgggaggtcagggggtgggtggggtgtgcccgtgagacaggtgcgggtgtctgtagagggatgtgggtgtcattcagttttatcaggctgcttaactgcttgtggtggtgtttgcattgcactgactgggtcaacttgtgtagtgattactatgataaaaaatttacttaattttcaagacaaatttgtgatctccgattggtattaataattcataaggtagatttccctcctttgtctggcacccagccctccccctgtactattcggataagattaatgaagcgcctgaggtaaacaaggtagaatccgtgttagcttatttcagtgtaaaaggtttgttttgaaaaaaggaatgatatttgctgctatttaaaatctaggtaatattttatagagactgctgagatattttgggattgaggataattaaaattggttactcttatttctcagagcttatactctaagatcatttactgatttttacatttaaccacactgttaaaatgtccagacggcagtgcctgtggaatccctctgttggcacctgttgtgtattggcatcttcatgtcttccgaattcttcaaggcttttttctccccctttggtccttgacagatttctgcccacccagcaaggaagaggccatcttgctgtcttctgtcatctccttgtctgtctccctttcttgctcttccttcacctttctcgcagtcttgctcttgcattttatgacttcctggtcattacaaggagctgggaaatgccatgcattatctgggcatacgtggcttagttcactaagttttcctgtagtgctattttgagttcattgtcttgccttagttaaagtagacatctggagggccactttgctccagctttgtgaaaacacaccttctgggtttgccctgctctgtgtccacaccccgtgcctcagctgtgctagcggtctggtccatctgtacgctgggggtcgtaagcagaaaggagaggaaacaccgggaggtccttgcagctcctaggaagcagtttgctgataactcagctaggcgtgcgaggactagaagttgctgacagtcctcgggttggttttgtgcagcacatgtgcttgtgcgtgtcgggtgaaacctaaaagctccatctgttgcctgtgtctcgggatcttgctgtctcctcctcaaccgtcctcctgtgttgggagcatacagcagtgtgaatttgactcttccctgttttaagttgaattaaattagattgtagcctttccacaaggtagatctgccttctgggagtgggacgagcttctctaaattgaatatttgtttgtggtaagctgcttatttcttttcgtaatagttcactgaaatagccactaaggagttgatgggataattcagcagctgtgcactgagggcccctgtgggtcccacactgtcttagaagctctagagtcaaggcccacacttgtatggttcagaatgtacagaggacagacatgttcacaacagaattcctggcgctgatggaagccatgaagaagacagagtgaggggagagtgagggaatgggagagggtgagagagcagggctgccctgtgagactcaaagcctgggagcacctctctgggggccctctcagtcagggtgttgccatgtgagtgtggggaagggcacccaggcagaagagtgcctgggcaaaggctctgagatggaattgagcctgcctgctgcaggctggagcctgcagtggggtgagtgagcttttgggggaaggactggaggccccaggggcgggcctcctaagctgctggctcctcactgggcgtcctctgctccaggcgctttgaaaggtattgccttggacgtcctcatagcagccctgggaggtgggactgcccacttctctttgtggataaggagactgaggcacaggggttgagtctttctgaatgtgttagtctgttctcacactgctatagagaactgtctgagactgggtaatttataaaggagaaaggtttaatttactcacagttaacacagggctggggaggtcccaggaaacttaacagttgtggcaaaaggggaagcaaacacgtccttctttacatggcggcaggaaggagaaatgcagagcgaagggcagggaaaagccccttattaaaccatcagatcttgtgagaactcactgtcacgagaagagcatggaggtaactgccccatgattcaattacctcccactgggccctcccatgacacgcagggtttctggaagtagaagtcaagataaagagttggttggggacacagccaaaccctatcagccacacaggtagtctgtcaccagcaccatgctctgcctaggactctgagcccccttctgtaggttgatggaagtgtggattttagtctaatgatggccagaagctgctggaggattttaagcctgatcttttacccatagaaaatgcgaccattgctgctatgtggagaatgactgtaggtgagcaagatactttttgatgtcaaattgcagtgtttgaggtgtgtaaggcagtttctgtttcctgagaattgtgcgtgatgtgcctctccccctctggcatctggctgccatttgtgtggtggatctggttagatggccggcccctggaacttgtgttttgcttcctccccagtttcttcctaggtcccactctctcctttctcttcactgtgtgctgtgccctgtggggtgacccacgtagcccctgcctgccacctgtcactgcctaaacaccctccctgggaagtttcccatcaggtagggtcatgtccaggagtgtaaccatgatgagtgggacccccgcgtgcggacgtttgtcctcctcttgtcccccatctgctcttgagctttccatttcaggcgtgtcacatgatctgagatgtccttaggtagtatttgctgactggcttatttatttatttatttttttagatggagttcactcttgtcacccaggctggagtgcaatggtgcgattttggctcactgcaacctctgcctcccggattcaagcgattctcctgcctcagcctccccagtagctgggactacaggcgtgtaccaccacgccccactaatttttgtatttttaatagagacggggcttcaccatgttggccaggctgttcttgaactcctgaccacaggtgatccacccgccttggcctcccagagtgctgggattacaggcgtgagccaccgcgcccggctgactgacttattttataaataagtggtgtgtattctgtgctaggcgtggttccagtgacttcaccgaattaactcatttaaacctgtaccagtgctgaggaagcaggcatcgctttgcgggagaaacggaggtattgagaggcctgggaactgggccagggccacacagctggtgcattgtggccggggctgaggctgggcctgttgtgatgcacttcctgtctctgtgcctgcgtgcatattgaagaaacacaaatgatgttgtgttatcgtccttttgtccctctactctcaaaggagtccacattcttcctgttgcaaactggtcaaggcccattggtcattctgggagctgagctcaggcggggtgtgagatgtgctatcagtggagtcagtgtgttctgaatgcggctggaatctaaggagcaggtctgtgctcactgaggaggggagggtcacaccccctgagaatgtgttctcagtatccctgagccgtgttggtgagtttgcaggttctcacacggtcctgctggcagtcccattaggcactgctgccccggtgccacttgtctggactagctcagctgatgacgtttgtccttgggactgtcactgggaaggcctctcactagcctcagacagagtggcccagactgggtaaaaggcatgtctttctgggtatgaaatatgtgctatcttgaatatattagctcacgtgcatttttcaacatgctattgaacaaggatgtttgatgttggccagatggtggggaaaaaagtgttaagaagggtatatgttgttattttctaaaagtccttgtgaaaaatgaagcagacagtcatgaccagtgagtgggaacagtgaagcttgaactcgcacgcagtgtggtcccgagaaccctggaatagctcacctcctcttctccatgcgcagggaattctgtgttcactcagtgcctgtcctttgacctccttcctctctcctaaacttcctgtttctcagcttgactgaggctagtaaagcagggttctttgatcatcttttagtcattgcttttctattttcatttaaaaataaagcaagaaaatgccagctgatcttgtagggatgggaagtcctcctctctctttttcttgacaggcgcttgccctgaagcactctgagttcctgaggagttcccttatgtcctgggaaccagcgagagaacaggttcccagtgagtaattacaaaaacacaaaaccctgagttcttttcagaccatatttagatgtgcagtctacatttaatgtgtttttaaaaatagcattcttatccaaaatatgtgtttttggccagatttttgtcagtttaccttgtatgttttctgtgatagtttagagaaagggagtggtcttcagttcagaggtgatacagtattcagatggaatgttcactcttgccctttagggaaggtttcaaggttagattgggtggtatccacttgggattctgagtatgcgagtgtttttaaaaaatgctgaccccagcatctctctggagagtttctgactgagttagcttggtacttagcgctgtccagctgggcatggtgaggagtgccagccatctgtcagggaggcagctgccggtacccacccagcttggaaaaggcagggaggaagccacacttttctctaactgtctcgttgtagaatgggccagcccagctatgctgagagtttgaggggaagattagtgtggcagtgactgagatctttaagaaatgtcgggccggtcagaaggattgttcatgtgggtgtttatttgcacgaaagccccacagatgatgagtgaaatgctttattttcctcctaggctacggatggtgagcggatgctagagagagccacttaatgtgccgtcccccccctttttttttgttttgaaaactttaaaagtaacaaaggttgggagactagagttcggtgaacatccgtgtgcccttctcacaggtcaccagcattctgagttcaaatgcctgttctttttttttttttttgagacagaatcttgctttgtcacctaggttggagtgcagtagtgcaacctcaactcactgcagcctctgcctcccgggttcaagcgattctcgtgcctcagccagcctagtagctgggattacaggcacgtgccatcactcccagctacttttttttgtgtgtttttagtagagacagggtttcgctatgttgaccaggctggtcttgaactcctgacctcaggtgatcctcccgccttggccacccgaagtgctgggattacaggaatgagccactgcacccggcctcaaacgcctgtttctgttttattttgccaactgtgtaagtcatgttgtagatcccatgatccttacctctgaatacttcagcatgtgtatcttaaaaataagaacattctcctacataaccatggtgtcattatcacacccagaaatttaacgttgtgttgccgtatgctatatcctataatgttatcgcttatgcaacccatattcagatatctctggtggtctcagaatgacgtttatggcttttctttctgttaaatgtaggatctgaacaagggtcatgcattacatctggtttgtctctagtttattttcctgtaggatcgtttttctgcctttatcgctttaacgttaggatttgacgcttttgaagaatccaggcttgttagtgtgtagcatgccctacagtctggacatgatttggttcaggttagacatttctggcatgaattctgcataggtaatactctgtacttcccattgggtcccagcggaaggcacttactgttagtgggctccgtcactgctggtgccacagttggtcactaggttaaagtgatgtccaccagatctcggttataagggtgcctttccctttgtgcttaatccatggatgatactttacccccaaacgtttcactgatgcttctagcatccactgcctacgtgcctgaattacttcctgttatggtggttcaggtggttctcaggccctttgatttgaggctttctttagggcctcaggctcctgttggcactggagggtggtggtgggcatctaagcccgcaagttgtgggatgtgggagaggagaaaatgttactttgctttcaagaatccaaagattctataacatttgtgaacttagtcatttacttctgaggtctgttttacttcccttacgagcttttcattaccaagcaaaaaatcagtctttgactcagactgaagccatgaactgaattttatccatgtgagcttcaggagtgaatagaaggaagttgattgacagggaaggaacacatacagataggatattttccattttatgagaagtaacggtggaaatacagaagaggtagaaatgtaagattctttaaaacatgcatgacaacagcttagtagtaacagctgctgcttccagaggagcttctcagtaccagaagccccagaaggctgtgttgtaaggcagagatagtgatcacactacaggaaggagaagctgagatgtagagaggttaaggaagatgcccagtgtctaacatttactaggtggcagagttggtatttgaatccaggtttatggtgatttcagaacttccaaattgagaattaaagatcagctccaacaagagaatgagagcagtacagttggtggaagattatagacacctggaaatttaatctttatggggaactatatactgtagtgtccataatgttctgcattttgaatttttaatacgtgtgtttatatagataatatacataatctgcatcatgcaactggaaggacatttaagatttaagatgtctgattgcaaaaatgttagtgttcaaaatgccccccatcattctgggcatgatgtgtaactcagtgaaggccgttgagtgtagtgaaagacttactacttggaaaataaattggagcaggtgaatggccactttaaaatttgagtagctcctgtccctgttgtatttgctaattgtttatctcttagtggtgaatttattcaaaattcaaacttcaacaactttatggattctgtgtgtattggttacattgtgaaatacattttttagtgtggatcatggtcaagagtttgaacattgatcacatgggggtcttagaaggatcaggacaagggaactttggaattggtaaatttgtgtattaagggtttcaagttgtcccaacttcaaattttacatccctttgctgagagaagacctggaaacctacttttgtcttgtttatggcagttgattggaatcttagtttagaactggcccctggaagaggtggaggtcattttgtaggacttggagcatgcccagaaagagatgggacaaagtcatgagatcctttgactggggcatttcttggatagatcatgttttttttaaacaacaacaacaactggggagcatagtctggatttcattgtggtggagaacttggagtatttctccaggtgctgttcatcagtttgcactcggttctgaggaagtgtcttgagctgggtgccttgccctgagggagtatagaggtgaacaagatatctgtgccctgaggcatcatggaacagtgcactgaagtggaaggaacccatgtaacctgaatagggggcagcagctgtaaatgcttcaagagaggcgcagctgtcatggggttgggactcagagaggggaagaaacattccaggtggaaacaggaaagagcttcaggtaggaagcgacctttgaaagggcagaggggccagacatcatgcaggtaatgctgctgcttggttggcctgtgagcttttcaggttgatgtgttgaactgaaccaacaaagcgttgtggatttggtgagctgtcctaaatgtggagtcaggggaaatgtgaaaagcctgcagcattgtgcatcttgactgctaggggatggaataacttgaacctgatgtttgttcagaggaagctgggagggttttattcacaagagtggccttaattcacaagaattggagaccaggagggtgagaacaccgccgttctggatcgcagcagtctcgttgatcttcacggtgtcgagcgtgctggtgtgccgcctccatacgacaggtccctgttcgccggagggttcaggacttccttgggaagcatttctgagactcttttcctctgtacctaatggagcccccgtgttctctggccagcttccttccacggggtgctgagttactgccccgtgtgtcatacagtggaccttcaagctgcctttggtggtaaaagcttgtctgcatgtgttgcatacaaaaggcttttctccagtgtgactccatccgcctttaaatctgaggagccggagaggatgagaaggtcttcccacaccttgtgcatctctgttgcttggctgtgggcatggctgggcctcttaacaatggtgtcatgcccaggggtggggggaacgtggcctggggtctgacgaataccaggaacttcagctttgatggagttggctgggctctgataaacttggagactgctcccaccttccatctcagcgtggccgctctcagctctgcccccgccatcgggagacttggactagatgtttagaaagcagttttagggttcagagaaattgggcctagcatctgtgggctcatacagatatggttcgtcatctccagtggttcaacttacatgtttttttgactttgccatggtgcaaaagcaatgcacattcagtagaaacagtgcttcgagtacccatacagccagtttttcagtattcagtacgtcacatgagctattcaacgctgtgttataaaatatgctcttgtgtgagatgattttgcccaactgtaagctaatatgagtgttctgagcaaacttaaggtagctaggctgagctgtgatgttgtgtaggttaggtgtatcaaatgtattttcaacttcacgatgtttttcagtttacagtgggtttaacaggatgtaccccattgtgagttgagcatctgggtggccctacaaggtagaaccaaggtgtaaatagtcaagagttagaggaaggcagattactagcagtcacattgcacgcacgctatgtcattgtactcgtgctagcaagttttgttaaatggcgcttattttgaaatacatatgcagtggacatgtactgggagttagaaattaagtgcagaaggcagacagctatagcattctatagcatttggatgggagtattggcaccttttttttttttaaacaaaaatgttctcagtgaaaatgtggttataagcttatttttttctatttctctcagaagctgtctggcaaatgttttgattctttggatgttttttgatggggtctaccctcaggtctcacacctccggcatcatctgtggcttcgtcttttctaatcaaacctcctttgaacttttcatgttgtctgctgaaagttacatttgcatagcatcaaatagtgcataaactacatgtacattgtcattttatcaattattataaagtcctgtggatttttacctataaaccctcttctaatccatttcttctcttccccattatggcctctttatgagggagggaatttaatatacttgctctgtctctcaccttccccacagcccctctaaatcccaatttttgctaattgtaccggttttataattttcaattttttagtagtcaccttttaactgtatttctagtatttcttgacttgtcatcttagacttctctcctgtgtaaaagatgaggagctctgtaagtctccaccaggacttgtggggaagggttgacgggggtcacttgcttatggccgggtgcgggtgggactgcattttttaaccctctctgtgtggttggggtaggatggtgttatggtgtgactctgtccccacccaaatctcaccttgaattataataatccccacctgtcaagggcgggaccaggtggagataattgaatcacgggttggtttccccgccgttctcatgatcgtgaattagttctcacgagatctgatggttttataaggggcttcccctgctttgcctggcactcattctctctcgttgtcctgtgaagaggtgccttttgccgtgattgtaagttccctgaggcctccccagctatgtgtaactgtgagccagttaaacctcttttctttataaattacccagccttgggtatttcttcatagcagcgtgagaacggactaatacagatggttattgttgaagttttttgacctactaggctgccctgtcctggtcctttggctagagaggataggtctttcttgaggcttttcttctgtacctgttggtgtttctgggttgctggcttgtttagcactcagtttggagcatttgaggcaaaaagaaaacccagagaacccgctggcatggttcccagccctgaaacccttagccggtctgcctcctctctcacattctgaggctgacgtttgttttataggcagcatccagggcttttagctgcattcagctggagggagggggagatgtgtcttctccatctttttgggagtcataggtcagttctctttgtgctatgctgttatttcctatcaggtgtggccttgatgggttcttcctgtttgtgaataaaagcccagttgactggcatcagagcggaggggactgtgcagtcctgtgtgtgggttaccggccccgtgggcttcactgtgcgggttgtgtgtctgggagcaggtggggagaaccggatggagggctctagaagcagctacacgagcagagctgagggagacactttctctgcacctgtttcctgtgtcacacttcagatgggggatagtccaggctggtggtggagctcccaggggatttcgcttctgggtagaattgtcatttttttttttcctcagagactgttgtgtgggcctagtggtgcatcaggttccggttagaatccagtgcaggccgcaggcttctctttaattagagagggtcacttcacctccggttagaatccagtgcaggcagcagcttctttttaattagagaggggtctgggtgctgagcttcccatcaggaagaaggggctgtcgtgctgaagtcctgaggtgggtcacgtgtcccttcctgtgttagaaaaccgtctttggtgctcctggggctcccttacaagtgctgttctgaactgttaggtcattcagagtccatctgcgtcctgtccccagggatctcctcaaaccctgtttagactgctcatagcctttccctttttagcactacagcgggttctttctctgttaattttttgaagctttttctttctctcatttcggtggcaccttgggagggatgggagttagataggtgtttgcagtgggccatcttgagaaacttctcaaaactggagtcttgtaactgcttgcattttgaagttaatggaatgggcgcattgcctttatagctgtaaatgttactgcttcacttactgttagcccaagccagtgtgttgcatctgcccagatccttctttgtggtatgtgctcactttctggcgacagccaggctgttctttgcaggcatgtgctcctagcagtcgaagacagaagtttgggggcctgtgtaggctgtatgggctgctgtgtgtgtgtacgtggtgagttgtgtctgagaccacccctcctcccctgggtgctgcctgatctgcctgcatgaccgctgtgggacaccactgtctctggtgtcctttcctggctggcagtgtggtggtgtgggcaaagccaggctggtgggctccgatcttggttctgcctttgtaagctttgtcacactgtcttttgggagctcgtgtgtgtgtgtgtgtgtgtgtgtgtgtgtgtgtgtgtgtgtgttttcgttttctgcctgtaagataaactggcatgcagtctacactgaggtacgggctgtgtgggccagcacagcatgccgtggtcctaagcagggaggtgtccttcctttcccctgcctgttggggctgcgcttccctgcctcgtgtggaggttgcgcccggtctgcagaaggcagagagcatcttgttgggaagagccctgcctgccttcccgttgctgtgctcctgcctccctgctctgctcctctcaccccttcctggaaactacctaaaatacttggttacttcttttttgaagatgtattctctgtcctagtgtttgggtgttgatacagtggaatccacaaaattgaataagatttgattttcattttaaagtgaaataaatcatttgggtgcatgttgggtgaaagtgccgtaattgatagcatccgtcatcagactttaattttacccctggggtgtaggagtgggtgggattaagtacaaaatctgcagaagccaggaagtgaaaacgtactgctggatttctgtttttcacatgtccccaacaatatggaccatttgcattaaacttaaatagcaccacttatttaagattcattttttactcttgttctgaaatcacaagttccatttgacagtgataggacaaaattatatttttaaactttgcaaaccacactccagagctgtgctaaaaataacaatttcttgtgtcaagaataactttctcaagttcctggaggaggcgagctgactggtggcaacgcagaccactaaagcttcagtgagcccagaaagtgtgcgctcagtcccacattgcagaggcctctccgtcagtattgagatggtggaaagtgaggagaagcaaaaagacgactacttctttccccatttcccggtctggtctttttggggtctactacgtagaggtgcatcagccagcgctaccatggaggcaggaggcattcttttgctctcgtgtcagtactgacggggttgattaaggttgctgtgcttgttggtgtgggtattgggagggtggtgtgaaagcagttgggctggaatagagctggtcagtgtgtccttttgcgtgcatttgtgtggccctagtgctacagtggtgtcccttagctctgggggactgtctgaatttttgtgctctaaattattaatacatgtttatgtgtgggtttgccagaatgctgtgtccgttattgttggctccttggacagctctccttgttctgcttcactggctgtgaaattggttcacgtggtgggctctgggtccagcgagatgcatctgaggtgttgacctggtggtgtgggcctggggctgccagtggtcctgttgcctgatgagggagaccgttcctgaaactgtggcgcacactcaggagagtaggaaagagagcggagaaagccttccggttctgagcttgtggctcttgccattcctgacttgtttgttgtgcgaaccaataatttcctttttttgtttaagccaatttgagttgggtttacttgcttgtagtggaaaggttctgacacaggatctttattatatgaagtattttcataatgtacattgtgttatatattagacatatcacacgatctattttgtgatgtagtttgctttgctgtttttattctgtggaagatattcctgaatttctacacttcctatgaatttggaagtggggtgaggcaaagtcactaatatcggggtatcagtaggggagcctttcgaatcccaaacattggagtgtccttctgtgacccgtttctttgtcaacttttgtccgctaggcagagtggctgtgacatctgacatccagtgtgaaggtgtggtcactcagctggaagagaaaaacctagcactctgagagtgggtggatctgctggtgattttcaagcaatgtcttcccgtttttggatgctcatcccttctgtagttggagccttgttctcttttccttgagtacaggtggggctgatgactcatttcttatgaaccgagcacagcctgcctgactgctgaggctagctcataggattcctgaagctgcaggccctgctttccttcctgcgtgtgccctgggatcactcgctctgtggagtccgttgtccgttctctgaggactcaggaactgaggcctcctgctcacagccacgctgtggagctgtcttggtagcacctcctcagtccctgcaaggccttaggctgccagaatcccacagcttcagctgacatctcaacgacctcccctgagacccagagccacattcacccagctaagctgccctgaacgctgacacgcagaaactgagataacagatgcttgttgtttgggccactgagttttagagtgagttgcctgtagaaatggatgagcagcatctgtgcctggaggtgaagggtggagccaagtgcatgtctgtcagagtccactgctatccatcctttccctgcctgccttcctcctacacggtgctggatcccccagaggatcagcagccgagaggcttctgcgaaagaatgtgctccttcagggccgacttgcatttgtgtctttttttcttggagatttctgtaaaacagcagccgttagcagttatgtgattactgtgtttagaatttgagaagaaagggaaaaccttgtttgccatggaatacatactgtgttgataagtcttccttattttgaataatggagaattctctgtgtcttagccagctaagagctacttacttttatcatgttgtgttaaaatgataaaagttactcttcggtgacctaactgcttcacttaatgagttttgattttgtttttgcaggatgcatttcctctccttcaggaataagttctgttggggaaattatgaaatatggacatgttaccacctcctgctagatgatggcgtattaataaacagttcctacatttcagtgttttgcacccccaaaggtttattatgtcagttatgtgttagctgcagataaggtgttgctctgctccaagtgtctttcttcagcatccaggctgatagaacagctccattttgagccttgccattctcatttaaggaaaaaggataggaggttggctggaacacctgaaggcttccaaggcttctgcttagaaccagggtgctttctttcagcttggagctggtgtctgcctcttctgtcatattttgtccggaattggttccttctggtgggttcttggtctcgctgacttcaagaatgaagccgcagaccctcgcggcgagtgttacagttattaaagatggtgtgtctggagtttgttccttcagatgttcagatgtgtcagagtttcttctttccggtgggtttgtggtcttgctgacttcaggagtgaagccgcagaccttcgcagtgagtgttacagctcttaaaggtggcgcatccggagttgattcttcctcagagtaggttcgtggtcttgctgactttaggaatgaagctgcagaccctcgtggtgagtgttaacagcttataaaggtagtgaggacccaaagaatgagcagcagcaagatttattgtgaagagcgaaagaacaaagcttccacagcgtggaaggggacccaagtgggttgccgctgctggctcgggtggccagcttttattcccttatttggcctcggccacatcctgctgattggtccattttacagagtgccgattggtgcgtttttacagagtgctgattggtgcatttacaaacctttggctggacacagagcactgattgatgcatttttacagagtgctgattggtgtgtttacagacttttagctagacacagagtgcttattggtgtgtttacaatcctttagctagacagaaaagttctccaagtccccacccgacccagaagcccagctggcttcacctctcaatccgccctctaaataggagactccaactgctgttgggaattgggcagtgaccgctctagctacttcctgctggatagggatgaagaaggggccctgaagttgtagtgtcctccagaggagaactatttaggctagtgaaagggccagtgggtttgtccaggggcccttggtagaagttgttagttgagctcatttggggttccatttgtaagaccatctgtagcttgatagccttgattctagaggaaacacatttgaggaggttaaaaatacagggcccgaaggcgagtaatagcaagatggctgccacgggacctagaaaggggagaagccatgttgcccaactccagaggttcgtataagagtttgaaaggcattgtctgacttcagaagccttttcccgtaaacaccgggcagcatctcgtactatccctgactggttagtgtaaaaacaacactcttcccctaagaaggtgcagagtcctcctttctcagcagtgaggaggtctaggcctcggtggttttggagagtcactgctgccaaagagtctatttgggattgtagagtaaggatagatttcgttatttcttgcaaactgagaaatcctttgagagtgtgtggtagtaggataatgaagtagataaactggctactccggttcctgtagcagtagccattcttaaccctataagtaggggtattagttgtatggctctgcgatgacagacttgagctttgaggggtactgataaagtctgatttcctgaggcaatgttaatgttgggacttagaaagactaaggtgcaggtgcctgtccagttggtggggaggcagatataggtcgatgttccacataagaagaatacatcttggctgggtagacagaactggttgtgtatgttaaaaaggtgtgtgagtttgttgttttcattttcccatactcctagagtacttgccaaggtagctctggtgagtggctggaaaggggtgttgggagcaaactgagtggctccctgtgttctgttttcccattggagaaaaaactgttttgtatctactaggaaccattcattagagagagtgattgaaagaggggatgagaaagcattcactagtggtgggggcgctgctgcagggggtccaggggtgaatggtcatgcagggagtatgtttgccattacaaaacctggactgtttagggaggaggtgatgattttggggggccctgagaagtggacaagccgtccgcatggagctgtttgggtgacttggaagttactatgatcagttggggcttgaagttgtgaggtgtaattacactgatggggtggtaggtgccccaggggcaggcctgataacaggttgcattggatgcataaagggacatggaaagttaagatggtattcatagtaacagggccgtgtatgcgcttttcattgcttgtgtaatagatgaggttggaaatgtaagaacgtaaaagttggattgcacgtcctgttagggtattcttggtcttatcagagatggggaagttggctaatgattgcatatttagaagttggaaagggtcttttccttcataatgagggtgataggttaagttggtagagacccaggtttttgcaggaatgggagtggctacgtaagcagagattgatagatacaaagccaacagtcatttgtgagggaaggattggactggtttaacagagagtgggttgagagtcttgtagaggtatttaggagctagtggaaggggaggggtgattgtatgaggtatccaaggaagcaggagggatagatagtcaaagagtaaataggaaggtaaagagggtgctctggaagacgagatcattttatccaggctgagttaaaggtaggagtaaattgctgtcagaaggaaggaagatagaaagaaggttgataagattaggattttcgtcctagcaggagctgtagtatatagccctatcacaaagagtatggttagtatgctgcttaatcatatgatgaaatagtaaaaggattccattaaagggttaaggagaggtgttaaagattatgtaggttttcacttatcttttttaaggaggaaggggtttttcttcaggatcagtggtaggagcctttttagtctgggatatttccttccaaaacaggagatgcaagtcctccagtggttcgcaggtgtatcaaggctggtctggctgatcttgggactcctgagctgatggtcctgcaggtttctcagcgggtgtccaaaatttaactcgggtgtggtgaatccaagattccactcctgccaccttaactgcagtgggggtagagaggattaccgagtgtggtccttcctacaaagagcccatggatggggaggtagaggggagagatttgaccaacactagatctcctggttgaaacaactctgttcccttttctctgtgacatccttcaggtaggattttaaggttttgttgatattttgccaaagaagttatatctttgacgaagttggccgtttcctgatgaagtaggacgtcatttgtgagaaaaggtcgtccatacagcatttcatatggactgagccccattttgtgaggagaattttggattctcaacaaggccatgggcaaaagagtaggctatgggagatgagtttcttgtgttagtttcctttagtgcctcttgagtgttttgtttgccttctcgaccttccctgaggattgtggcctccaggcgcagtgaaggtgatattgtatccctagcgccctggaagggtaccgagttaccacggctttaaaagctggaccattgtcgctctgtaagctttggagaagcccaaatctaggaattatttcatgaattaggactttaatcacttcctgagccttctctgtcttgcgagggaaagcctttatccaatttgtagaggtatcaacacacaccaataattattgaaatcccttcgacttaggcatatgggtgaagtctaaatgccagtcctctccgggctagtgacctattctttgttcccttagaggggacttatgatggaccaagggattattcctttggcacacctcacagactttgactacctgtcagatggtccggaggagatttggccctgtaaatagggatttggccatttgatgagtgttttcaatacccatatgaaaagtttgttggagggttttaagtattttccactggatggctttgggtataagtacctttcctccttctgtcattaaccaccccgaggggagacaactatgcccccgtgaaagtccccattctgtttcagttggggaatactggggcttaatctcttggagggggttgttccataccaagggtccttccgtaggtatttctaatgggaggttcctcctggcagcaattttggcctcagcatctgccctgcggtttccttctgccttttctccttcacttccttctgccttttctccttacactttggcagtgtaagactgccacctccttgggtttttgcactgcgtgcaatgactccataatttccttgtggtatttaatgggggttccctcagaggttaggaactccctttctttccatattgcagcatgggcatgtaggattagataagcgtacttgctatctgtatacacatttattctttttccctttcccaattccaagtctcggttaagtgccactagttcttctaactgggcactggtccctgggggaagaggcttactttcaagtgtcgttacatcactaactatggcataacctgccctttgtattccattgtccaccaatgaacttccattggtatacaggttaaggtcaggattagttaaggggacttccaagagatcatctcgggcagcataagtctggactataatttgttggcagtcatgctcgattggttcgccatcctctgggagaaaagtggcagggttgagggccacgcatgtacatatttgaagcactggtccctcaaggagtagtgcctggtatctgagtaggcggttgtctgatagccataaacttcctttggcacctagtatgccatttacatcatgagtagtccagacagtgagatcctttccttgtgttattttgatagcctctgacgctaagacggccaccgccgcaactacccttaaacagtgaggccagccttttgctactacatcgatttccttagttaggtatgccaccggttgtggggttgtcccacgagtctgagtaaggactccaagagctattcctgctctctctctgatatataaagagaagttttgtcctgtgggaaggcttaaatctggagcttgtactaggttctgctttttaaggttttgaaggctgtttctgtccctggttcccattctactagatgaatatttgccctctgggtctccttgattagagtatggaggggcctggctatctcgctgtatccggcagtccatagttggcaaaacccagtgattccaaggaacccctgcaactgttttaatgtcttagggtgaggataagccagtataggccgtactcattcctttctgagggccctggtccgtctggctaagattaggcctagatatttgacctgctataggcaaagctgggccttcaacctagatgccttgttcccttgatcagctagaaagttcaggagatctagagtagcccactgacatgaggcttctgaactggtagcccaaagtaaatcatccacatgctgaaggaccagagtgcctggacttgagaagtggcctagatcttgggccaatgcctgaccaaacaggtgagggctatccctaaacccttgggccaagactgtccatgtaagttgggatgtgtggtctgtgggatcctcaaaggcaaagagaaactgtgagtcagtgcaggggaatacagaaggcggcatccttgaggtccagaatagtgaatcattctgcttcctctggtatttgagagagcagggtataggggttgggtacaactggatatagaggaattactgcctcattgatgagtctaaggtcttgcactagtctccactgacgattgggtttttgtacccctagaattggggtgttgcagggactgctgcatttccttactaagccttgagctttcaaatgtttaacaatatcctgtaatactttatgagcttcaggccttaagggatattgcctctgataaggaaaagtggtgggatcttttagcctgatttggactgggtgggcattttttgcccttccagattgtctttccaatgcccagacttcagggttgattccctcctcaagtaggggacaacaaatgggtaacttgttccccatattcgtgtagataatagctccagctttggctaatatatccctccctaataagggtgtgggactttcaggcataacaagaaaggcaagtgaaaagagcaaagtcttccaattacaactgaggaggtgggagaaatacctggttacaggctgccccaggattcctcggatggtaacagaccttgaggatagtcgtccaggactggagattaacactgagaaggcctcgccagtgtccaagaggaagtcaatttcctggccctcaatggttaaatgtacacggggctcagtgagggtgatgacaagagctggcgcttgctctgggcaccgtcagtcctgttgttggatcatctggttgggggcttctggcccagagaaccattgcactctggggcagtgcgccttccagtgattgcctcggcatagcggacatggatgagggggtggcttctcgttggacagtcttttttaaagtgtccttgtaaaccacactgataacaagccctactgggtgattggccttttccattttctgtcttctctgaaccaccaaggtttgtctgtctgagggccatgactaaggctgctgcctttctctgatctcgcttttccttttgggcctattcctcttggtccctattatagaacactgaggttgccaggtttagtaatgcctccagattttgttcagggcccagggcttgcttttggagctttctcctgatatctgcggctgattgggtaataaacttatcttttaggatcaattgaccctctagggagtcgggtgacagggtagagtattttcttaaggcctcctgtagccagtcgaggaaggcagaaggattttcttcctttccctgagttatgctagacatcattgaataattaatgggctttttcctaactctccttagtccttctagaacacaggtcaacagatgtttatgactccagtccccatgatctgagttgagtcccagtggggatccatactggggacgacttgctgaccggtagggaatttgtccctttcttcggctgtcattctgtcatttacttgactaagataccaggtatcaccaaactctcgggctgcagctaaagctgcattcttttcattaaagactagggtttgatctaacaatagcatgacatctctccaagtgagatcgaaggtttgccctagaccctgtaggaaatctatcaggatcatctgaaaacttccccaggtctgcctggatctgctttaaatcagagagggagaaggggacatgtacccagcttgggccaaattcctctccccctacagcttgaaggggacataaccgatagcccgggggtttttgtggtcccttggagatttctttgcttatttccttctgggcaggggagattagaggaggcttatcattaataggaaggggagctatagggaggctaggatatgggggtaagctgagaggtcctcctgtgggacataaattgcaagctttgcatattctccttcaatgaaaagaaagctggacataaggtatttcaatccatttgccttccctcttacagaaaaggtcaagctgcaggatagtattgtaatttatacttccctcaggtggccatttttacccatcagagagagaatactggggccaagccatagtgcagaaaaaaataagctgcctctttttcagggtttctgggtcaaattggtccgaatggcttaggatgcatttcaagggtgagcatgttgatgcctgagtgtttcccatctgaaagacaaaaccacctgcagttttggtttgtttttctccccctgcccaagaacctataatggtccctggaccctgctgatcggaatagttgcgctcaccgacgcagcagcagaaacacctcttgcccaagaaccctggaccctgctgatgggaatagttgtgctcgccgacgcagcagcagaaacacctcttgcccaagaaccctggaccctgctgatcggaacagttgcgctcactgacacagcagcagaaacactagtttccctcctagaccacaaggaggactgaggaaggttggatttagtggcccttaccgacgcattctcgtaaaacctgcaccttgcctgtcctcctagaccacaaagaggactgagaaaaatcagatttaatgacccttactgacgcattcttgaaaacctgttaagagtcctaagcgttctcctgttagtattgggactttacttgtgtcctataaagatgttatgcccccaaaatgaagtggagggccataccctgagggagagaagggatctccagggttggaagagtgatgccttttgtcctcacttatatgaataggaaggatacaatttctgaggctccccatatcctagcttcaggaatagcttttgttaggcctgcttgtctgagtaggggtgctaaaattccagatagtaccccctatgacagggctttgggcaaaaattatgtctttctgattggcgggcccgggtgcctaaagaagggaacagagtcctgaaactagaaaagaactagagacagggagtggtttttagaagcaggactagcctcagagaagagaggtgagaggacgtttgtctgacaggcattaggacccaggaggcaagggtcaggatggataggatagatgggcgagtctcacttgggcgacataactttgagagttccgctcatggccacagggtcaaccagcttgttgttgggaccccggagttgaatggctttcctctctgttgaccgttggctcagcctggaagtacaggagaagtggaagctggtaccaggcaaaccaccgctcccaactctgaagagtcgggggttgttagccctttcccagaaagcctgacacgcgtgtctttagtccggtggctgtgctagttgcttttaactggccgacaggtgcctggtatttagcccccgaattctacggaaaaataggacagaatagcaagcaaaaggggtccgatgatactcactgcttggcgatagtcccatctgggtcgccaaaatgtgtccagaattggttccttctggtgggttcttggtctcgctgacttcaagaatgaagccgtggacactcgcggtgagtgttacagttcttaaagatggtgtgtccggagtttgttccttcagatgtgtccattccttcagatgtgtccagagtttcttccttccggtgggtttgtggtctcgctgacttcaggagtgaagctacagaccttcgcagtgggtgttacagctcttaaaggtggtgtgtccggagttttttgttcctcctggtgggttcgtggtcttgctgacttcaggaacgaagctgcagacccttgcggtgagtgttacagctcataaaggtagtgtggacccaaagagtgagcagcagcaagatttattgtgaagagcaaaagaacaaagcttccacagtgtggaaggggacctgagtgggttgctgctgctggcttgggtggccagcttttattcccttatttggccctgcccacgtcctgctgattggtccatttttacagagtgctgattggtgcatttacaaacctttagctagacacagagctctgattggtgcatttttacagagtgctgattggtgtgtttacaaacctttagctggacacggagtgctgattggttcgtttttacagagtgctgataggtgcgtttacaaacctttagctagacacatagtgctgatgggtgtgtttacaatcctttagctagacagaaaagttctgcaggtccccacccgacccagaagcccagctggcttcacctctcaatatctcattggtcagagaaagtcatgtggccaggcctgcccctgcctgtaggaagctgatgggcatcactgggctggatgtagactcctcctcgaagggcagggggagtgaatgaaagcagccatactgtctgctgcagtgagcctgggttagagaggcagaggaagttggaacatagtgtactgaatgtgaaaatttaagtttgggtcaatatcagctcttagaacttttgtctgctgaagcctttttattttagaataatactctttttgattgaagctgtcctggaaaccactgtggatatttctgctagtagtcgtcctctggtcagaggttttcatatttgggagcacaggtgactataagctccctgatgttgcctgtgcatacttgtaaggttaccctaagggccttagcctgccagatgcttgctggtgaccagccgagccccatcttcctcatgtccaaatgagtcctccttttgtcaggtgttagttcaggaggtaaacttaataataaatgtggctgctttggtgtaaccataaaatgaggaatatgctaaaatagaattcctttggaggcatggcaaaaattaaggctggaagttgagtctgggccagattgtagagcctttgatgactggttccagcatctttggcttcagtttcttctgtggggttaggagttggagtgctgggtgcccaggaacaatcagcctgggcctagagactggacagcagtggggaacgggcaccagacagtgacctcctgatatgcctgttacagatggtggccttaggtccacatttgcatgggctcacccctcttccttttttctgctccaaagtctgtgcctccattgggagcacatacagttgtcacccactctgtgaagccctttctgactcatgttacgggtacttgctttctgccgccgtggactactcggtgactcctcctcctcttcctcaacacctagggcgacttttccctaccatctttctgtgtctgtggacatcacctctctcggcccctagatgggaggggtccttaccagccttgggctgcggcctctctggggagagcccagtgccctccctgctgcatccttcattttcctcccggtcatctccaagccgagcctcctttctctggaaccaagtgtgggagatgcagttgtggtacaaaggaatgaatgcccacttgccttaactcatttttttttctcttattgtcctgtagccagctgctgaattcctcaccactcaccttcacctttctctcgttttctgttcagccagctctcttgaccctggtgcttccttgctcgaaatcatgtctttttttttttttgacaatacactgtgtcagaggaatccttgagttttacaactggaagtgactttagaggttagctgattcagcttctctcccttcccaggtgaggaacgggacacccacagctgtgtggagacttatccaccctgcaggtgccagctaaatccttcaaaatgacctttccaaaattaacgccatgttctgacatagccaaaactgtaatgtctgtcatacatgacaaggttagtattgatgtctcaacaccatctgatacgtagtctgtatttacatttccccaggtgttcccaagtacactttgtagatggtttatccaaaacggtccagtgcagggccccttctggcatctggaatctcttgatccagagcagtcttgttttccatggcccagaattgtggacagacttaatgtctggcttttgtaggtgcccagaagctgcttgttcagtgaagacatggtaaagacaatggggatgagatactgaagacatttttttcttctttggctcgggggggatttccctcagtcttaaatattaatgaagttcggccttcaattaaaaaaccatgcccttggtcgtcctccatgccattgtcttctgaacctaggacttgatccccaggcttgttggctccttccagtctctccccagtgtttgtccaaatccccatcgtcccccttgttcctgtggctgaggttctccgacctacgattgcagaaatcttcctcagatagtttctctgcgtctcactattttcttctatggtttgtatagtttagcaccttctagccattctattttatgcccaaatcgctttatatatggcctgtgtatttcacagagggcaagataattttcctaaacagtgccagctacaattcagcttcctaagaagcaatttctggaaagcactgcaagagaaacgaggtccagtaaacatactctatgagaatagagttgagaaagtcattgtactttggggcttcattttatctctaaatgagagggctgacctgtaagtcatgtagatgattcttctctctgttcagtgggctttttcttgtggttattttgcatttttaaaagtaagagttttccttggcagaatggagttatctgtaggtctgttttgataagtgagatttggtgtgcccttttctttttgaaagtgtggggcattccagttgctgcttcctgtcctcaagcatgttcccctttccctggtgaggatgagaagtctgaggtctaaggggcccaatgcagggctgtagcaagcaggtggtcagggaggctctgctccgtagtctcagccctcttccttcttccagcaccgccgtgtccttcccacaacgtgccgcattgtgttgtgcggttcagtgttagaccatgggaactcccctccccgccacttttaagaaggtatttttctatccttgtttgaatactctgggcttcttttatccctgatttggtattgtatttgattatgtagtttctattgagagcaaaataccaaaaataagctaaggaattttaatgttagttttctggtggaaaactggtaggatgatttcattttgggagtatcggatcattctattgcacatttaattcacttaaatgtaaaagtaagggtgagtgtttgaaatacgctttttcaaatggatagatcctaaagcgtattatggtgcgaagtgtgtctgtgcagccacccttgtccccagcatggtgcctgtgtggggtagtgcaggtggcaggaagtgtgcctgtgctggcattgaggcttcagctgggcaggattcctaatgaccttccttacctcaccaggagcgcttctcacgcttggctgtgtgttggagtcacttggagagggttggcattttgatttgagtctctggactccagaacactgctggagtatcctgcccttttacagccccccaggaggtcttaacatgtagctcctgctgagaattgctgctcctgaggctgaggcttccaaaaggaggcctggagacaatggaatatggtttgtacttccttccctcctgctgctccttgccattgccaagagtggaaatactgctaaagcacccagcaagtcatggtggggaatgaatgaatcccgtctaagacacttgttttaataaccctagggaacaatttagtgtgctaaatgtcatggtaattcttacatacacactgatttactttttgcagagagatttctataaaagttttgagacttccctattattcccatagtacaaaatttctctgtactcagatttttctgtttctgttttttgttgaatagatttctattttaggaaatagtctgttatctttctctagagaagcacttcaatcgaaacattttgttggctgagaatgtgcattttccccctctcaggggtaaggatttgcctcatctcattgtctagcttcctgttgagaagtgtggtgtgtgtattcacttaaactctgatgtcatattgaagcccattggtgggcagtttcagccaatcagatgcttcctgggtatccaagtaagaaagatatatagttctggaataacaggaaacttcacatttttcacatcctgttattctgggttttgtgacttgctgccttgccactatgaaggttagtagaaatttatgtatgtatttctttttgtagtatacaaaattgacaaaataaaaaatgacttgaattttcagagcactaagattagatctgtagagctgaaagacattcagatctcctatttaaaaatgttatgatgaagagaaattttatgttttgcatataaggaagctgaggcctatttaattccttttaaaaaatgcagcttaacccgtatttgttataggtggttatgtcagcctagatgctgctctcatttgagttgggatttcttcttaaataataaatattacaacaaatgtattctgtatgaaagatgattctaaagactatctgttctaaggactgttttttaaaggaaggatttagcttcatgaaatcagttatattttgtgccttttgttagaaatggcatcggtaagcacatagaatgcttagatgtgttcacagctttccttttacgttttgtggttccatctgatatttccttgtgaactttaagaaagtgacctctggttttcagctcctttcttgactcttttagtgatttggtgggtttttctcttgaggtagtttttcaaagtctggttcttctttatttatgtttaaacatctcatgactatttttacttatttggaaaattatagacagaaggcctttagctgcagatgaattttgaataatacagcaggactttttcacatttggtgtcacttttcttagcttctcttggcgtgagcttcattacagcagcatgcggtgcctgcagggtgggtggctggttggatgctggtgcacgtctccattcggatgccttttcactgtgcaccggcccctgtgctgggtgttgggagatgtacaatctgccactgcagatttttagtctagggaggcctgtagacatccaccatcaaactatcatgacacgtgttctgggggagcctggctggggacctgaccgggtgtggtgggggcagccaggctgtcaaggcagggctgtgtcaggaagcaagatgaataaggattagccaggaaagggaagggaccgaaggcaggaagaggaagaagtggggcttctggcagggtctgctagaggtgtggggagagggcaggactgacaggaggagacgacagccctggagagaaggtggggcccttgtccactgatgcttatttccggtaatctcagttagaacatatggcaacaggatacacgttttggtttttaaatgtatctttctgttattggcacctctgaaagaatttttttcttaatttttctggaacatagttgtggacgatttgactgtttatctttgcttgaggttatttggtgatcagaagccatatgtagtctttgggcagtatctgagatgagagctctgtttgttttgacatggctgtgtgtgtgcacacgcgttctagacactagttgccacatacctaggcaaaccaatgtgctttacctttccaagctccaggatggtggtgggaagtgcctgccagtggcaatgtgaccagctccatcgtggtcccagggctctagatagccctggactggaggggatgcggttgtgggcttgcctggttctggcctcagagctctgagggtggtggtctcttgtccctgcccctttcctatctgggatctgcttctcctgtctgtcctccttttaccctcacatccactctgctctctgatgtccgcattttcttttgctgctgttagctttggaatcgactgtcattttcccttattttctgtggctaggaaagaacatctgtagcacgccttgcctggggcctctgtgttaatctaaggagaggaggattgcgcaagcaccgtgcttgcttgctgaatgccagcagcccacccccccaccccgccccgcccccgtgaatgagctcacactccagaggggcaggggcgggtgttgggtagggaattggcctaatgccgaggggggaccctgcacctaagtaggagaattttgattgggttcttacctcaggactgagagactgagcgtgctggtctccctgtcgcaggttgtgcggtctccttaggatttcaggctgagcatcgtcgcgttgctgggagaacttagttcatcctgcacccaacataagactctactaattttgcttgtttaatttttcctttcagacgtttgatgcaaatgatttgtatcaggggcagaattttaacaaggtcctcagttccttagtgactctaaataaagtaacagcaggtaagactcttttttattgaactcgagggggtgggaagacatacgggctgacacctttggttttcttgttttaccaaagccaggggagcattactgaatttaaaaaataagcttttgttgcattacgttttgattgttccttttgctgtgatattttatttgccttgttagaatagaatcttctttaaatgttctggtatatatcaggtgttttcctttctgtgggtggagagatttctcacctgaacgtatagcaggagaaaagtgtctagttcttatgggaaggctcatgggctgtgttggagctagaagcacctttctctcagtttttactgagtgtatgctggttaaaatttgtatctagtgggcagaagttttgagctgtgaccatgataagggagtggctcgtggattggcctgtaaagtccacactacctgtccagggctcctgagggctgtggcacccaggtacatggtgtgtgtggtcctagcccccattagtactgaagtggagaggaggttttggggacatggtgtgcccctctcatgggccacagcgaagacaggagttgttcagacaggtcctctgagggaaggtgcatgttgtccatgatgccaaggtccccggaggaaatgctccatgagccctgaggagctctttcttggatttctgtgtggctcaaaaggaaggaactttttagttgcttttttggtcttattagagtaatttttttttcctatttaccttcacggatgttaaatatcaggtttgtgggggaaagtgccgtgtccttttcaaacagaaacctcctgagttgattttgtcggggtcgcttctcagcttcgtctggcccttcagaggggggggtgtacttgcctcactgcacattgaggagagacgggggttatgcatgctttggggctgcagttcctggctcccggaggcttcatcggtggtgcagggactgtccttggtgctgcctcccagcgcatgtgtgctctgactgctgtctggaagctgatgctgctgctgctgatgctgatgccccggcgagaggcactggcccccatccctgggagcaggggcagaccccaggcagaggtgtggctgtggctgcgtgttcacagcttgacttctgaggtttaaaggactgttcagatgaaagcatcgaggaaacaaaaatttaaatggcaggattatgaagatggatgtaactaatgaaaattgtcacattatttaatgccttctctgtctctacaatctaaaaatgatccttttaatatgaacaaacaataagaaaatcacagccgggtgtggtggctcatgcctgtaatcccagcactttgggaggccgaggcgggcggatcacgaggtcaggagatcgagaccatcctggctaacacggtgaaaccccgtctcaactaaaaatacaaaaaaattagccaggcgtggtggcgggcacctgtagtcccagctactcgggaggctgaggcaggagaatggcgtgaacccgggaggcggagcttgcagtgagccgagatcgcgccactgcactccagcctgggcgacagagcgagactccatctaaaaaaaaaaaaaaagaaaaagaaaaaaaaagaaaatcacttatctaaagttatggatgacattgaaaaggacatacatttagagtggatcactggaatttaatacaagaaatactgcaacaggtgatgtacagaagtggcatattcatgtgtcctgaccacatgggggaatctgcctgcaaactcatattcatccatgcctcagagttttgaattattttttatggaggcagggtcttgctctgtcgtccacgctggaacacagtggtgtgatctcagctcactgaagcctcagcctcctgggctcaggcagtcctcccacctcggcctcctcagcagctgggtctgcaggtgtgtgcctctgtgcctggctaatttttgcatatttgtagagatggggtttcgctgtgctgcccaggcttgtcttaaactcctgagctcaagctatctgcctgccttggcctcccgaagtgctgagattacaggcttatgccaccatgcctgtcctaaatgatgtgccttataattaacgtagatctctgtggcagatggggcaatagcacagatatgtaaaatctacaagtaatccttaatttgactctgctcccattgaatacttttttagaggttgctcacaggagcagaagatagtaactttgaatttcattgtagatgttttctctgcttttgctgtaagtgggggtgctaattaggacgaagtggctttagaacatggctttaatttgtacactcagtcttgggattgtcaaccatctaggtttgagacggtaggatttacaagtaaataagagaagtcagaatccagtagctctcaggctattagtttttacctctaccttatggaaatgtattttgtatatgttcttggtatcattggctatgtgttggatgtaaaatagatagctttgttctttacaaagacaaatttggaagttaccacataaacttggtacttttaagcttttaaactataggaatgacccctcctagatggaaggaatgctttgcttttctgtttgccctttgtttttgtttttgaagtcagtgggaaggcaatacccgtacgttttctttttgagacagagtttcgttcttgttgcccaggctggagtgcaatggcatgatcttggctcaccgcaacctccgcctcctggattcaagcgattctcctgcctcggcctcccgagtagctgggattacagacacgtggcaccacacccggctaattttgtatttttagtagaggcggggtttctccatgttggtcaggctggtctggaactcccagcctcaggtgatccaccagcctctgcctccctaagtgttaggattacaggcatgagccactgcgcctggcctcgtttctttctagatttcagctttccttgattggcaaacagtaagacaactgcagcagccacagttactgtggacattcttgggaaaattgtcattgtctttctgcttctgtctcttaaaatcatatgtgttctcaaggcatttagttgactgtaactggccttttaattggatagaagaaagcttggtgatggggaagtacagaatgtcttcaggatggccctccttgtatgagaatttcctggaaggctgtggccagcagagcactgcagaccatggccgggagccctgtagaatttgctggaaatgcccttttagctggttttgtgctgcgggttgcctgagacccctgtgttctcaagcagaatgtgctctatagagattactcgtaacctgccctcagcaggtcctgggaagtgtagggtgagggggtgacctgagaagaatttaagatcgttggagtagcaagcccccatctgtggggtcaggcaggtggcgtgaagggaggagctggatggaagggcatgggtgctgggtcctctcaggacagcccctgcccagctctgagccagctttacctgatgggatatagacctggtgtggccacatcctaaatgtgtcaagagcagtggggaatctgggtttttggtgataccttcagacttttcgatgttgaccgtttaattcagaattttataagatacgtgcaagccaatccaaacacctgggaggaagctgggacctggagacttagggttgctttcatggaagcctccctggagtttaggacatggccgggcacgtgcctctcagaacagcgattttcccagcaaagtttttcacagcctcattctctcttttttttaattgagtcacttttaagaataaattgctattatttatttgttggatggcctgtgtggagtgtcttatgaagggagatccagagaacagaactaagcctcttactgtctgtttactttgattctgtcagcaacttcatgaggtgagtagagcctgtgctgccttagtgttggggaaataatcctcacaaggttctctctggctgaaaaatacactggattttctcttttaaataagagtcttttccttctgttgcttattgcatgacacatcgtcctggaaaagtgggcatgtggtggtgatgctttggagaatcagtacttggttgttctccgctccataatcaaatttgagaggcttttttttccaggtgaagggaaaatctttaaaagttataatacatttcacaaacttttgaaaattatattagagaagaactgattaatagttatctccagataatttctggaaaggtagttggggaatgaatgcaagtcatttatgtagcaaataatttgttctttgttttctgcataaatgggctgctttgttgtggtcttttggtgtgtccctctgtgctgccctagttttaaagtctagtgtgtagtgtgggtgcgtggtatcaggcgctctcagctctctttttctgtgtgcatgctctttgcagacatcgggctggggagtgactccgtgtgtgcccggccctcgtctcaccgcataaagtcttttgactcccttggatcacagtctttgcacactcggacttcaaaactgttccagggccagtatcggagtttggtaagtttgagagattttgttacttaaatatgtttgggaaggatatgagtgtgtatggatatatctgagaagatacgtatgcctccattaatggtgttaaacagggcaaaggtagctggacttcgcctccgttgtgcctgtaatctggtttggcatttgctcattaccagatgatccagatattatgcttaatgattgcttttgagaaactcatttgtttttaggttgtattgcaagactcatgactcgatatctggagtgatgctgctttaaaaaaacacaccccttgtcatttgcatggcattatcagctatgcacatgtacagaaatattgagaataagaaatatgtatggaaaagtactcagctccgtaaagaagagatggttaaaactaaagaatctggcctttcttctcttcatgaaagcatggcttagtgtgctttactaagtcaggatttagtttacaggggagggaatcccttagaatgactgattgggacgcagagaaagaaacttagatgatcgaacagttgtcgtggagagtgaaaaaatactcgtttaaaaatgctcaggatacaggctgtgagtaaagcccatggaatgtaatagtgaagttgaaaatgagaaactcaagcagggttaaacagggctgcctgtagagtgttggggcagagccagggctgccactctgcagtcctgcacccttctctgagctgcagctggcgggcagtgacttcgattggctgctggggataccactgctttctcgcgacagtacatactttgttagaaacatagtgatcttgtaacgtgagtctagagagaaccctattctagagtcatgaagggtccatggattttcctctgccttaacatgggggagtattgctaagtaagctgatggtggtcctcaagaaataaaagttaatttagatagagtcgtgatttgtagagggaaataaattacagtggtttatgaagcatgtgtgaaaaatggaaagatatgcgaggaatgtgatttttatgtttctgaactttttgaactcaagctcgctatcattgctgtgtctcctcttagaggatccccgaggggtctgactgcttcaggcgtggtgggcggtgggctgcatggcctgagtgctgcagtcctcacagcagccccgagaggcctggctgttgctgtttcctgctttgcaggagcctgttctggaagaattctgtggactaccattgggagcattaggattccaagttaaagaggactaaacaaaccactttaaacacacttgaaatgagctctgtaaaacacatgaggaaaacataagagaaatcagctcgccttgggtaaagctgtgatttgctgtctcacccgttcactggtggcaattttcatctgatttttttttctttttgagtagaggactagattacaaatgtataattttaagtaaaataaagttaaatgtaatgtttgttggtaatgttactgagatcatagtaagtattggattaatttttcattagctgctgaaatttcgttatactagaaatagacttgcgctctctgacctgtgtgaagtctttttgggctgatgttttgattgggtgctagagagctgctttctctttgatggaatgtgcaagacctctctcagccatgctaggtaagaatgaatgtttctttacccttaggtttttctgtgtagtttatcgatagcactttgtagtagttttcttggattaaaaattaagaacttatcttgaaacaagaatggcctaacattcctttgaagctgggcagtggatgcatggagggccacctgtcactctctccttttgtgtgcatttgaacatttccatgataaaaagttaagctaaaaggcaacttgcagtttcttgaatgtcagttttgagatcatattaaacctaagctttgagattgcgtaagacgcttccatcccccaggcgaggatctgtgttctgaggggctggtgttgtttatgcccctttgctcttgtgttgctccttcattacctgcctccctttcagtgtaagaatgtgtcctccagccaccactgcagttgctggttgtttttataagcttgtttttcatctgtgaaaccgtcagccccctgcctcgggacagatttcctgtcttgggatataggcaggcttgaacagtttgatgttgcgtttactgctttgcactgcagtggaggttttcacttgtctgcggtgcccctccaccattccaaggaaagaacagtcaggggagagttcttacccacttccagaggctgaactaaatcgagctctttatccagttcggctctgtgatgggcctcggtggtgaagaatgtggtaggcgccagttgtagatttaggtatggtttttctcatagataaggcatgagttcatacttcactctttgttcgacaccgctggaattcctggtgactgctgtgcttttagtcttcaactgctggctgctgattggtacagccttgagtgctgaatgctgttctcagagtttggggatggcgtttgtgaggtgattgtccccatcatccttcatttctgggagaggtgacttgatttcttaaagtgctgcttctgcttctggaaaccagggacctgtacgtctggcacagtcctgatgctggcagctaaccttggctttggaccagtcaccgagtgtatttccaagacatgcaagaaattatatccaaatgtattgtacacattgttaaatattttcatataccatattttgtcaattcaaagacttctctttttaagtcattttaacacatctggaagtacgtgtatcttacagttgatggtatgccataatgtaattgacagtatttggtggaatataaaggcattgtctaatttttggcatcttatattggttgacatgaggaaactgaagcttagagaagatatttacccaagatcacagcactcagaaatagtaaagttggagtaaaaattgtgtctccgtcctttggcaagcatttctccttctgtaaaggaaattataggtgctcttagagagcggaggagagggtattgttggtgtgaagcagcactccagagtgtcctggttttggattgttagggtaatttcagaacatgggatacaataaagtaatcaggtgattaatatccaagatactgatgggtggtgctttggctccaggcatcagaaagaggccgttaaggagcatggtgggcatagatgactgtgcccggccaggtcgtgtgtgcctggatggggtctcttctccctttgggttagggcagtgggggaactgtcttcactcccctccagttactaaattttattgacacgtaacgtacatagaaaaccagttcatgtattgtgtgcatacagcgtgatgtattgcatgatgaagttttatacatggaacattcccgtgtaagcacccagatgaggaggcagagcatgaccagcctccaactcctcgatggagcttgcgttccccaaggtatctgctgtcctgatgtctgatggtgaagatgagttttatccatttttgtattttttttagcaatgggattctgtggcatatccttttgttgttgttgttgtaacgactggcttgtttttctcaactgaatgatttagattcccttagagtgtcatgttgagtccagacaggtaacaagctacagtttcaggagagctttttaaaaaagggaaaaaaaccccacaatgataaaatagtgatgaaatccatctcttccagcttcctgtaacactactgacagtgaacggacccctcactcagctgccgtgattttaggctgaacgtggtagtatagagtgtgtagttggaatatagccttttctaggacacccttttccagccagtcccatgcatcttgcgctctgatggagcacttcttggcatgttctaagtaacctgtcttgagagtaataggcagaaagaacattacagagcccacatgtccttcagtgtaatgactgctgaagaatggaggtatgttgcgacgtttcacctggatacctggatctgaaacagctgcctgccccctgtacccttccttggattccccgctctcttagacgccgccctttctttctggggtgttgcattgatgaagtaatgtcagtaggcgtgcctccctcacccgtaccttaagtgtagagcgtgcatgcatttgcacactcaagactgaggtggaactccgctgcctcttgatcatacctcatctcccctctgcttccattcaggcctgccctggcctcagccctggtgctggctggagcctcagggctggccaagggtgatctcgggcacctgacctgggaaggggcctgctgcgcctgcgttgctttgctcaccacagctgtgttctggcattggagctgatcaccagggtgcatgcactgtgagcctgttttccacaaggccggcgtgcccaggtgacgttggattacttacaggagagcatggtcgcgatcacagcagacagctagtgagtggagatggtggtttgcaaaaagagaacttgacatagcacagtgaactcgggtcacgtttcaccacacaagagcaaggaacacgtgacagtttctggatgggatcttcagttgcaatggcaaacttgaccctgccccttgttggtcacagggcccagagagctttgtgtctgcgctggtaattgttcgctggcgcttttgttgccaaacactgaagagaggcttcttgattaaatatgaaatatgcattaagtatttcacttatgaatttgaattactaaatacatatttataattaatacttaatctgtaaacacatttaaatagataagtattaaatatttttggaataatattacagctactccttattgaggatctgttgtgacctctttgctttgatgctttaccttttaaaaatgttttttttttcagtgatttatacattcacttaaagtcaggtgattcgctgagacctgctattaggaaaaaacagtagggacggccacttttaatttttttccactagttctttttttgttttgatttttatggtgcatagttcatctatatttatggggtacacgagctgtcttgatacagacatacaatgcgtcataatcatatcagagtaactgggggcatccgtcccctctagcatccatgacttctgagtgctggttcttaaggagtgctttctaatgcggatagttgttaagtttggtgtcctgcggggctgagggggcgatcttgctggaggattgtatttggctgtcctgctcctccgttggtgctttgtaggtatttgcctgtgtgtctctaaataaagtgccctttttttttgtttttccttaatttggggtgatatcaatgtggactcccacagagaaagaggggctggtgctgttttcctcccctggccccttgacctgcataaatgcctaggcctgtcgtccccatggctgagttccaccctggtttcactgagatcggtgttcagggtaacatgacgaggcgaataatatttggagcagagccacgttgtatgctatgactgttcttacctttctaatattttgttttcgagaattagtaattctcgtttctttgtttagttttctgtgtatgttttgcaggttgcagatctagtcttttgcgtatttctaagggtctctttgacattcaaacacattaatttttctcttctcttcccgattaactaagctcttggagcctgtgccctacttgaatctctcttggttgtgagccaggctggccgcacagctgctgcctctgagccgccttccattgtcacctgggacactccccctgactgtgtagatctcctctgcctctttcttttcagtttttttgttaattcccctgttttggagaagcacatttttaactccttcagaaagtggtgcgtgggaggtaaatttttgagatcttgtatatctgcaggtgtctgttttattaataacttttttgtctttagttttcagaagtttaatttatggtatgaattggtttgaatttctttaggtttatactagttggggttcacgcaggttcctggattggtatatttatgtcttctgtcaaatttgggatattctgagccatattttcttaccctgcttttcagctctgccctcttagactcagcttctgagactgataccagtgtttgaagttcttttatttcccacaagtccctgggactgagtgttgctggatgggggggtgatgattggcctgctagtggtagagcgggggctgtatgtcaagaagtgtgggtggtctcaggccttccctgtggctgggtggagggcagggagaagccagtgtgggcagatggaatcacctgctgccacctggtggggatagaggcctggactctgctgatgtcactggtggggatagaggcctggactctgctgatgtcgctggtggggatagaggcctggactctgctgatgtcgctggtggggatagaggcctggactctgctgatgtcgctggtggggatagaggcctggactctgctgatgttgctggtggggatagaggcctggactctgctgatgtcgctggtgttccctagagctctgaacgttctgtgcagtctgtgggacactgcgttgcaggtgggctgggctcgcttaccatcagtggtagggaagaggggtgggccggggctgaggtctgccaggcggcccttttcttgctcctgtgccggcacgagcaggcttctcctagggttgtcaggctgtgcgctttggtagttctgcatctccagcctccagagctctgtccggggcagatggaaatcaaacaggccccagcccctctgccttcctctttctgcctttcagaaatctgaaaatatgcacagtttctgagaaaaatgcgaattaaaatacgaggtactgtttcttgtcagtttggcaatattgagtgttggtggaagtttgaaatgagcacttttagatactgttgctggggatgttgcttggtgtagtttgtagaaactttttggaggacaatttagaaagatgtattaaaaagttaactgtaataaatatgtcttctgaccagaatttaatgtatagctggtttacaggtatattcaaagatagacatacaaatatttttaatgcagccttgtctacacaaggaaagtactgtatatggtatctggaaatatactggaaataatctaaaaatccactaatggagagtgggttccataatgagtggtatagtcatatagcataacattaagtgttatgtaagcaccagtaagtactgccagataaatgacatgttgtcttaacttttgtgacttgtggagaagtgcgtgtagtgtgactctgtctctgtcacatggatgtgtctgattaggcatcacagtggcagaccaggacctttgaatgctgtgaagagggtgtcctctggggctggagtggtgctggtggtggtcatggggcactggaagggaggaaactgaaatttctctaaatgtatttctactgttgggcaattatgctacctttgtactagtaaagtataatccattttataatgaagtagactgttcttggtataatttttctcccactcttcttccccttttaggacatgaccgataatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcgaggtcaaggccagcggtaagtggccgagcctgggctgtgtgtggctttttgcgatgagcagaaagaagtaaatgtacttgacatagtgtttactctccagctggacctgtgcaaatgacctggtcttaggatacagttttttgttagatgtaatggattttcacctcagccccacattggggccctggcatcaagggctctctagttactagccagcatttcctttcatcctggcattttccagacgtgaagagaaacatctcgaatctttatcattgcagttttactgtgaaagaattgatctttttttttttttttaagagctagtgtcaggacttggagttggcagtccgcaggctgtgtttaatttttgtgactatgggtggtacttttggcagtggtgtgcaatgaagtaatttctgtcattctctttgtactagtgatagtattttacaaatgcattgcttccttatgttttgtagttgttcacattgtttcactgactttccgattttgaggcttgtgttcttatgaaagaatagtgatcctcggcacatggctatggctgccgggctgtcgtgcttcttgtggaagcgtgtgggtgggtggacagaggtggggggtgggatttgtgaagggaacaatcatgtgtgtcactttacttgcatcctgccctgtagttgaaaaacaccgttgtatactacagttcctcagattctgctggggaaagagtgacttacagagaatagctgatacacagggagctgtggaaaggacatgatacaaaattgtagctctgctctagggcttgggtgactgagcctcagagccacaggtgtttcatatggaaaatgaggatgatagttctcccttgtgcggtcttgtggggttgaattgttaaggtttatactatgtgtatggagtctggcagagtaggagctcagggaatgttaatggctgctattgtttttctaaggtagcaagaaaaaaagatttacaaatgggaatatgacaattttgatgtaaaaatattttctcagtgacctcagaaaacaagtattttaataaggcagatggcagcccttatttgtaaacttctctggtgttggaatttttaggaacagcacctgcctgttcttattgtatgtatatgtatacatatatgtaaagcagttcgccatttttaccagttctaagtgtactgttcagtagcactaggtacattcacagttttataaccatcaccaccgtttatctccagaactgtttcttctcaaactgaattctgttcccattaaacagtccccattcccctccccagcccctgccctctaccattctgctttctgtctctgaatttgattaccgttggtgcttcgtgtaagtgcagtcattttgtcttttgactgcttatttcattcagcataaagtgctggagggttttccatgctgtagcatatgacagagttaccttcctttgtaaggctgaataatatttcatcatatgtatgtacaacattgtgtgttgatgggaacttgggttactttcacctcttggctatgtgaataatgctgctaggagcatggttgtgtaagtatttgagtccttgcttttcagttcttttctgtatatacccagaagtggaattgctgggtcagatggtggttctgtgattaagtctggaggaactgccacgtggttttccccagcggctggaccatgtcgcattcccacaagcagtgcacagggttctgctgcttctgtgttctcgccaacttgtttttttttttcttaaagtaatagccatcctgttggatgtgaagttgctactgttttttgtagttgttaataatgataatttaaaaggcagtattttttattataataaatcgacttgggcagaatttttttccggctgcttgttatgttccagttaatgtataaagtactttccatttgcaacttcagttctcctcataacccttgaagacaagtattgctgggatattaagaagggggtgggttgcaagtacatgacatcctttaaaaaaatccgttcatgtgtagagcccactgagagcgcggcactggcaccatgctgaggcgtggaaatgtcaacttgatagacatcactgttaggagatgcagtttagtctgtgactcagttggatggcactggcctgcatgagccttcctggagacctagggctagggcaggcccggtccatcctgtgagcccatctcctagcccagccccaccagttggagagatctttttcctgggaaccaatgagagcagccctgggccgagaggcctgaggtggcgccagtggactttccaggaggacacttgagccagggcagaggaaggaggacctcgttcgttgctcacctttgccaaggagagttgaggttacagaactgctaagtgggacgcacctttggagtagggacagacgcttgttccagctggtctttctgactttctttaattcttaagtgaactcctcctttaagtgtgaatcctggactgactctgaaccaccacagtaagagtgcaggtgagtggggttttacttttcatgtatttctccttgtggattttttagaagtaacccagagcaaggaaattacgctgaaaagatggggtttgtggatctcaaaatcctctccagttggaagtgattttcagacacatttgaatgtcgtcagtgtcatctgccgtgggaatttgtcttgcagtatgctgttacccctgatagcccacaggaaggcatcgtgagcccccgcttttgagtggactgtgggcccttgagctggcagcagcagaggacgccctccaaaggaccggcagggcgtgtttagaaacatggctctcatgaggaacagtgctctcactttgttctacccgaagccactactcatgtcttaggcgtgtctgagcgtgtgtgcgtgcccggtttcaacgtatgtgcgtgtacatggtgtgttgccatcaaggagctctttgcaggggccacacggaatccataggtgtattagggtgctttagagggacagaactaatagtattctcctgttagttatatatatagatatagatagatatatagatatgaagggaactttattaaggggagtttattatatatacatgttatatatatataaaggggagatatatatatatctacatatacatatatacatatacatccccctattgtgggaccttgtgatcatgtaagttaatacctaataaactccctttcatatatatatagatatatatgtctatatatatctatatagatatatatgtctatatatatctatatagatatatatgtctatatatatctatatagatatatatgtctatatatatctatatagatatatatgtctatatatatctatatagatatatatgtctatatatatctatatatagatatatatgtctatatatatctatatatatgtctatatatatatctatatatatatctatatatatagatgtctatatatctatatatatagatgtctatatatctatatatagatatatatatctatatatatagatatatagacatctatatatatagatatatatagacatatatatatctatatatatagatatatatctatatatatctatatatagatacatatctatatatctatatatatagatacatatctatatatatctatatatagatatatatctcccctttatatgtatatatatatgtatctcccctttatatatatatataacatgtatatataataaactccccttaataaaccccttgatatatctatctgtatctatctatatatacagctaataggagaatattattagttctgtccctctattacttctgtccctctaaagaaccctcatacacctatggattcatatatgtatgtatatgtgtacgtgtacgtatatgtgtatatgtatacaaggtcccacgataggccatctacaggctgaggagcaaggagagccagtccgagtctcaaaactgaagaaattggaggctgatgtttgagggcaagaagcatccagcatgggagaaagatgtaggctgggaggctaggtcagtctcgccttttcacgtttttctgcctgctttatatttgctggaagctgattaggtggtgcccagcagcttaagggtgggtctgcctttcccagttcacggactcaaatgtgaatctcctttagcaacaccctcacagacacacccaggattaatgctttgtgtccttcaatccaatcaagttggcactgagtattaaccatcacaatagggtttgtgccaaactgagacctaagtaactttggaaaatttccctttttttcctgtttattttttaaaattcaagaaatgtcatttttgagcatattagtgatgcatttgctaaactttatctgatggttgaaccaaaggaataaccttctgtccctgttgttctctaattacctaagcatattgtatggaaagtcatgctagttttattttagtttatttatttttaattttattttactattttattttgagatggagtttcactcttgttgcccaggctggagtgcagtgatgctcactgcaacctttgcttcctgggttcaagcgattctcctgccccagcctcccgagtagctgggattataggcacgtgccaccatgcctggctaatttttgtatttttagtagagatagggttttaccatgttggcaggctggtcttgaacttctgacctcaagtgatccacctgcctcagcctcccaaagtgctgggattacaggcgtgagccaccacgcccagcccagtctgagtttaaccgtgggcatttgaggcaagtgtgaaaccacattttttaccgtgttactctagagcagttaagaataaaactctaggatcacaattacattcagtacagcagacttccctctcacctctggctttgcgtaatgtggttacaagtacctgcagtcaactgtggttcgaaacaggtgagaacaatacagtaagatatcttgagagaagagaccacattcacataactttagttatagtatattgttataattgttctatttcattattagttgttgttaatccattattgtacctaatttccagattaaacacacataggtatgtatagatgggaaaacatagtatatatagggttggtatatatacagagatatagctgcagtttcagacatccagtgggcagtcttgtgggtacccccgtggataagggtgggcggctatattgcattttttccagtagtttatgtggctttctgattttggaattaggtttccttttttgaagagtgtgttaaatgtattttgatttatagttaattagtgcttgatttttctgaaaacaaaattgtgccaggttccaaacttagagacttctctgaccatcatgttaggatcatttctttattcatgaaaacactgacttcctttaaattgagggtttctcttctgaattatattttaatttgatgtacaaatagttttactgagtaaacaagaactgaagtttttctctaaatggcacttttttaggctgtttatctccagataaattgaccagatggtccaattcacctctcctgcttccctggggaagtgtagccattggtggtttgccctcttgtggtcggagatggaattgttcttgtcaaggttcaccgttgtgttggtgcttttaacctgtggtgtaggatttcttgtttgaatagtccctctttgaagacagataaaatgttctaggattctgtaataacgatctttctaatgcttgtgtcaaaagcattgtatattattcctgaatatgtacagtacagtcttatggaaggtaaataattgtcacttagcatttattttctgtgcaccttttttggttaggtaaaacccatggatttctatagcattttttttttttttttgagacagagtcttgctctgttgcccaggctggagtgcagtggcataatctcagctcactgcaacctccacctcctgggttcaagcgattctcctaccccagcctcccaagtagctgggattacaggtgcccgccaccacgcccggctaatttgtgtatttttagtagagacagggtttcaccatgtcagccaggctggcctcgaacacctgaccttgtcatctgcccgcctcagcctcccaaagtgctgggattacaggcatgagccaccgcagccagcgtctacagcattttttacaggctgatatgtatttgtgtttcacacccacccacccaccctcactcttactcccttgcttcagaatttcctaaattcaagggagaagttaaggagagaagcagcaaggtccattctggaagtgagtggtgatggtggttgctgtgattggatagaagtggaggcactcagctgcatgtggcacacacggttagcagctgtgagaacacacctcgtgctctgtgtgcttccaagaccagttttctgtgtgtgcatgtggactcaggcttttttagatgattatttctaatgtgctgactttagtcattctcctatttctggacagcttattatctgttgtaaagacatttcttttaaatgctgttttgggggctggttagcttgagatgatgactgtctgtgtttggcagtgatgtgagagcttaaatgggactgtcatttgctgatccacagatctttaacgacattgccactttttaagttggtcacttttaaatattttttacttatttttgacataaagcaacacgcagctgaattttggatgtcgttattaatttagctgtggaggaacagtgtttgatgtgagtataatctgtgcggggaaaaggacaaaagtaccccagaaccttgccttccttcgtgccactggatgtgagcttgtgctgtagtccttcctcctctccggtgaggattgggtttggatgggacacatgaggctgcattacaggatggacctctcagcactattgtttcaagatgtaattgtttttaaacaagagagaagaacataaattagaagatatgggccccccgaggcaggcgtagggagcgtattatagcattatgtacaaaggggtcttggagtagatggtttggaaatgtttctggcgtgtgaaagtgaatattttcctagattggtataccgagcatgtcctcactgcaatgtggctgcctcccgttgtcggtgatgattacacatcttccgtttcaggagcacgtcccatagaccagctgacttagagtaattaggggtcaggttgttagtcttccagtattagagcttctcttttttaaaaaagttttatttgcatttatgcttaagtaattgtattacttacatgccacatgcttgtagcatgtgatagccagtagacggaagagctcatgtggggaagagcacaggccacccactcccacagccctgatccagggagaggcgttactcacctcctctcctctcctacgtagctgcctcgcaactcttcacagtatgcagagacttctctgcttagatttatagggcgtatctcactttattgcactttgcttgtttttttgtttttttttttttctcttacaaatggaaggcttgtggcaacactgttggtgccatttttccagcaccatgtgcccacttgtcccagtgcttcatttgggtaattcttgcacgatttcacagcttttcattattgtatccgttatggtgatctgtgatcagggacctttggtgttactgttagaattgttttggggtgccatgaaccatgcccatgtaagatggcagacttaattgataaatgttgtgtgtattctgactgccctactgaccgggaattccccatgtttttccccaggccactcattccctgagacacaaaaatactgaaattaaaccagtttataaccttactatggcctcttaagtgttcaaatgaaaggaagagttgcatgtctctcactttaaataaaaagctagaaacgattaaccttagtgaggaaggcatgtagaaaggtgagacaggctgaaagctaggcctgttgcaccagtcagtcgtgaatacaaatgaaaagctcttgaaggaaattataagtgctactccagtgaacacatgaatgataagcaatgaaaccaccttattgctgatatggagaaagtttgagtggtgtggatagaagatcaaaccagccacaacatttccttaagggcaaagcctaatctcttcaattctatgaagactgagaggtgaggaagctgcagaaaaagagtttgaagctaatggaggttagtgcatgaggttgaaggaaagaagccgtctccagaacatgatgaaagtgcagggtgaagcagcacgtgctgacggagaagctgcagcaagtcatccagaagatctagctgacatcatcggtgaaggtggccacaccaacaggctgactctctggtctggggttaatgtagctggtgactgagttgaagccaattctcatttaccattctgaaaatcctagtacccttaagaattatgcttaaccaactttgcctctctgcgctgtaagttagaacaacaaagcctggatggtggcacatctgcttgtgtcatggtttgctgaatattttaagcccactttagagacctcccactcaggaaaaaaagattcccttgagcatgttactgcttattgacagtgtacctaatcacccaagagctttgagggagacatacaaagaaattaatgttgttttcatgctgctaacacagcatccatactgcagctcatgggtcaaggattaatttagatttttgggtcttagcatttaaggaatacattttgtaaggccataaatagtggttcctctaatggatctaggcaaagtaatttgaaaaccttctggaaaggatttacccctttagatgctgttaagaacatttgtgatttatgggaggaggttaaaatatcaacatcaacaggagtttggaagacattgattctaaccctgatggatgaccttagggcctcaggacttcagtttaggaaggaactacctgtgtggtgggaacagcaagagaactaaaattggaagtggagcctggagatgtgactgaactgctgcagtctcatgagaaaacttgaatggatgaagagttgctccttatggctgagcaaagaatgtggtttcttgaaatagaatctacccttgctgaagtgccgtgaacattgttgaaataacaaaagatttagactgttgcaaaaagttagttgataaagtggtagcagggtttgagaagattgactcttaattttgtaagaagttgtatgtgtgtaaaatgctaccaaatagcatctcacgctccagagaaatctttcatgaaaggaagaatcagttgatactggcacacttcattgtcttgtttcaagaagtgtccatagccaccgcagccttctgcagccactgatcagtcagcagccatccatatcaaggcaagaccctctacaaagagattacagcttgctgaaggctcagatgattgttagcatttttttagaaactttttttttaactaaggaatgtactttttttaaagacagtgcaattgcaaacttaatagactacagtatagtgtaaacatagcttttatatgcagtaggaaacaaatttgtgtgactcactgtattgccatggtctgaaaccaagccctcagcaacttcagggtctccctgtgtaccccgtttgacttaccttcttcctcctactttcttctaggtttgttctttgtgattaatttgttcttctgttggtttcctctgttggtgtgctaaacgagatgctttagtcttatttgtatttcagtgacatttggcagatacctcctgatgccccattttgttccgtgaagattcaccttgacccttttctctatcctcccacattctgcctttactcacctgtatcttcctgttgcattgtcaaggttgttcacagttacaccagttacacttggctctaaagccacacccagcatccattccccaaatacttactttggtgagcactgttgtggaaactgagaaacacagcagtgggaaaaccaagagtgtcttcccagaagttatgaagcacatctgaggtgtcctgcacggcacatgaggtaagcgtgcaggtctgtgctctctgctctctactggcatccaaaaaagaggagggggcgcttttatagaatgaaagagactttagtggcacagcagccagatgtgctgcgcagacttcatttggttcctgattcaaataagctgacatcagaaagccattgttttgacacacaggaagatctgaatatagactaggcattagatactatttaaaaattattaatatcgtcaggtgtgataatggtctgaggttagggttttgagtttaaagaagaaaagctccctttgctaacactgaagtgttggtgagtggagatgacctcatctctgagacttgctgatggtgcttccagcagagaacacggcgggagcggatgaggcaggctcgatgctgaggactgctaacactgttaagagtctatacgtggtcattctctgtatgtttatgtatatttttaagtttctaaaagtttgggaaaaagtaatggcacaattataacattttcgaacaaagatcgagcgtcttagcagatcatcccttgaacaactcggaggacgtcacctgacaggagggtgcatgtggttcaggaaagcggcaggcagacactgctgagcacgggcagacacacacagacattgactctgtgaactctgagtgcgtgagtaacagccaacaaaccacgcacagagccccagcacagaaggtcggaagaggacgtgggaattccgagtttttcagggccatgtctgctctggtggttgaagccagcggtgatgattaactctggactttgctgggttggtgacacgtcacaaatgaaagcgtaaccactgaaacagagggaagcggctgggtggcttccagtcaagcggaagaggcaagtgaggactcacagaagtgtgttcttctcaaaagaggcagaaattcccagccctgtgatggtggagctgcctcggagtggggagggcattgcacctggctccccggacctggccctcgcccagctgtgcagcgttcctgtgtgtcttggtggactctggttttgctcggggctggctgtgcttcctcagcccaaggaatccagagctcttcagttccagaaaggatcttctcaaggactacttccagctcactccctgatttttctcctgaatatcttactagatgtcttattttgccctctgttttaatccgcgtattttaatctactttgcgtatctgtttgtttcactgtgctgtattatctattcctctgcctgtcagttcattaattccctcctcacggtgatactaacctgtttgtggagatttccattttagtgaccatatttatttgtagaagttttgctgcgcttcagatgttttcagtcttcatggcgccttttttattcgtcgtgattggtcctaattgcgtatctctcctgtcattttaaacgacagattacattaggtcttgattttcctcttatttctactttggggaacctggtccctttatatgccacatccactcacaccctcctggtagctcagtaccttctgtggctgatactgtttaatggtgggcttattcctgatggtgggttcctgtgtaccctgggttgtagaaatatttctacagagaggagtaacatttgcttcttaggggttcccggagacttttttgtcccaggcaggtactggtagtcctgcaagaggagagcataggttggagtggtcctgctaagcaggtgcgggctctgggttttggtttcttctaggctgtgcccccgtctgtgagcagcctgcacacttccttgctatttctctagaccagtgcatagaagcttccagacatctttgcatcagctgtgcgggttactaagggatccagttttatttgcttgggttggagcaggtctgttttcttcctgcgttgggtgtagccccagctgctggagcctggagacaggtgtgtctcccctcccctagtgagagggtttcctctttgcttttggcatgtcatcccctctttttcttttacacgtctatatttaaattttcttgttttcagcatttttcgagtttattttaagaaagggaagacttgctgccccagtcagcccttggaaaggtagcactaagctacattctcttggttccccactcctcaataccagtgaattttattaatttttagctaccagatgggccaaaaaatgctgcttttcttaggatagtagggcagttgagtattttctaatctatttcctggctgtgtgcttttctgtctgttacgaatggccgtaatttagcctcttttaatttcaatgctgttttttggtagaagctactagaaggcttcctaggctgcccgggagttacctgtgcccctgctgccccgcacccctcctgttgatggcacatttcttctggcgtgaccgccccaggagcctggacagtggtggggcaagcaaggagctttgcatcagaagccaggagtggccttgctggggtctggcagccaggggcttcctgtctcccctgcagggtctcctgacagcagacccaccttgggcgtttgtggaaattacgcttcctgattggaagcaagggcacgttgtgggtggcacacttcagcagtgccctcttgttgaaaacgaaccacagggtgttctggggaacgtgatcttgacaccttccattcagcagccagcagaattgggagctcttttttcctaggggagaaaaggcaacctgcctggacttaatctgatttgactgggtttcttctgcctgttttttatttttatgtaatgttagtaacctgaagctttttcttttgaaaacttttttcttacagttcttatagtaaattaattgaattttattaactgtggtgttgagttgtgaggtatgtcttaagtttaaaataacacagctggcaaaatcattacttttaaaataatgcagattcagggtcactgttacgaagttcacttcaccggcacacatgctgacgtgcggcttatgatcgcagtggctgtgattgaggtgtggacagtctcccctgcaatgttgttttctatcctgcctccaaattgtagatttcaaagatgaaaaagtgttgtttttcctcagatgaaaacatttcatagtgttttcttctacaattaaattcttagctgtagaaaagagattgagtaggtaagtgtgctagcaagaatagattggttttcctccttgtagctcttacagtgtagaagggatttgtttcctgtggagttttgttttccatcctgtgggcagagagaattcttgcaacttgcagcggcaccttattttgttgttttcaaccacctggaagtacttaacagtgaggcattgaaggaagatttagaaacttgacagtgaggcattgaaggaaggttgaggtaaacggctccacaggaggaggatccaaagttaaggagcatgaggttggttcggggcattctgggtttctgttgccagaagatggtgcagatcctgaggaggcagttgacgttagggacctgaagccttagagtgtttggggttgaaggcactgttttgggatatactacctcagaccccaggacactgagattgtggatgggggacgcatgggaggagaggagagcagaaggcatggactgtaggcaggtgctgctcacacaccagaggggaggagtgtgttcccgcccagtgagggggttcacatggcaggattcttgcagtggaggtgagctttgagggaaaactggtagggactaagtcctctaggaaatgctcatcagaatttcttggggaagaatgtgggaaaaaacctctccctttcctttgtccccactagccccaatttgatacactgctctgtagccctggaaaaccagtggtaaacagaatccgtagaaccaatgttagatatacagaaccaatgttagatgtacagaacgtagaatcaatgttagacctatctgcccaccccctagaactgttggtagatctaccccatggaactatgatatacacacaaccattgatagacccaccctatagaattgtgatagacacaccctatccatctaaccattaatagaaatacacacatacccataaaaccattgagagacagagggacccaccccatagaaccagtgatggacgccatacactgtctgcagaactaatggtaaagacacagacactgtctgtagaactgataatagacacacaccaccccatagaactatggagagacagacccacccgcacagccagcgatggacacacccacactgtccatagaaccagtgatagagaccccctcccgtagaaccattggtagacaggcccaccccatagagctgatgacgggcatgcatggtgccaggttttgtttggcaggtgtttcttcggcaggtgtttcttcagcacctgttatgcagagtaagtgtgtgttgaatggatgtggagtgaaagcggtgctgttttaaaacatcagaatccttgctggagtcaggactgctttaatggttttgcctggtgtggaagtgaaggcggtgtgggtttttcttgtttttgcccctgcttgagatgacttttctttctcctccttgtctcctgtgagtgatggttatttcaagccctgagccagatcttgcttgtttagagagacttttccattctgagggatctgagtccctaacttttagccctgatgttttaatattgttatgtatctgccaaaatgccttttatttgggtgacgctttatatttaccacactatggaattgtccttgtagctaaactgctttggttttggctggcattcgtggagcagtctcttagacgccttcaacttgaaactgggagaacagggtggggatggggtgctgtgattggccttggtgagccgagcctgagggactgggtttctggggcactgagggtcactgtggatggccttttccttggcttgccatttggcttgttaattcagtgaggctgctggatgagtatccttggcctgtgtgaggggctggaacttttgtcatctttagtactgatcagtaaaactatgttacattttcatttcagagaagcctgtgtctcccaaatcaggaacactgaagagccctcccaaaggatttgatacgactgccataaacaaaagctattacaatgtggtgagtaattgcagaacatttttaaactaactggtttttgactgcctgtaaaactcagcaatgtagaatgtagtgtaaagtacctagaataggaagaaggaaataaagttcattcatctgccacacaaatgtaaccaccattaaggttttggtctgtttccttctaatctctgtatttttgtaattgtatgtttttgttttaatatcatgtatatggaaatgtcccttgctcttgtcccgtaacatagtaatgtgcgtgtttccccatgccatagccagtcttcaaaaatgatatttgaaaaaatgtataatgtgatttgaaaattttatatgcattgagtgccattctgtttgtattcagagtagactgtaagtactttagacataaggcttctaatttattttttctcttaatatagtgtttcccaggattgatgtgtacatatcacatggcgtagaattaggggagcatgtctaaacgctatacgtgttaaagacaggtgtttctggatcctaaaatttgctgcttaatatgttcagtatgtgatactaaatctgtgtagtctaatgctattaaatcaaatgtatagtctcatggtactaaatctgtgtcgtctaaaccttctttgtacctaagcttatgtagcaattgcatgttctatagaaatggaaaataatttattttaaagaatttattaaaattttaaaccactcaacatgataacaacaaagtaaaccctctaaacatgtgtatgttttgaattctggggaaaatgcgcatttgttttgttatttcttcccctactcccaatcttcattttcttcttgagtagatataactatgaacccacgagacctttgaattgttggtgtgaaacagcagttgattggtgtttttgtgcagcagtcattttcttgtgagcatttcattttctgcacctgtgttgggaaacggtgaaaaggtgtggtgcaatggagtctgagcagctccaccacgtggagctgtgccaccgtcttgtgctgcggggcttgcactctcagcttcctcctgagtgcccaccttccatctgccccagcatcgtactgcaggacagactggcctggggacccactcattaataactgtttattgggcgcctgctctgtgcagctctgttaaaggcaccaggatgcacagtgaacagaatggcgggtgcctctcccctcgctgagctcgcacttgggtacgggaacacaatggtcttttgttgcctccatttttactgcttctttttcataatttgacatctgtgcaccttcttgtgagcaggtctcctcatgcatcatgccacttctcttacattagtggcaatctttgacttatttttccttgtatttggtcaactccggatccttttctgccttggaaacccttttcttttgcttcccctctttcttccctttttttcattcatcttcatttggctgcttggactctgccttccatctcaactttgtggactttgagaagatcagactccttttagcgcgtcgtgtggcccacattacccgagacacctgctttctgtcatctctcctagtgctctgcatcgccttcatcccttggcctgttgggcatttactcccaggatttggctctactaacccattcgctttttagtgtgtaatgtagcttatgtgtagttttgtgtacgtagctacagagacagtagatgggttttatgggttgtaggaaaacttgagttttaactcctggagctgccctttcctcttgcattcttgtataagacactgcttttttggggaaggcttcatgtggtgaataacacagccacaatccacagtgagattccaaagggtgtgttaccttctgttatggttcaggtccagataattctgttagaaaaagtggtcagcagtgtttaaattggtgccaagggcattctttagtttctccattaatcttgctttcattaggcactttataaaaccaggcaaccatgcttttttagaaatcctggtgggtttttctttgcattatatattctgtaatacttctcagattgaagcatagtcgatacctttttcgttttccttctctaactgtccttttacagagagaatagcctgggtattataagtgctcttttcttcaaatcagccaactctttcatacagaatgatggaaaacaccttgacctcaaaatcacatctaaattgttttctatataaagctgcatttataaatagcacatggtaaaattacagttgttatagaaataaactcatagaattcatagagaattgtcttttgatgtagtactctcattttacagcagagaaaacagaagctaaatgccttgtccaaggttatacactggttactaagccaggaatcaatttcagctttccttaattttatatttgtaaattgtacataaaaatagagaacagaatacaacacagaacaaaacatgatagataatgtgttaggcatttctacacccccttttgtagtttcgttttcacagaaaactataaggtctgggtgtttttaacctcactgaaagttgaaaacttactaaagggtaagactggtgtggaccaatggtgttaaggaaatttacatgaatgacttgtcttaacttgggatcagtataatggagttgagagaagagtattccatgcgaaagtaccaacattttgaaattaagagacaatgagacaggtatgaatgggatggatatgtgttttcctgctattgtataatagttaagatgaacaccaaaaagacactggaaagtaaaactcgtagtaatttatgtctgttattatgaaccattcagtaactatttctctctcctctccttctgggactcctgtggtgcaattagtcaaatatagacaatatttgagccattgtcttcatactgtcctttaattttttaaacatagtttcctttagttctttggacatatttataacagctgctttgaaacctttatctcctaagtccactatctgtgccccctagagacagtttccattgactgcttctttttttcttgtgtgcgtgtgtgtgtggtcacactttcttgcatgtcctatgattttttaaattgaaaactggatatcttagacctattttagcagctctggatgcttgaaatccacctcccctgggttatactgttgctgttgctgtgtcttgctcagtgactcacctagagcacttctgtagtttatcttcccatagtcactgatgtctatttttatttttttattcttgtttttatttttaattctgtctttctaggattcacttttgggtagcataatttagtattcagccaaagattcaccaaagattgtgcttaaacacctttaacagttcaggtattacggctcacacctgtaatcccaacactttgggaggcctagtagggaggattgcttgaggctaggagtttgacaccagcctgggcagcataacaagaccatgtctctagaaaaaaccaaaattacctgggctgggtggcaaatgcctgtagtcttagctactcgggaggctgaggtgggaggattgcttgagccctggagtttgaggctgcagtaagctatgattgcaccactgcacttccagcctgagctacagaacaagattgtgtccctaaaaaaccaaaaaacacctctgacggtgaggtttcactcttgccagtgatctgtatggggttggggaatgcattcaaagagagggctggggaggagcatgactttttaaaagttaaaggcagtggatgaaatgacaaaggaaaagataaatcttttaggctacctaatgagagtttaatatattccttgcctcaaacagtataagccagatcacaagttaattggaatgttatttgcatcaggtataatacaaggttatccttaatgtctgaagagctcattaagacaaatacatgaagattaatagacaaatgggaaaggttgtgaacaatttaaaaaatggtaaacactaaggctttgaaaaaaaatagttaaactcaccataaaaattttaataggcatattttctgtaatcagtgagcagagatttaaagagagaatctttagttctaatggtggaaatgtaaatccatacagagtttctcaaaagtaatatggcagttatatatagaattctggaagtgatcaagttctttaatttagggctttctctttaatttctaaatttcttgaaatccattccagagaattaacctgaaatatattcaaagatgcttgtgtaaaggcattttcagaggattatttgttatagtaataaattgcaagcaacccaaaataaacagtatgagatgaacagtaccagaatgattaagcgatcagtggtttgtccatttgtagttactaaagtgtacatgaggctttaaaaatacaaaaaacatatattttcatgttaagtgcaataacagaatatgaaattacacaggtgatatgatctcatggtattacaaagttgacatagaagatagaagacattgtgctagagaatggtttctttccagtggaggaattttagcttcccactaatgtaagggatagtgattatgggggaagtctttggcaccacagtccagaatgtgttggagatagaaacgggcctctgaggctagggaggaagccagcgtggaacatggcaggcacacaggccttgggcttggagagtgacggggaagggagaggaaatcaagatctcttaaatgcagatcttttaatttcaattagtttttgtgacacagccagccactactcttgcctctattttctcatgtacgtactgtttgaaatcagtctgttagctgtgcttagggtgcccttgttgtgtaggtagttcagataattaagatccgggcggcttgatgcagtggaaggtgtacagcctttttgttgaatcgtccatgctgcttagcctgggtggccaggagctttggccctagcttcctgagcccagttatctcatttgtaaaatgagattggtaatgctggccctgacctggtagtattaagtggactggcaactggccttaaggcctccagcaaagtgctggaccttagaggtttttgtgtgtattaagaagagtatttaagagcattgggaacagaaggcatcactgaggccaccataccattctgtttgtaaactggaatccccgtagattttgagggtgacctgtgaaagctgtagccaaggtggcctgatcatataattaaaagagacaggtttgtgacctgatgtgcccgagcttggtggatttgacagtgaaagcacactcgttgcccccatggcatggtgactggcatctttcctgatggggatcaaaggaaggggttggatgcctaggctggagagaatgatggtctggagttgcctctcggggggatgaggagcaccccgctccgtcattagagaatgaggtttcttaagtcgctgactgggaagacacagtccttatggccttccctgctcagcgatatacactatggtttgattttttaggctttctgtattagtccgttctcacgctgctgtgaagaaatacccgagactgggcaatttataaagaaaagaggtttaattgactcagagttccgcatggctggggaggcttcaggaaacttacagtcatggcggaaggcacctcttcacgaagcagtgggagagagaatgagtgccaacaggggaaatgccagatgcttataaaaccatcagatcttgtgagaactcaccatgagaacagcataggggaacgcgctgcgtgcccctgctcccccacacccccgtgccatgattcagttacctccaccctgtcccgcccttgacacatggggattattacaattcagggtgagatttgggtgggccatagagccaaaccatatcactttccctgttatttagagcattattataatactgtgaatataatgtaataggtagcatcactctttctaatctgtaagtgtataaaacggttatgtatccttagatgccatcacacacatccacgggcctttcctgtgctccagagaagccgcacacctgtcttttcctccctgctcctttagtttgcgatggccttcagatgccaggccaaggaggaaaacctgagcctcctggtgacagggtgtcttcggtctccatccatcagcagtgaccctaaaccctggcgttgcttcgtctcttcatcttctgctttgcccttggcttttctccacctcaatgaagatttctgttaaatcttttgactcctgaagtctctgcttggggcccgtaggtggagatggttaatgatgaggggccctgaggtatcagggagggtgtgcagcttgtgggatcccctcttttcctgggcggcgaggtgcctgctggcttctttcacacctggctcccattgtttttcatgggatttccttgctgtatctggactaagatgatacagatgaaggttgtcaggtaggcactagtggaatgctgacacggagaggagctcagtgtttgggaggattgagtgacttaattgcaagaaaggctgtcttgtgaaataattacctcctgactgaaggagtcatttaagaagcagctccaagtaagactctacattgggctggaaggtcgaagggtgactggctagatgccttcctactataagccaatgactggcactcttgagtaaccattataacctcgtaaaacccctttttgtgaaaaagggaaacagaccgatagacttgtccagctgcagacagtcagtggtggagcgcagctgggagcccaggtccacgtggctgcagaggccggctctacctgtcgccatgctgctgtgcaggtgccattggtggtgtctgcttccccctgtgtgctggaggctttgcaggagccattgcctataaacctttaacatttaggagaaacgtaccccaagacctgtgaatctccaaatttaaaagtaatagaataacatttatttcaaaagatacagcatcataaaagcatttatgtggtctctccaaactttttttgagaactaacgttccgaggtattggtaaggaccagcagtgctaacacaccacattaaatcagcaaccgtgtggtcggggagccactgactgcctcatgtcattgtgacccgtagaggagccagcaggagcttctgggatttcttgtcaacactccttcctcctcctcctcctcctttccgtggagtcagatgtttattacaggccacattgtgtggtgaactactgtcttgtaatgtactttttgaaaatttacttgaagtgtaaatagactggaatggagaacattaaatgatgatcttgtttctctgtagcagtggacagggaagggctgattaggtagggtggaggtagatttggaataattgtgccactttttggtttttcttcttggacttatacattaggattgggatatggaaatacagttgtatgatgataaaaatcttttatacagatgaaacaaaaaaaattaatgttctttgttctcttatgtaaatcagttatttgtttttaaaggctgttgatgacataaacatataaaacacctaccgagattggcagtggaagttgtaacccatttgtaaaatcagaaatgctaagtactcctttaatgatgcaacgaataaagtgtctgtgtctgcgaggcacagcagtgagtcctctttgttttgctgtgctctgaggcgggcagcatagggattgagtggcaccagtgtttgactgcacttgcctctccatgcctcgtgacccccgggaagctggcactggctgagctcagctctgtgggcctttcttcagcactgtgggtcgtaaaagctgccttttctttgaaaactgcctgcgtcctctgggttcccagcgttggtgggatggagctgtggcgtccaggctgtgaggtctcatggggtcctgcagcagccagagcgtgcagaagacgaggaggggaagaaaggtggtaagtggcacccccggctgcgccccgaggtcaggaaggccagcaacctcctggcagagggagtgggcaccccagctggagtcagggagccaggcctggctgtgtgtttgaggaaaagttaagtgtaacttgcattgtttggttgggagtaatacaggaattgtgtttagcaccctatttgaaaatagtgtttaagactatttgttgaattaaccaacttaactattttaacaaatgtagctttttggcagagggctctttcaagtagtttttggtgcttatgggaagctttcatttctacaaccagcgcttagtgctgtgacggacaaaaggtcattgtattttattcttctcatattcgtgctagtgatagtttctagtggctgctttcttatctcacataggaacatttttctgtttgaaaataagtatataggtcttcaggtgtgcagtgagcagtattggtaagttggtatccaatatttgtaattaggaagctaaatcatatttcctatctttaacattgaaaaggacttttctgatacgtctgtgacagatcttatttcatcttatttagctcaagatctcattatgcttggctggcttcccctgttgttctggaggacaggcctggtttcgagtagcgtctctggggtgtggtggctggcatcacggtttacctctgctcaccagacctttgacatttgtgttcgacgggaatttcgtagaaggaagacattgtggttgtggggtcagcatttcccatgaagagccagctccctgcagggcccctcgctctggctctcccacggtcgtctcccttgaatagatcccttcagggatgagcctgagttccttgtcaccagtggaagagcctctgttttttttcgcccaagtagtttagtaagtgatttaatcagatttgcatttactcaggaatgactgtattcctttctcagagtttacagtcaacagtaggcaaacagagtaacgacccgggttgtctttactaaggctgaaatttaaatttaacttgatgacttttttcttaaatgtttaaatttacatttggattatcaaaaatgatggggacagactgagcatgtttaatatctttattacttctgtacaatttcttttgtatgaataagtgagaatgtattgttagctctgggagacaaatagcacatcttgatgcatgtactagatgcgcagaaaatacgtgtaatgtgatttcctgatttaaaaagcactagctctgtaacagactcgggtgaaaaagaatggaggcagggattccactttcttcacttacgtcaggtccttcaggatcctcagcgtgctcctcagtctcatgccaaagaagacagtgtggtgcggtgcagtggcaggaggacctggggccgctgtctggctctgcttttctcagctgtttgagttgggagaagtcagcttctctaagaggaaaagttttgtgtgcagagccccttgctcggtgccaggagtgcgaggagcacctgcagttcacatccaggtgccttctcgtcccaccctgggctgggcctttgctgcagtgatagctggtggaaagcattcctacttggtttcatcagttttgcactttatatttatctgtcagtttttaagacttaaattattttggctaaatttgctacactagtacagggtattgggaaacattttaattttaaggttaatttataattattctgctatctttaaatgaagtagtaaagattgttaacattgataaacctttagtttttaataaatgtggtaataaggtgtctgagactgtcatattcactagggaaagtctgtagttcccagaaattgatttcaatttttagatgcaatctaaagagtaaactgtttttttagttgagagtaatattacatatgttaaaatacatagatttcaaaggcacagtccagtgagcttttacaatgtatatatctgttgtaaccgctacccaaatcaaaatacagaacctatgtatcaccttagacatttacgtcattctcctttccttgttgtccacgcccccatcctacccttcacctcttctctgatttctgtcaccatagattagttttgtcatctcttagacttaatacaaatgggatgatgcaggatgtccttttgggaatggcttcttttgcaccacacagtgtcgtagagattgatctgtttgtccatgcagttgtgattcttggcggcttctcctttttatctaaacagacatggcatctgatgatggaattcatgctaggtatacctgtcagatacggttggcagtaagataaagtcagttgtatggccttagtaataattcattacatgggtttaacagtcaataattgcaaagaatgatgatgatactcaacactttagtattacatagaagtaacagtgtgaattgaacaatggcgatgaactgtccaaagtgtataaatcttagtgtcaaatagcaattgaaatgtcaaataacacttattcatcatttattataggtgctacagaatattttagaaacagaaaatgaatattctaaagaacttcagactgtgctttcaacgtacctacggccattgcagaccagtgagaagtaagttagatgataaattgcattaactgtaaaatagtctaaaccttaggctgttctcttctattttcagagaatagagggttaaatagtgaaacaaaatttagtgtaccagtttgccttagacatcagctgtttattaggttaagacttcaataggacattgggatggcaaaggagaagaatataaataaaactgtttacatatgtttactgttatttttcttggctctaggttaagttcagcaaacatttcatatttaatgggaaatctagaagaaatatgttctttccagcaaatgctcgtacagtctttagaagaatgcaccaagtaagtaagatgctaaaaatttgcaacactcaggttggtataattggtatttaaaggattaagtgtgaagtaattttagaattcacatttctaaagatgcaaacttaagttattttaaatcttttgggtaaatcagcttttacagtaaaagctgtattttagactgtctagtttgtatagcaggaatcttcagagaaagactcaagaatggtgatttttaaggtgttccatggaggaagagtcgggatgaagagcctctgggagagaaaggagaatggcctgacaccaggaccactgaggggacaagtggctcagctccttgtgtgccctgagtgctgcgcagggggccttgaaggccaggtctttccccaatatcctgcagcttgcctgctgtttctggccttccagaagcagatacagtgcttctagaaataacatattaggttggtgcaaaagtaattgtggttttggattgtgaattttaaatcataactaggctcagacacatctttattaatcaagaccattccagtcaacacattttcaccagtgagaaataagttttattcttgtagcgtaaaaatctgtgcttcaggatttgacaaactcttggaaagcactttctgcatcctgctggttgtggaagcgttttccctgcaaaaagttgtcgagatgcttgaagaaatggtagttggttggtgagaggtcaggtgaatatggcagatgaggcaaaacttcacagcccaatttgttccacttttgaagtgttggttgtgtgacgtgcggtcaggcgctgttgtggagaagaattgggcccttcctgttgaccaatgccggctgcaggcattgtagttttcaaagcatctcatcgatttgctgagcatacttctcagatgtaatggttttgtggagattcagaaagttgtagtggatcagactggcacagaccaccagacagtgaccaggacctttttttggtgcaagtttggctttgggaagtgctttggaacttctcggtccaaccactgagctggttgtcgtataagaaccacttttcggcgtatgtcacaatctgattgagaaatggttcattgttgtgtagaataagagaagatgacacttcaagatgatgatttttttgattctcgctcagctcatgaggtacccacttaccgagctttttcaccttttcaaattgcttcaaatgccgatcaactgtagaacagtcaacgttgagttctttagcagcttctcgtgtagttgtaagaggatcagcttcagtgattgctctcatttggtcgttgtcaacttctgatggccggccactacgctcctcaccttcaaggccctcatctcctctgcaaaacttcttgacccaccactgcactgtgtgtttgttagcagttcctgggccaaatgcgttgttgatgttggaaattgtctccactgctttacgacttactttgaactcgaataagaaaattgctcaaatttgccttttgtctaacatttccatagtctaaaataaacagcaagtaataagtcgttagcaaaaaaaccatcaagcgagaaatacgcattaaaatgatgtataaccacatttatttaagaacatgttccaatatcaaatggcaaatttcaacaatgcagaaaccacaaatatgtttgcagcaacctgatgtaacatgctatgctgatgaactagggctttgaggctttgtcacttttccaaaattttcctttggagggacagaggcatgttctgaataatcagccatcagtttttttctgtgtgactattttattttcttggtttacatcagacattaaaggatatttgttaatttcctgccaggtgacttagaacagtagtgcacatggaagcttttaggtttcagtagtctatcaggtgaggtttctttacttgtgggtttgatgaaggtgacacattttatttttaaattatctttgatctttattcatataacccccagaaaagactacagtacattatttccttggatttcggttggtctctggtcttcccttcagcttgtgcctatttaggttttgaacgtggtgagggagtggccttccttctgtgccactagttcttgcagttcatgacagtttaccaaccatgatgaaaatactttgttcccttacctttttggctgggctttgaggttttgtcaaggcactttatactggactatcgatatggcaaggaaagctgaatgccagagtaacagaatattattagaaaccgtaagtgaatattctatagaacttaagactgtactttcaacccatctgcaggccattgtttttacttttatagcatttttggtttgcataaagtggcattacttacatgaccatgaaagaatagcttgggaatcactttgattttcttttggtgaatgaaggtcatttgctgataattcaaagtctttgtaagagttcatattgtgctcaagatggaagtaaatgcttgcctctgtttttctcattggctgtagataatgtggtctaacaaattattacagtatattttaaaaatacagtttgcagtacctctgttgggcattatatcagccctgcgaattattatcctcacattactcgttaaaaagctgaaataaaggcagtaaagtaatcgcttgaagccatgtgtttactaaggcttcagtccttatgttatctcagaatttggtatggcttaggtattattttgatcaagtttctcaaattttatgctacatgtatacgaggtgttagagttccacggggaaatggaatgtactagacgaagttttctttctcagctatttctcttctttttattatgaatattctgaaattttcatcatttccattttaagacttactttcgtctttttgtcctatatgtgaaatttctgtaccattttacagtttaccaaatgccatatatatgtagcagtttcatactcattctttttttttttttgatacagaatcttgctctgttgcccaggctggagtgcactggtgcgatctcagctcactgcaacctctgcctcctgagttcaagtgattctcctgcctcagcctcccgagtagctgggattacaggcgtgcgccaccatgcccagctaatttttatgtatttttagtagagacggggtttcaccatgttggtcaggctggtcatgagctcctgacctcaaatgaaccacccgcctcagcctcccaaagtgttgggattacaggcgtgagcaaccacgcctggccttcatattcattatttcttttgatttttttttttcgtctctacacagacttgattcgtagatgtccaggccctttcacagctgcctgttggttagacccaggagttggcaaactatgggctgggtcagattccgcctaccacctgttttctataaacaaagtttcactggcacgtgctgtactttttcattcacccattgttaatggctgtgtttgtactacagtggcagcagtggagttgtgatagaaactgtctggctcacatacctcaaatatttactccttggctttttatagaaagttggctgacccccaggtgagatgtgctttcttccttggggcctcgacctggccctaacctctccattccctgtgcgttctgaggcccatgtttgttttctcagtatttttgccatgtaggacttctgtcttccgtcttgaaaactgaagtttctatctggtgtcatttttcttcaggcagaggaacactttagttttttgtaattcaggtgtgttactgacaaacatgatcttggattttgttgtctgaaaattgctgccttcgttcctgaagatttttttttttcccatggatactgaactctgggtaacagatttgttgtttcagcatttgaaggatattgctccactgtcttttggccttcactgtatctgttgattgtatctgatgatgacctccattatattctgatcagcacaatttcagatagttgttccccgtccgcttcctagatttttgcctttattttaggtttttggcattttgacggtgattatctcgggtgtggttttctgacttctcgaacttgaaaatttatgtcttttaccaaatgtggggaatttgcgggcattatttcttcaaatattttgctgctttactgtttctactctgccttggggctccagttacacccatgtagaccttttgctggaggtcctggatttgctcgttgctttctgacctggtctctgctctgttcttcaggttgaatggcgtctgctgtgtcctaagtgttcactgtctgcctctctactctcttgttcgtccccgtgcaacaagtttttagtttgagaatttttttcagttctagaatttgtttcgcttaaaaaaagtgtttagttctctgctaagattttatatttgttcattcactacaagaatatttttctttatatcctttagcaataattagaataactgctttaaggtcccatctgctgattctttattgtgaggatgggttacgtcttcatgattctttttatttctagtgactttgaattgtgtcctgtttactgtgggttgtagactcttgatcatgttaggtttccctgaagagtattgatttgcttgtttgacaggcagttaacttggtcaggctcaaattgccaactctccctttggcagatgctcaaatctcagtccacttattttagactcagctgatctgaagttggccttgcaagttctgttctgccgtcagccagagatttgggcagaatttagagacagaattcagggtcacactcaccgtgggtttcccccagcttcccagcaactctggtagaaccaaaccctgtggatttttgttggagttttagctgttccacataacaaagttggctgccattagcttaatagttgagaaagcaggaggtgccctgcccgttcttttttccaaatgtccatccttccccagaatatacctgatgctaactaaaaagtgattcaggcaggtctcaatcgatagaggtttacgtagctgcagttgaggacgtgccaggtaacaggagcatttgtgctttttccaaagctttgagaagttcagtatttaaaggggaaagaacaagcaggaggggaaaaaagggaggctggggagcagtgaggcagatgcttaaacattgttgtgagcctccgattggcctcagtaagcctgcattttacacgggaaagggggagtagaggaaagtcagttgtgcgtttttctcagggttctctttcacgggaagggtgatttctgctcttgtccttgtctgtacctatgaagataagctggtacttgacattgccagggtgagatacaatagaactcggttttagggctagtttttagtgggggacatatgttctgatagatttaggggctcacaagaaatctccttgtgagcactttgtgaggaaggccatctggggagctatgtggccttctgtagttgtgggcacctggcgtatggatgaggccatgacacagggttgtggaatgacagctctctgttcggcaacaaaaggcagacagtgttgcacagttcagttcccaagcttcactttcccactggcatagtgagtttgggtcccaagattctgttatctttcatgctacttttgagtgcctctaggcagttactttctatatgttttttaaagtttcgatgttatttgcaggcgagtcagtttgataggagtaatttggctatagccagatttatagaacccatttccttttagtttttcaaatcacagttcttcctttcatcagctgtagagggctccttgcaagcatgctttgtctaggctttcagttcaaaacaatagaaactgcaatctgccttccatgcccttgtgccatttgctgcattagtagcggcacactgtcatttgtgttgtgaggttgtgatagctggaatgtgcccagtttgcctagagcagctttctcaggtatgcgtgcattcggcgcttgtgcacacgctgccaccacgtgcgtgatgctggctggctgctgatagagcctgtcctggtggagcttatagtctggtgagggagacagataattgaaaattgtataaatagttagaaagctacaattgcagaccttcttacgaaagaaatcatatcaggcaccaagagcaaacttcaggggaagatcactgagcactgaggggtaaatgggaggtaaccaggcaaaaaacgagaggaggtttttcctcacaccagcacttcgtcaattgtctgacactgagtttccagtggttcagttctattcggacatttgtctcccacgagactgccacatttcaaacccagctgcaaatggggtgcccaagctatatactcctacctgactgagtacagatttgagggttcccatgactcccttcaggtttgataatttgctggaatgacccatgtatgtaactcaggagagtgcttgacttcctggtaccagtttattatgaaggatgcaactcagaatgagatggatagaagaaagatgtagggtaagggatgggagcagagtttctaggccctctgggtgcagcacctccgtgctttcagcaacccaaaatctctccaagccctgtccttggtggtttctaatgtaggctctgttaggtagacatgcatgattgactagatcactggacattgctgagtggcatgatctccagccccttgtcctccctttaggttgctggttggggctgaaagttcctgtgatcatggtggtctttgtgacacctagcccccatcctgtaagctgtctaggggccgacccagagttacctcgttagcatagactcgggtatgacggaaaggggttcatgatgggtaacaaaagacacttctgtcactcagaaaattccaggggctttgggagccagggacagtttatctgatatcacaggagagagagcaccctgaggtgggcattggctgtggctggagcctgtgaatggagaggagtggaacagtaggagcccggacgggcaggcgagatcaggtcctggagactttgattggatcttaggtgactgtcaagagtagttggaagccgctgatggatttgaagcttggcagtatcatagtcggcactcttctgtaaaaggaaccgtatgctctgtgatgagtggtctgggtggggcagagggcaggaggacacagagactccagaaaggaggatattgaattttgtcgagattcttttccgtgttaaataaatatccgttaccttaaaagccactgacttataatcattcagtggtaattttgtggaggtgtttataaaagttacttagcaagtctgtttttgcttaggcattgtagttagtgcttctgggatccacggctggttgtaggcagcgtcttctcccagaaccactctgaaccaggaagtaggtcactactttcacatacactcatgcctgcatgcattcattctcccggaaccactctgaaccaggaagtgtgggtcaccaccttcacatacactcatgcatgcatgcattcattctgtttttgtttttcccccagaatgaccctatgcctagaattcttttgtagcttatatgactttttccaagcattcctttatccccaaaagggatctctttgtctgtggttgccactgtagttgatacttccaaagtgggaggagtgccctggggccttgtcctcctggggtccttgtgtggtcctggaaggtgcagcgggtgatttgcttagcactggggcagaagcctagatggcattccatagaaagcactagttaagatggcataaaagagttagtctcattataaaatatccagaagctgtagaataggacagagtgaaaaaccaccaataaactttttacccagatgtaattattgttgatactgccttccacttctctaagctttggtgtatgggagaacacatgcataattagggccaggattgagggcctgcctctagttaagataagatagtgagtgctctctcaggagagcctgcctgttgcatttgggcagtgaggtaacctgatttgacctcagtatggggcaggtgtgaatagcacaggcagaggcttctccttcctagatgtccagtacagaagacattacatgttttgctgcaaattaaatgattgcagatgtgaaaagaagttatcccagaagagagctgtagaagaattctaaccactttaatgtcattaggagagtttttcaaatactttaacggcagctcatgtctgtctgatggctgccttactataaatatgtacagtgaacttccatgtacagacctactatttattgaattcttagtgtgttcctggtattttttcagttattaactcattttatcctttaaaggaccccatgaggcaggtgtttaaagataagaaagctaggacaccaagagggtgagggatgtgcccaaggttacacaactggtaactggggcctcagatttggagacaggttgtcttcattcgaggtatgtatgtgaaaggttgattctgagagtccctgattcatagttccacctctttcagttggcagtgcttttcgcaggcctggcagcttctcaccccaccctctgctgccctaaggcagccccagcgagagcccccagccagttaggttcctctcccagggccaggcccagcagcagctggagcccaggcccccttctcctgttgggggcagggcccctgcctcactttgggacaagaaagccttagtggggagaaataagatagtgagtgctctctcaggatagcatttgaaatgcagttttccttcaaactattgttctatgtgtcggagaattccctgtactacatgatttactgtagaccctgttacagtatgatttagagagtctttggactagtctgggaatgtggaacagtggtttgtaaaaaattgcctctatgggaaaatgaattcttggaatctaatagtatcttttaaacgagtttttaaaataaaactgataagttgggaatttgcttctagtttatgatagaaaggaggttaaattctgttgaaaatagaacctcagaagccctcttatggaacatccttgttgtaccaaattttattcttacttattttgatggtgactcagtggtgttgtaatacttcccctaaagaaatactaaaatacccagtaactctccgtctctttgtttagatgccagcgcatgggctggcaaacagtggagatagcaggatttgccctgttcccgtctcagatgtacagctcttgaaatagtgagggtgcctggatcactgtaccccagagtctccaccaagcctgggactaccacactaagcttgttgtgtgtaactgttgcttggggcagctgcgaccatttcaccattcctgcttgagtgttctgggtgctttccccaccccgggtccccagcctcccccgatccctatactttgtgctgctttggcgatgttcagggccacccgatgacctctcgcaacccagttatcacagttcaaatgtctcagagcattttggctctgctgcatgccaccatgtgatacatgggacgccttttcctcatggagtttcacataggtttctgatggttctgccgtgttctctggctacctgggagatcacaggatgccacgcctgtggaggactgtgagggaagcctacccttcttgtagctcaagttgaaccattgtggtgctggttcatgggtgctattagtttagagggcaaggtggtggtgaattccatctccagtcctttactcagattgttctaatatgttgtacattttctgtaagatgatagtgaaaacagtacatcaagagaaaaattttcttctctagagactcattctcagcatatttgttgtttgaactgtttttaaataaatcggttaactgcaatgtttgtaattttcagtttctattctggtgacagtttttttaaaaatgtgattttgagtcaagttgtttgagaggatatgggtgccactaacatgaaggccgggctcagaagaggattcgggctaaggcgctgagtcactaacatgaaggccgggctcagaagaggattcgggctaaggcgctgagtcgctaacatgaaggccggcctcagaagaggattcgggctaaggcgctgagtcgctaacatgaaggccgggctcagaagaggattcgggctaaggcgctgagtcactaacgtgaaggctggcctcagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggctcagaagaggattcgggctaaggcgctgagttccgtttggggttgctgtgcatttcagttggagatgtcacaggggagggtggaagcggatactgggagctgcagacttcccacccggcctactgcatgtgtgggaagaggtgtggcccaggtaaaggttaggtttggattgacagctctcctggtcacctgcctcatgttgcttgcccatgtctgtcccagtgtcctcatctataaagcaggggtgctggtgtcacccacccagagtcttgcggaggtaaagtggcctggtacttacggaaccatctgcaaatgctcggggccctacttggcgtctggagctgagttctcctgcagcctctgttctgccagggccctccctgtgcaccatttataacttcagttgtgaaaatgtaacttcgcactggctttggagggccctgagtgagctggctggtgttcgtgaaagaagatctgttttcagtcacattggtgagggacttttttcctcacccttcccatttctgcagctttgtcttcacttgatttcactttctgcccttaaactcggggacattttatgactgtctttaactgggggatatttttcctgtggaaggtggggtcatggtgctttcttttcagtgctgcgtttctcttggctctgtcgtttggggatgtctgacaggcagttgactagccatggaatcaggttggaagtagagaatgatttaatgaacttcatgaatggtgtaatgaattggtatgatatttcattcgttgtctggatctttttaatgtcgatattttaattatttttttcctaaaatagctggaggcaacttatttttaaccgccagctagttaagccatcattgcctgtatttggaatggtagaaaacaaccaaatgtgtctttagtcttattcttatcctacactaatcagttccttgattagtaggctgtagctatggaggaggcggtagctacggcataaaccaaagaaggcaggaaggtttcacttggaaggcgatggagaaatagaccaaacgttcaggaaagaaacattttggatgattaaggaagctttataaatggcatgtagggaggcacagtgattggaactgcgggcgctttgatgtttttagccaccatgccttctttcatagagggttacctatggcatgttctccctgcccacactcaggttctgtcctgagcctgctccggttctcagttgatgcagtatgggctccaccatccctggtctttcagtgtcacaaccagttgttagctcctgcctctgaagtcagcctttctggatcagatctttcttgattgttcagcttgtcttttcgtgtttgtgccgatctctgtggagacctttagttggcgtgcttcaggaattcactggcatctcctccttcctcctcttccctgctcactcgctctcttcgtattacccacctgttgatttctttttagaaacctttagtgtatctttaactcttccttttcccccaccttgaatcatttgccgagctacctcttctgtgcctgacctgtcctgaacgctgtagttcaggtcttgtgggttttcatggtgtctgtgcgctaacctaactgggccctgacttctagttggctcctgttctgtccagcttctccaccagcactggtcctcctgaaatggttcatcccagaaactgggggtgacaccgctttattcatttattcaccagctggtcttcaagacgtttggacaggacctgttaaaattgtggcaatttttgcttcttgaaaacagctaatttagattggttccaaagttgtaataatctacagatgtccctctacagattggacctcctttttggcctctgtcctcaggccttggcttatgagcctttcttgttgctgcctggtggggctgaaagtgggattttccccccacccagctctccttactattccctttgtttggaatcacttctgcttatcttcttactaaaatcctacttaatccttcagtcccagtgaacataccaattcttagtacagccttccctttgtctcttgtgttttgattgaatgtatgtcttgattttattttaatggtaaatgcctttcaatgtattacagacatcagtagactgagttcccatttgttgacttgtatatgataggacttcagtgtagtgtatcaaagaaaatatccaatgtgtttataagtatttaatgtaattgttataatagttaaatatcatgtaatgattttgttcaaaagttaattataaagcctaagataatagggaggaggtggagcaagatagccaaatagaaacctccactgattgtcctccccacaggaacaccaaattgaacaactctccacacgaagaaataccttcttaagaatcagaatcaggtgagtgatcacggtgcctggttctaacttcatatcactgaaggagaaactgaagagggtaggaaagacagtcttaaattgctgatactactgctccctcaacttcggcagcagccacgtagcacagagagaaaacctgtgcacttcggagagggggagggctcagtagttgtgagactttgtattggaactcagtgctgccctgtcacagtggaaagcaacattgggcacagaggtagcatttagaccagtcctagccagaaggctagtccctggtcccagcagttggaacctgagttctggcaggccccgccactgtgggctaaaatgacctggggttctaaataaacttgaaagagagtctaggccacaaggactgcacttcctggctaagacctagtgttgtgctggggctctgagccagtggccttggggggcctgcaacctagtgagacctcagccggggcagccaagggaggccttgcaccaccctcccacagccacaggcagtgcagcctgcagctccaggagagactcctcccacaaccacaggcagtgcagcctgcagctccaggagagactcctcccacaaccacaggcagtgcagcctgcagctccaggagagactcctcccacaaccacaggcagtgcagcctgcagctccagtgagactcctcccacaaccacaggcagtgcagcctgcacctccaggagagactccttccttctgctagagaataagaggagaggaaagacggctttgtcttgcagcttggataccagctcagccacagcaggatagagcatcaggcagaaccctgaggctcccggacgacatttatagacataccttggaccaaaagggaacccactgcttggaagggaagcacccagttcctgtcaggatccatcatctgctgactaaagagtccttgggccctgagtaatcagcagtggtacccaggcagaactcaccatgggtcttgcatgagactcaaagacgagctggcttcaaatgtgacccagagcacattcccagctgtggtggctacagggagggactcctgcttgagaaaaggagaggagactttgtcttgcagcgtaggtatctgcccagccacagtgaggtggaacatcaagtgggctcttgggagtccccagtttcaggccttggctgttagacatgatttcgggacctgctgtgggctagaaggcagcccactgctctgaaaggagagtctcaggcctggtggcattcaccacaaactgactgaagagtccttgggccttgaaggaacattagcaataaacaggcagtacttgctgcaggcccggtggtggctacagggagaggtttcctgcttatggaaaaggggagtgaagagtgggaaggactttttcatgtggcttgggtgccacaagaaatattcaactgcagtagaatagtgcaccagctagattcctaaggtttcagcttccgggctctggctcgcagatggcatctctagacctgcccggagccaaggagaactcaccgtcctgaaggaaaggacacgtgcccatctggctttgccacctgccgattgtagtgccccagggtcttgagcaaacataggcagtagttaggaagtggttaccatgggccttgggtgcagtccagtgctttgctggcttcaggtgtgaaccagtgcagtcccaatggtggtgactacaggggtattgtgtcatccttctctagctccagctactcatctcacacacacacacccctctctctgtctttctctctctctgtttgggagagagtaagggaagagagcaaagagtctctgcctagtaattgaaaattcttctggattttgttcaagaacaccgtggtggttcctatgtgaatcagcaagagtcacagcattactgcgtgtggggtgccccaatttaatgcagatacagctgcagtgagaccaaaaacttaaattgcaacacccaagtccctttgaatactggaaagccttcccaagaaggatgggtacaaacaagcctaggctgtgaagactacaataaacacctagctcttcaacgcccagtgcccagacactgacaaacatccacaagcatgaagtccatccaggaaaacaggaactcgccaaataaagctaccagtaaacaattctggagagacagatatgtgacctttcagacagagaattaaaaagtagctattttgaggaaacaatgaaattcaagatgacacagagaaggaaatcagaatcctatcagataaatttaaagagattgaaatatgaaagaatcaagcagaaattctggagttgaaaaatgtagttgacgtactgaaaaatgcatcaaagtctcttagcagaattgatcaagcagaggaaagaattagtgagcttgaagacaggccatctaaaaatacacagaagagactaaagaaagaatcaaaaacaatgaagcatgcctacaagatgtagaaaatagccccaaaagggcaaatccaggagttattggccttaaggaggaagtaaagagagacataggggtagaaagtttattcaaagagataacagatagcttcccaaacagagagaaaggtatcaatattcaagtacaagaaggttatattaataaaacacgaagtagatttaacccgtagaagactaccttatgggatttaataagcaaactcccataggtcaatgatgaagaaaggatcctaaaagcagagagagaaacaaataccatacaaagatgctccagtacatctggcagcagacttctcagtggaaagcttccaggccaggagactgtgggcctgacatatttaaattgctgaaagcaaaaaccttttatcctaggatagtatatctagcaaaaatattcttcaaacatgaaggagaaataaaaactttcccaaacaaaagttgagggattttattaacaccagccctgttctacaagaaatgctaaagggagttcttcaatctgaaagaaaataatgttagtgagcaataagaaatcacctgaaggtacaaaactcactggtaatagtactcagaagaatacagaatagtataacactatgtgtaaactactcatatcttgagtagaaaggttaaaagatgaactgataaaaaactacaagttttcaagacagtacagtaagatataagtagaaacaacaaaaagttaaaaagcacaaggacaaagttaaagtgtagagtttttaattaatgttctgtttccttgcttgttacattgtttacacaatcaatgttgtcatttaaaaataatgggttttattatttggaagtccatggtaacctcaaattaagaaacatacaatagatccataaaaaataaaaagcaagaaattaaaacataaaaccagagagaatcacctttactaaaaggaagacaggaaggaaaaaaggaagagaagattgcaaaacaagaaaacaaatgacaaaatggcaagagtaagtccatggttatgaataataacattgaacttaaatgaactaaactctgcaatcaagagccgtagagtggctgaatggattaaaaaaaaccaaaaagacaaaaaacccaatgatctataaagacacctatagactggaaataaaggaatggaaaaagatactccatgcaaataggaaccaaaaagagcaggagtagctagacttatatcaaacaaaatagatttcaagacaaaagctagagacaaagaaagtcattatataatgataaaggggtcaattcagcaagaggatatagcagttgtaaatatgcatccaacattggagcacccagataatataaagcaagtattattagaactaaagataaaccccaatacaataatagctagagatgtcaacacaccactttcagcactggacagatctttgatacagaaaagcaacaaagacacttgactttatctgtactttagaacaaatcaatctaaagatacttacagaacatttcctctagtggcttcagaatgcacattcttttcttagcacatggatcattcttaaggatcatctatattaagcacaaaacaagtcttaaaatttttttaaaaatgagattcatctcttaaaaaaatataattttatcaagattcttctgaccacaatggaataaaactagaaatcaataatgaggaattttggaaactatgcagacacatggaaattaaacagtgtgctcctgaatgaccagtgggtcaatgaagaaattaagaaaatttaaaaatttcttgaaacaagtgatcgtggaaacacagcataccaaaacctatggggtacagcaaaagctgtattaagaggaagtttgtagctgtaagcaactacatcaaaaagtagaaaaacttcaaataaacaaccttaatgatgcatcttaacaagaaaagcaggagcaaaccaaacccaaaattgtagaaggaaaataataaagattacagtggaagtaaatgaatttgaaatattacaaaagatcgatgaaaccaaaagtggcttttttgaaaaaataaaattgacaaacctttagtcagactaagaaaaaagagaagacccaaataaataatttttcttttttgtttctgattttaaaactgatactgcagaaattcagactcactagaggctactgtgaacaactgtatgccagtaaattggagaacttagaagctttggtagtcaacaagagagacctgccagaggtcatgtggttacaggggccccgtgtccctgtgtgtgtgtgtgcatgtgtgtgtgtgtgtctatctccaccctgagtgggagcaggaggctacttgtgaagtctcatctctgaaggccatctgttgatcacgacaggctgctgggttccttgcggctggagatgtgtatggaggttcccccagcacattgctctgtcttcatgggcatctcagtttccatctgaaatcacttgttgatgaactgagaaccattcctctgtctagttagcagtatcactaggagtaaacatgttacgggggaaactgcttagcatttgatttctcaagtgttttttctgagacccagtaatcttctgggtaaggaaaaaaaacccttgggtaccccctttcaccttgtgctgttgctgttactgtgaagatgtagatggtatgtgtgactctagctgtcatcagatcattcatggacacaatgcaacatcacacctgttagattatggctttggttctgccaggaggcctggtgggagcagctggcatgatgcgtgctgcctctcatgactcatgtgcaccatcctgctgcccaaggccttgatgtagcccctgtggggtgccctgtctgcatgttatcacactctgaagagcagcctatggagcacaagagagaaccgaggggaacatcccctcctttaattctgaactcatattctgtaatggtgatttctgtgagtctggctggttgtcgtgtgaattcaggtgtctaggcagcgttatgtgtggaatatgttggcacgttatgctcgagtcctagggctcagctgacctttatgagctttatctgctactgaattaatgaacaagggctttatcagccatgaaactttggtgatggcagtgacagaaaattcttgggagaattggtctgggactgaaagaggtaataaaaatctagagcctaggctcagtgcggtgaattaaataggaaaaaccactcgtaccgtgaattgttcgtttataagctatgctgaaatatgacttaattttcattaattgatgaaatatcagaaatgaaaatcagtttatccagatttccttttctgaatggatcggggctgtggcactggaccaggtaggagatgaaatcttagcatagcccatggcccagcactgagcagtatttctgcaatcctaagaatttaacccattgtgggtagcacatatccaataactttcctgtgccacatctctggcagtgttttctgtgcgtatacctttggcattccatcattacccagtgctcttcagtcctcctagtgaggcatgcagggtcctgtcattctagaagcccgcctcttcctgatatttcactgtgtctctgaggatgaacatcacctgctcagatgtcagaagattctcaaaacctgtgtgtcttaaagggcgtgttcttcctcctctgtaggctggcagcagtttgtagctcctgtcactgagactacataattgtcttcagtttacttctgtacaaaatgatagaactcactttaaggtagagactgtttcttaccctgtttttaatctgttcccagtgccttgtaatggtgctgcatacatatagtagttgaaattaatttgagtcagtgactaccctgcaaatggacagaactgtggctaatcccggtaggttgtggaaaccccgcttagctgttcacagttggaaatgggtctgcagcagtgcagatgctagcttactttgccttctgttgtgttttaataaactaaacagtaaagcaccataataactgcatgacacattcaggatttggaaacatggcttggatgaattagaccagtgttgttgagagcttgcattgatggaaacatgctgtatctgctagacaaatttcagtagcctctagccacgtggggctgtgaagctctggaaatgagattaacgcaactgaagaactgaatttttaatttttttaaaaaatttagttaaccttacttgaaatagctgcaggtggctagtggctgttggatttgagggtaaagaagcatggtagagaaggcaggtgggacagcctcccatctgcgcagagatctatatgtcaccgccaccgacaggaagacttgtgcatcctaacccttagcctccttgtgctgtgggcaaggtccctgctgttgcagaccccactaaattcccagtccgtgcaggtaactgttgtgcttctgtgagcccccgccagtactctgggtggggacatgtcttgctcagacagagatcaaaggagagctaagagagggagagagatggacagttaaatattgaaggagggcgttggcctttttttacacagcacagggaagagactagtatgtggagggagcacttacatttggtagatgttcttacacagatcagccacctgaacgtgtgtgggatatttttattacctatattttacatttctattgtctgtattatttaccgtaactacatttgacatctacatattgctatgttttagaagcagaggtttattttcacctctttcctgaaggccatgttttataaaactgacatgttatctagtctagaagggaaggcccagctgggcatggtggtgcatgcctgtaatcccagctactcgggaggctgagacacgagaatcgcttgaaccgggaaggcggaggttgcagtgagctgagatggtgccattacactccagcctgggtaacaagagagaaactccatctcaaaaaaaaaaaaaaaaaaaaaaagaagacccattgtgctgggaatgcttgagtctgaggagagaaaacggtgggtggtgggatttggcacctctgtcacagcgttacttcctgtgcttttctgtctccacagctattataggacgtactgataacagctcagtaaattttcttaaattgatgagaacaggaacagtctttttgagcctcggttaacagttactaagaaatgaataaaaaatggttgaaaaacagggagaagaccaagttagcataaattttgagtgctctgtgttttgaacatgaggtttttcctaatacttgtgacttgctgattctcctgactatgactttctccagccagtacttagccgcggagcggaaagcagtgctcatgaaggtggaggcacacccagagactgcatggaggtggaaccgggaagtccggggtctgaggtcctgcctgcagggttgaaaggcatgcctgccagcagacacatttgggagccagagtgtgctgtggtctgaatgtgtttccccagatcatctgttactacagatgatcaccaattggatggtattaaaaggtgggccttggaggtgggtaggttgtgaggatgcagccctcatgaataggatcagcagccttgtaacagctgtgagggagctgttttgccccttccccgctgtgaggatgcaataggggaccacctgcgggtgccttgatcttaggcttccaacctccagagctgtgggcagtgcatttctgttgttggaaaattacccagtccgcggtgttctgttcccagcaggggcggactgaggccgtgtgcttatcggtggggacagcagagcagaagcagtgtccccatgagttgtaggcctggaccttagacccaggctccagccacctttgtgttggatgctgacgtctttcatttttttttgcattcctctgtcattttggtcacgtacctgctctgggaacttcccgaggagcaagtgcatgccaggcagttaatccatgtgaatgctcacggttgactcagatggagacagttagaggaagcgatttccacccccgtttcaaggggtgcttcagtgtttctgggctctggtgctgaggagccccatgctgttcctcattctcggtgtgaacaggtgtttctcactcagagctcttcgcatccttgtttctgggcttctgaatgactctgctgttgtctggggcctcggtcttcttttggcctgtgtcgacgctcgtggacaccttcgctcttgtgccttgcactctttctgtttagtcgtgtgatgatttctttgattgacttctgcttatatttttggttttctgtatcatgaacttttattctgatgtggaatgactatcatatttcctttttctcctttgctccttcattcccctttttttaggcaaatgtatttgtcctttcatgccttcttataattaaggttggcacactaaaagcactttggaagtgctgtccgagagttgggactggttgactcttgttttctgtaggaatccctggtgttcatgtttttggtcactttttctctggctcccattccctaggtaggaggatgtaatccttctggtaatattgtgggtatctggggagcaaagacaccctggggtgcagggaaggtggtaagagttcacgtggttctcctgttttcagcacacgtgcccctgctccgggttgttgctgttgtccttcagaaactctgaggtctggagaggtgagcgtgtaccccgttaggcacacccaacactgaggcggcaccaccaggggccctgatgcccacagcttgtgccgacttgtcacccctcatgcagcttccagtgctggttctggtagtctcttcctcattctttttgttctcatgagtttatgcttcttggaaaagcctgttaactgtcaggatgctgtggatctggggaggagaggcacctgataggtgggcttgctttctagtctctaacctgaagggaaaggcggtttttgtattttttgttagtcttgatgttgctgctttggtagaaaacctcacagactgaataaccacattcaataattctccttattttatgcaaagctgaaggctctgtgacatctgtttttctcactgcccaaagaacttgggcctgagggttggttgggatgctgtgcagtctgaatgctgctggagaggacctggcagcacagctgctttctgggcgccccttctccttgctagactcaaggcagcaacacatgtgtgctgggatcggggcctctggttttcacagatgggtgcagagggaggttttccttactcagagtattatatgtctgtcagttagcagttgtcctgtctgtaaaactgatgactatttccctttgtgtcgcatttctccaggttgcccgaagctcagcagagagtcggaggctgctttttaaacctgatgccacagatgaaaaccctgtacctcacgtattgtgccaatcacccttctgcagtgaatgtcctcacggaacacaggtgcgcttgctaggcaccttggcaacagggagggtggatggctctgtgtccttcaaatagtgcatgaaatagtatgatgctaatagtcccttggttattaaagggtatgaattttaattacccctcaaaattagtgcttgagaagtactggtaagaagtctttaaaatgatggtgagtatttttgtaaaaagacaaatcttttcaatgttttccctacagcctgaagccctttggctaataggttgaaggggttagtaagtgttctggggtgtagccacaagcttagtcaagggtcctggaatcatatttcagttcttaaaactggaagtacatgagtccgagttacatcagctgtaacagaaagtatctcatttcagattaatacaggttttatacacaaaacattacattggagacccttagcttttcatcctgaaactaaaaacaagtgcaacagagaatgcacagacgttttgcttattttatgaagcaagacagtgtctgcttcctgcgaattggaggaagatgtttctcagctgtttcagttactgaggaggatctcagtcattagtgagtgttaagaattgatttgtttgaggattggcttggaggagaccacaccggggcttagagagctcagaggctcactttctgcttctaaaaagatttatattaatgttttacaaaaaattaatacaaagatttgtattaatattttacaaaaaatttcataatttcttttgaaaacagaaattcacacattttcaaaaccataaatggaaaagtattgttttagtagcataaagataaatgccattgtctttctaacttaagtatttaacttcagcttaaccgaacatttccactgaaagcctcgtcagtgaacaggtgttggttgcctcttcagaagcacatttggggctcaggtgtggcgctgcgtgggtgtcctaggacagctcagacatggcagcagggtggactcggctctggctgtggctgctcccttcaggctctgcagccttgggcagatttcctcctgtctctgggtttcagcttcctttcctgaaggaactcattcacaggggtgttacaagcattcaagctaaaactgtcagcaggtcaggtcagggtgaacgcaccaaatgctcagtgaatattctgttgtcttctattgtttcttcattttttaatttttttattttttaaaaaagaccctggatagttactgtttcctgggtgtgctcaaatataaaaggattaagattttttgaacttcctatttgttactaaagcatctgcagccctgaaaggaaacagcagccttgaacaatgtagtgaaaggaaaggaagttagaactcacagcagtggcagaaaaggaaaacccaaagaaccctccctctgcacgtcccgcttgggagcgtgggccatgtccgcagcatctccaagcgtccagcatgtttccagttatgtgctatgcccctacccctgggctgtgtccacagcgtctccaagcgtccagcatgtttctagttatgcgctatgcccctacccctgggaatttatacattgaatgagatttccagaaagcgcaatgcaagtgttaaatttgtatctctggaaattcttcaagaattgttgatggagtcatgaggaagatgaacagaaagttcatctttctgaggacctgtcctaaagatgacattgaaagtcactaggactgttagtttcctaaaatgcgaagccattcaagagcagtgcttgcgggcgtgtgctgtgttgatcctcttctctgttattaccttaatgagtgtgtttgtcaggtcttaatgtacgtgtagcattttcctgaagtaactagaagaaagaatacaggtgggtttttgagtcaggagggtctttgtgcctccttcccagggctgcccagagagtggaggggcaggctgaggcccgctcgggacagcagccccggggcaagtcaccattgctttagtgctgggagtcagagctgcggcgagaggaaggtcccccgagccagcaggtgccgccactgtggaacatgaagcttgtgtgccctcccgaggtccctgcaccacgagagttcccgctgtgttggccacagattcctccccaccccaaagacacagcagtgaattggggtcaggcttccctgtgccaaggctccttcctacctcctgcctttgtacttggattctttcttggtcctcttgccagcttttccatgtgtgtgacggtctttaagctgccacacctggggtagactaatctgctcatgctgtggagtaatttttaaggattggttcaagtgcagtgggttgaagtttaaagtcttatttgcatcctcactgtccttgtgttacttgggtttaagttctaagtgtgagccctgcgagcgcagaatgccaactctgaccgttttagcagctcagaccttctgcagcgtccagtgatggcagcaacacttgtccatggccagctattttgaatgaactatgggtgtcataatttagcctttgaaaatgatttttttcccagcagtttgttcctctgcacttggctccatgcttgcatgtgttttgtggctgccgtcagcccacagcactgtgtcggtaaggactgaggagacccactgtgtacgggctgctggcatcagcagaactgaagctgaaagagcagtctttggtcagagtagctgtaactagctgttttgttttattatggcactactttttttttttttaacttcaaactgaaactaaaacgatgatccacaaacatttataaaatttcatttcctttttaactgtatttgttctggcattgtaagagtgtcttgtggatattagaaggagttttgcttgcacatgtttcacttttttggcttctgggctttttttgagggagtggtgatgagggtaactgtttagttttgttagtttttctctgctgtaccgtagttaggaaatttcacaggtaaccctgaaatataaataatgacctgaatggatttttccttgattcttattttggtggaaaaggtacttatgtggattacatttaaaggagttgaaatatatttttagtatcataaagtttgattttcatgggactgcctgataaattctccaacacctagagaattgttggtaaaatataaattgctcctgtctgaagccctcatgtcactctattcatgctttaggaatggatagagtgagtaatgggaagaggagcacttctgagtaagaactgggcggaggggagggatgtgtgtgtgcggaacaggctgcccgtggtcagaggggccggccatgccatccacatagcaggggtccgcctggggtgcagagcgtcagctgttctgccggcagtgatggtgtgggcagtggccttcatgcaggccgtcgtctgtatcacttgcaaaattgtaggtctgccccacccagtgatgtttggagcattgatgtctgtgagtgcctgccctggtgcctagcatggtgagcagtcctgtggctcctcctctgtccttgtggtcctgctgtccacagagtgctcacagttgccccagctgagaaggggcgggggacagtggctgtagtggctgcagcagatgggagtctgtcctggaccctcctcagttccccacccatcttcccggggaaggtggatgctgaggaaagaaggcagaggacgtgtgcgtgtttagaaatgataggaacacatgcggtgtgctcatgggctcatgtcaatgcagcctgtacggtgagcaggacaccttgctgtgcaggtgttacccacagcaggcccctgaagatggcactgtgctttatttcagtaatctccagcctgggattgtctcaaggaaatgatttttggaaagcacaaagttacagacaaaagatgttgagttgtctgttgcccacaaaagtgcacttgctctcgtgcgtgcgtgctctctctcacaaagacagacaccacgtacacacactcggaagtactcttgacagtctctgtgctactaatttttaaaacagcatcaacacgatgggcagccttacagaaataattatgaagccttatatatggagttgataaaatgtttcttgtcttaatttttttacaagtggatatatgcaacattacccttttttataatttgctttagtattgataatatctgttaagtgtgtatatgtatgtgtttattggaagtatttcttgttggcaagggcagacagaggtgccgcacccacatcgttactgtttttacacagcataggactgcaccctggccttggttaatgagaccaccctggttttgtagaaagcgttgagatgtaagtggccttctcagaaggtcttacgtgcttaggaagtggaaggctggtttcctaatgactgtttggttttcagcatggtgtttgaatcggtttcattggaggacattctccctggctgccctggcaggggatccacatggaataaggagggtgagaagcgggaagggctggcaccaccctggctctcagtcctccttatgggaagctgtgtttaggttgaactctctgaaactgttaatgttcactatttgtggactcagtttcctctgggttagccaaaacactgtctgtcttttccccgggagcccttgatggttctggtgtccccgagacctctggcagtagccagcttggctggggtggtgcggtgggaggctcctgtgagaccagaaccggaaattggcttgtttctcagttttgctgttaggattttcatgtttattttaggacatcgtttacataatgaggatataaaagtatcttttccttttaagggaaaacctctagactaggaaaatttgttcctaggatttgtgccatgggtatcatttgaaccaagctctgctgactagagacccctatcttctaggatggggcgtggtgatggggcgggggtcacctgggtctcctggatgggatgtggtgactgagaagtcatcctggtctggacctggcatcggctgccagcgctggtgctgcctcccctcctttctgtgggctgtacactgtcagatgtgtggactgatggcacatgcaatttgagggacagcagacccagggcctgacagagacctcagagatcgccagtgaaggggtgttgcggtcaggtgactgtcagccttaacaaacgtgtgggtgaagagctggaccccccacagaagcctgcccgtgtcctctgccacagccatgggaactctgaggacaaagatgacacacatgaggacccactgtagggaaagataggcgaggcactgtgaaggggatggttgaagaggaatacagaaagttctaaaacttgtttctgactctttaattttgggatatgcactgtttctatgtccatacacagggacaccttccttccttacgtgttgtgaggattgaatgtaacaatgcttttgaagttctaaagcgtaaatcaacattcgctgtctgcacacagggacccctttcttcctcacgtattgtgaggattaaacttaaagcttttgaagttctgaagcctaaatcagcgtttgctctcttctcttgctgcttctcgtgctcctcaccccaagagccattgcctactcccaggctgagtgctggcagcacataggtggggcctgctcgctggacgaactcgcatctggggatgactaccatcagtgtgctctagctctttaccggagcagctcggtccttgttctaccaccttgagactctgagattattggaatccattctggctctgagtgtgcatgtttccattggatatgtctgcatggcactgatgtgctggaggacctcgccatcagtaggatctcatggagacccacatgtcctgtgctgtgtatagttattgttgctcatatgagagcaggaacgggaccccttagggatgggagtcccctttggcatttccagataagcagcgcagatttgggataaaagctggagccttccagatgttaaaagcaacacttatgtttcataaattctggctgttgctcatggagatgagagagccaccattgtctctcattgctaaccacgagtgtctctcttgccacttgctgcccagtgaggagttgggggagttcatggagaccaaaggtgccagcagccctgggattctcgtgctgaccacgggcctgagcaaacccttcatgcgcctggataaataccctacgctgctcaaagagctcgagagacacatggaggtactgcgctttcattctcttacttggagtccttaccaagggttagtggcatggtcagacttactgtgaaagaaagtattattcatgatttattttagaagccagaaccaacagagtttacaaagagttttgttaaatattatgtttttctccttattccagctctattagaaaacatttaccccttatctctcttttacccactgctgctgattgaaaagtttccaaaagctgaaacatgagaactgattttcagatagtgttgagatgtcttacctggatcatccagctacaaacaatgtgtgcataggttatagggtaatactgtactaatcatttgatgaatgattgtgctcttttaattttgaataacaggttgcagcctagcagaaatttgggttgaagttactctcttggcttgagttggcaaaccttttctataagggggcagactgtagggtcttcttcacggctacacagctctgccattttagatactgtatgtgagccgtggcagtgttccaataagactttattgatgaagcaagtgttggcttccccacccctgctgcttgtgactgttctcttccaacttatatttccccaaagtctaatggcttcgtgatttgctgaaagactgacactttaatgctgagggaaaaagggaatgttaagggttgaaaagtgttagaaaagtttcaagctggtctgtagaaagtacctttttaagaaaagcttttccttatgaaagctaattgtatgtttcttttactcaaaggattatcatacagatagacaagatattcaaaaatccatggctgccttcaaaaacctttcagtaagtgattaagcatattgttttcccccccagacattattgtgacaaatgaatgtaaaagaattatcaactgaaaaagtcaaatgattaaaaaatgacttgtgctgacatgaaagaaaaacagagtcggcattctgtggctggtaaactccttttagtggactatgatagaataattatttaaattttttaaagtcactgtgtaattgatgttagatctactttaaaattgtttaaaacatttttttacccttcattcatgttgtctttaatgatttattgcaaaacagaacaatggtggttccattttctctgctgttgtgttgtcttaccaactgcgttttggaaatatatggccttattttatagcacaagttatactttctgtttcttcttttcagtcttccatattggcaaacacgaacaaaaccagaatgaaaatacagttcttgtcctgtccacatttcttttttgtacaagtggcaaaatgtgctctatctttctaaaataatacttagtattccagagcagttgtgtgtgttgcttctcttaacttggtttcatacttctaagcaaatactttcaattccctataattaagcaaatcgctcaataaattatctgtctgaagaagtaagatataaagcaataattgtcttaaggatgatacaaagcaatgtggccggaacttaacattctgaaagtttatgtctgttaacagtgttgttctgtgtctgtcaggcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggtactgctgcccacatgcacgcaccagggtttctgtcccactcttaggagctcatagcagaagattttaaaggcatctcaagcgatgaaaaatgtctaatagaagctctatcttataatttgtgagctactttttattcttgacacaggagagaggcttatggcatgttagagaggcttagagctgagtgtggacttgttgatcagtttgatccagctgaagtcagtgtggcccgaagcccacgtgaactgaaggatagatagtgtgcagaaagacttgcaggagtcctgtgcacacatccgcatggagctgtatgcgcttatctggccagcaactttgtaccaaggctcactctcacagggacctgctgctctcaatgctttcgggtcattatactttcctgtgaaagtatgctagctgacatatgcttacaggagtcacagttttcttacaggtttggtttaagtgagagatcaacccagatttttgggacatacccacccacacagtgaaaatcgagcagtttgtttcatgattcacattgacatacattcaatgggtcactgaacaggcacctctttctgaattttattctacctttgcaaaaataacatgatcaaaacatgcgaaatgactcatttttgaacacaagactccaaggagaataagaaaactaaaacttcaaacttatatagtgtgttttcctttccacctgtaaaatatcaccccttctacatagtcttgtagtttgggtaccataagaaaccatgattataaaaacttcacatcttttcagaagaagtttctttttgagtcatgctcttttaaactttaatctgtggaaacatttcccaaagtgtgttctttataatattagatctatacagcactggtgggtgttactccaaaatgcttcagagtggttctgatcacgactgaacgtaattagtggaaaagattctttatgatagagctcctcagagacttggctgtgaatgttcccaatgtatgttgtgattcttcaagaggggaatatagcaagtcgttctcagtgacttctttaaagtacggaagactcttttctcaaggtgctttgcataagcctaatgttctgaggaatatacttggggaaactaattcctaggactgatttcacttttttgggccgtagtttaaatgtcaacatgtgaaaaggactgtggcatttttttgtctctttttggattcttaggaacttttttctttcacttatggtctctttggcttttatcttactgaagcaaatgatttttaatacataagtaatacttttaagtctgatgtaaaccaggtgatgtttatggggtggatgaaaacaacactgagtcgacatttgggaggtttgggaagtgccaggaattactagtagaccaaaattgattttaacattttatcctttctttagcttaaagactccacctgttccccctgaccccattaaaatttataggttctctcctttttctctgaaccagaaaaagaaaattttagcttacctgaaaatagttaatcacagagctgaactctttaaccaaatatagtttcaagatgttacacaggctaattgtgagtccaggatcttttaatcagtccgtttactttcttaccttttgttttttgaagaatttggaagtccttctctttacctatatgttaaagctctctcataatcatatgttaagacttaatacagaatttatcataattgtttccatttaatttacctgataaaacttgatagaaatacctaaacgagaaatatcatgtaatgtttcatagggcctagtataaataagtgaagtatttgtgctcacatttgttaagtagatgttttttaagaaatgttttggatttctttttttgtattaggaaaagaatgaaagatatcttctactcttcccaaatgttttgctaatgttgtctgccagtcctaggatgagtggctttatctatcaggtaaaacacaatttaaatttatattttattgtggatctgaggataatttcaaactggctttgaattttgtgttaaatattacgtgtatctatctgtgtatgtgctgtgtgtgtagtgctgtatattcagatatggacgtacagctcctgtttgtgtttcgttgtgactgcaagcatatcctatgttaatttcaaaaaaggaaagaagtgtaaactgtagagcaacctcataaggacacagactactgtggcacaagtcagtctctgtcattgccttctgtcgtttcatgcaaaataccttgctcctccttgctatggttttattctgtgaaattggttcaagtagggcttgtgggttagtggggtagtgtagactaagatcttgtgtcagtggcacggcaccgcccaaatgcatcagcaaacagaaagtgatgtaagggtgtaagtagcagtgtgtgatcgttgaacctttttaatttttgtttccctgcttctctttgagaaaatgtgacagcagatttgggaaggaggtgcaagggtgagcagggccttttctgttgcgacagtggtttatagtggtggtatatgaaggagctggtattttcgctgtctgtctagtagatgcacttggcaggtttcattcttctttttctgggaagttacagaggctcatatccttcccatcaactttctgaggactggccagtcaccacgtaaccactgcagcagaagccgccacttcgtgttctctgggttgcatttcattgtagcacgtgttgttttgtgttggcgcagcaaggacgttcaagatccctaagcagacactatgccctcacagaggctctgccgacacccagagaggacttgtggccatacgcttacaccaacacacgtgctttagaattggtgaatcacatatgtaggaacagactcaggaaagtgaggctgtagtttgttaggccactgctgaagagaggtgatctgtggctaggatagtgcccactacagtttcccccaaactagcagctacttctgtgttaaatgaccttgataaacctaaatctctgtcctttctggtcagcactatctggcttccgattttatatccccagaatctcattccagtggctggaggcaggggccttctctaacctaaggagagaagaggttgtcacttgtggcaggcttgagtctctgcctgtgtggctggtgcttacactggatttgcccttgatgtgttgacagactgctggagctcatctcaacaacaggattttatttttccattcttagcacagtggtgacccatggtctctgtatcattggtatccgtttctaccattagaacactggctttgggggatgccaaaaagtgttcggtccagccacagtcatagtgttctatacaccgatgttcagaggggctaggttaaacacagttgtgcggtttcattttctgtaggacttacagctgttaaagtacttatatgcattacgaatcttggaaaggagttcacagtgtgtagcattttttaaatacgcttggccacagaagtgtccagcagtctcctcttccaccggccatgctttaggatgagatttctcagcctgggcactgctgacgttctggactggatcgttcatggccaggggctgggggtctcggtgagactgtcctgggcactgtagggtatcagcagcctctctggcccttacttgctggaggtctgagcccctgccaggttgtggcactgccacccattctctgtgggggcacgttccccacaccagttgagcagcactccgtctggaggtgcttatgtagaatcctgctccgcagctgatggagtgctccccaggcagcgctgcccagacgcccactgcctcttcctgcggacttggtgggccaccatgtactgtggtttctgtcagctgtgccaggatgttttgtgttcacttctgacttgtttgtaatgatcactttgtaccccctttctggtatctttccattgacatttcctggtgcagttaccgatttcttctgttttcagggagcactggtttgccaaccattttgtgcattgtgtgcagcatttagcacaactacttattttctgttttacaaagtagaatgttatgaaattcttgttcttgcctcaatttcccacccttattttgactttaaacttggaacttcctctgcatttctttacgaggaaaatacatggttcttttctgcaaaaacatcatttaaaacaactgttatacacggtagttttttaaaaatcataatgtgtgatgtcttttgtcctggtgtctatgtttagtagcagctcatcagatacagtgtgtgtttgggcttgtcactctgtcccttgtcgccagttgagtttcttgcttacagtacagtattataatttattatttgagataaaaatttttgtattatacacacatctgctacaaatgagctttttttggttcacaaacacagttcctccaccaattctaaaatcatttaatattgactttaataatggtacctttttctagaaaagcactaattgtttttttttttgtgggggggggtcttttttagggaaagcttccaacgacaggaatgacaatcacaaagcttgaggacagtgaaaatcatagaaatgcatttgaaatatcaggtgataggcacaagctgtgtgagtgctgtgtctcggggaggagaggcagcttgtccccgcgtgcagattcttgcttgcgtatttcagaaggtggtgtttaagcgctgagtggaattctggggggtgtgcacgcacgtgctttttacctgtgtttccactcggcctattttttccttctctcctatagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccgtaaggacttggtgcttctcctccttccagactccaggcgtggcatcccgtggctgagctgtcagcaagtgatcagttgctttaaaacctaatcaatatttggataaaaagtgcaaaacacttgcttcacatttctctgcagatctttggccctcttcgtgcagtagtgaattgttttccaatgagtgttctcgagaaacaaccctgaattgtgcctcctcacgcacagttcagaggtgcttgggtgggaagctgcttctgctccgtgtggccctagaagactgatttaggggagttttacactcaactatagatgatttttctgagaattttaactgtttattatgcttcatttaagaaaacaaaaaataaatgattatgatgatgaaaagggccagactcatgttgaaggcattaaaagaatttatgacacactgttgattttaagaaattgaggtgtcttttacttagaaaagctcaacaagtctttggatatttagagacttttttttttttttttttttttttttttacaacttttcagaatagatgaacactgaagcttcagtgtttaaacctctcctggtgttttgtgctcaagaagttggtatcgggttgttttaacagtcgtcatctttatcaagtaatacggaaaaactgggcagagcttttaaagaatgaatgacgatgacacaggcgttttctgcttacagatttcctcacatccttattaggctattaggatcagctctgtcgtgtgctcagttttcatgttttcttcttcatgtgaaggttgtagctcaagaaggattgctgtactctgatattctcatcagagtttcagagtccatctgatttctttcagcagtaaagattgtaactactcattggcttttagctagcatttcatttttaatggctctaccattttaaaattctccattctttcatggagatcagtttatcccagggacgtgtgtgtacacgtgtgtttataaagaacagtggatgagctgcttcactcaggttttcaacagcagcctgaaactctacttcatacaattttatatcaagtcagcttttctctgtggccagaccctccgtcttagtgtttctttcactggtggctgggaaggcatcccttcagcggggaaggcactgtgcctcatgtttaaaatgttctgcattctcctacagagtttcttgtgtgggatgatgtattctgtgatccaactctgaccagctgaaatcattttctaattttagcataaagcatacttcctttgactttttcaagaaaggagaaacaaaaccagacactgctttgacgttgttgctagaagggatgtcttacataattttatccatctatacattatttcctatgaaaagatgaccttacagtggcttcatagcatgacctgcatctcacacaattccctcccccatgcagggactagaatgtgatcgttgcaggaagttgatggcttctattcttgaaattgtggcattagctgccgtccctctcagcctgtgttttgaaggtcgcgcacttcctcagaatgccggccccactccgtttccagttcacagcgccacacagcttgttctcccattaaatgcaccttactattgttggctaatttgaggtcattattggctgattttgagaatgacttatttaacttttctcatttaactgtcattgtgatggaatattttgggttttccaggaatataaaatgcattaatggcacaccgctctaagaagttaatttttgattaactttgttttgattaaagttgagttttctaagaacataattggttttaataccagggtttggcagtgttcagtaaagatccagatggtaaacgttctctgctttacaggttcaggcctcttgcagctgtactctgcccttggaacacaacagcagttttagacaggcacaggcctgcctgtgtgccaggaaaacttttttaaaaaacaaaactaggcgatcaggccttagtttcgcccagtactttatcaccaggtgaagaataatacgtggctgggggggaatcaccttccttcttacagccacatgccctgtgtgcttttgtgaaattctcatctttttactagatgaagtaccttttttctataaatgttactccgtagctaataaatgtggctagtggatgtcttttgagtgctggggccccagctagagctgcccctcctgtctggggcagacgccgtgaggagccccacgctcggcccaggtggcgcgagctagtgtttggccccaaaaactgactgctgagagccagagatacgaatgaaatgataaatcctgaggtttatttcacatggagtgtttaaagagcagaaggaagtgcgtgataagtgccctttcgcggtgagcacgcgagtctcatgttctctgcccttcccgctctgtgcccttggcagctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccctggagcctgagctgcctgcggcccgcgcctcccctccggccctcagctgctctctgctacaaggaggtgaggtcccttgaccactcaaacagccagatgacggtgagcatgcctcgggccctgggtgtgcccacgtgctgggccttctgtgtacagcaaaatgcaccctaactcctagagaactgagaagggggggtctgccttggttctctggttatctgctctgctgctgagaggcccgtggtaacctgtgtgggaaggcgatgtgcagggtccccctcctttctgccatgcacaggggggcctttactgcacttgccggaggagtgtgccgccaggggccaggagctggaaaggcgctgagcccaggtggctttcactccctgtgtgtgaggccatcgctcagcatctgcacgctgtctgctgcgtctaacgacccctcctctaggttggggatcctgtccaggagccctgcattttgtcatccagaagccatttgagatgaagagaacatttactaatacaaatgaaaaacaatcacttaggcggtttccccctttgatgcataagaaatcatgatgcggtctttgcttgtctctgttctcatccggcatttttatatttgctaggcgcaaataaagtacgattccaatgaataaatagaagtgttaacacttccttacacttttacctaaaccagcttggatgaggaaaggaagtgtctttagaaatctgttctgagaagtactttcacctgaggaagctgataattgagatgagagttgttttcataagcagttgagcgtgcatggtggtgaggtatgaggagtggcggtgagagtgtgggtatcgtgcgcgtcagtgtgagcagcagtgcccgttggtggggtgtgagtgagcgtgaggatggtgacacgctcttgcctggcattgtgcctctgtgtctggtcaaggccacatttgccaagggaactggagcagactttttctacattcttgccggcagccctgggggttttaaggcccacaggaaagtactgtatgagaaattaggatctgtgcttttcattttttgttctgagtctttgtttttatgatatctttcaggtaatcatgtgtgcaagtcagaatttccattttctatcatgggaagttacttgaagaatgttgctgttccttattgtatactttagtgtgcacagtctaaagaaaaagtgagctactacaagaactggtggagactgaattactagggaagaaaattgggataaaactgttgggcaaagaagtagaaagggcaacggaaggggtattgaagtgaagataaacaattttttttgataagtctggctgcatttgctttgccaactccacactgggagagaagggctcacaccgagcagctgccgtccagtgttgctgagcaccgcccagcagtagcgtggagagtgatcttgcagggtgtgagaagaggacatggaggctcgtggaggccgctctgcagcccgctctgcctggctctggctcaggtgtgctgtgtgctctgtgaccctctgcgcctgcaggtgccctcggagcacgtgaggggcgggcgttggctcttcaaggctctccatctcaatttgcttcgaattagggaagccatgagcacatgtgtataaatgtgtcttctggaacagattgctgctgcatttctaagagctttccaattttttatagaaatacttttgtttaactttttgaaggctattttagattcagagtttgttacgtggctgtattgggtgatgctggggtttgggcttctggggtacctattacccaaataggaaacattgtacccaatgggtagcttttcaaaactcacccccatcaccttccgccttttggagtccccagggtctgtcatttccatggtcatgtccatgtgtacccattgtttagctcccaagaaaagacttttaaagataattttaaaaaccaagctttgtttcctctgtttccagcctggttcattccatagcacatctcatcttctgagtcttggtctcgcgtttagcattcgtgatggtttatgtcgttggggtgatgcagaaaccagcctttttttgatatcggtatttaacacgtgcttgacagttgacaccttacctgctctgttgggacttgctttgctcactttgttttttgccgtcgtcttctgtgcttgtttgaaaagctgtttgaagaggtaaggggtgggccattccgttgtgaacactctgagctggtgtgcatgtggcccctgcacagcagccctggccgagcttggctgtgctcctggcactcagagtcaggtagctgagcactcgctcccttttcttctccctgaaacttcaaatattttcttaaagcaattattttttacttatctgtcatttaatgacaaccttagtttcctcctctctttccagttagctgtgccaggggataggtctgtcctagggagcagctgccccctcctctcctcctccctcaggagcgtgcaggatgtctgtgcacaccagcgccagcctgcctcctggtgacacctctcatcacaggactaacaggacccaaatgacacgaggggttttattagaattaaaaaaaaaaaattagccaatgactaatactgaaaatgccctattgatttttaaaaattaacgttcagaagctggtaaagaaaaatcaaagtaggaaaaggcgagaagctcttatcagtggctataataatttggggttttatacctttacagcagcctttctgatatgccagtgaaaatgattggctttagagtatgttagcattttcttttgtctttccctaggatcttagtaagagccctaagaccatgaaaaagctgctgcccaagcgcaaacctgaacggaagccttcagatgaggagttcgcgtcccggaaaagtgagtacctgcggtccgtgtggtggaggacgtggcctcctggtcacgtaggccatggctttcctgggatagagggaggcttggtggctttctgaagactccaaacaaaagtaaggtctgccccttgaggcagtgataggaataagccacgtaacatttacccaagcaagcaggagaagcgcctttgtgtcagtggtgaagcctccgtgccagtcccggcaccactgccttatagccccttcctcatccaggagctggggccggacctggagggctctcctgctcttctggttctccctctcgcctataagatattccacccacacttcctgaagtgccagcatctcccaaagcaccctgtgtctgttagaagcgtgacctgctgtgttctcctgtgggtagcacccacccgtgctgttctcttgctggtctctctgctgttggacctgtcctgtctgctcctcaggcctaggggtctgactcagctctgggttcctatgtggcctcgcagcaagcacctggcacctgttaggtgctcggtagatagcttttgaataagtggagctcttttcagaagtaagtgattttcctgggggtgactgctgggaaggggtgcacgtgaacagattgctgtggactgatgggtgcagcccagggagagagagccagctctgggaaagttgcaggatctgtcctacagggctctgccctgccccgcccctgtgtctgagctcagcctttgttggtcctttgccttcactgctcacttcctccagcctcaggaggaggcccagcagccgtcccacacgctcactgtgccatgccactgctggcctcccctcaccgccaccttatcatcaatcagcccagtgaggtgaccgtgctggggtgttcattcttttcttgtccttgtcacctgatgtccatggcagtataagtcaccatcctgactgtccttctccttaggtagtccaggtccctgaccaccagggcccctgatgagatggtgaggccctggggtctagtgattgaagtggagctggtgctggatgcctgctctgttgcttactggctgtgccggggcttctctctgagagggctgttctgtgggccacttccttcagcagatccaggggcagcactgagctgggccgggggccggctgcagctgagaccatcgttcatggacgcgtgcttcatcagcaccttcgtgggctgggtgggaaggatacagtgtggccgaaagagatccctgttctcatagagcctatgttttagtaggaggatacagacaagaaacaaaacaagtgaacaatgtgtgggccatggagtgctgcagagacccagtggggaggacaggtgggagattcggtgccagggcgccatttgagcagcctcctggggctgaggaagcaggccaagcaggtgtctggggaggagctctccaggcctggttgcagagaccctgagcaggaaccccaggctgtgcccaagggacagtgcgctgtgtgggcccaagctcccctggcagagcgggaggtagcacagcaccctgagcagcaggcagccagagtccggttccatagacaagatgatgggcccgggttttcacaggaccacgggctgccgtgtggggaacagacaggcacggatggccacgtcgacactgagagttgtcggccttttgttttcatctggctggcgtgtggaaacacgaaaatgttttaattttcatttcttgttttagcgagattggacattttttcttagaactcttcttgttttgtgacttccttattcctatctcctgcccttttttcagtttgagagtggggatactaattttcttacgggttggtaggataatcattataaagttaggatgttcgccgtttttccaaatgtgttgcaaatatttttatttgcatttattttattttattttgaatataactcatgaattttgtagaaaacagttatctgacaagaaaatcaagggcagattatcttacttggtcactttggtcgagttgatgtctgcattgcattcgtctcgccagttgccctagaggcctttcagttcgactgtgaactgttgcgcatctcttgacaggcacagctgctttggaagaagatgctcagattctgaaagtcattgaagcttactgcaccagcgccaaaacaaggcaaacactcaattcaagtaagtttagcaataaggcctgggaagtgtggtggtttattctgtttagtttcaaattacagtctgaaggaacctgttgtggtaggccccttgcacagcccatgcgcctgacctcccagtgagtgatgtttcagtcaggggtggcaggcaggacagcagctgagcttcaggtccctaaattcatgcagctgcgtctgagctgtgggcacaattgctgtgtgattttctagataaaattatactaggaaatatttaaatagaaggtattgccagaattcataatgcttttgctaagagaagacgtgtttagaagatagtggaagattagttcagttatttcagctatttaaactgttggtgtagtactggaatttttggtttttattttgttattattttttagtttcttagaaatatccaaaatacaaaccttgagcaaggtttcttttagcctttctaaaaaataattgcttttaaaaattttttggaaatttacaactaatttattcagcagatttcagaaccacaggatttacgtgtgtctgatgtacagtgtcttaaatgaaaaacttttttctattaaggtggcttttttttttctttttggagacggagtctcgctctgtcacccaggctggagtgcagtagcgtgatcttggctcactgcaacctctgcctcctgggttcaagtgattcttctatctcagcctcctgagttcctgggattacaggtgcgcaccaccacgcccggctaatttttttgtgtttttagtaaagatggggtttcaccctttgggccaggctggtcttgaactcctgacctcaggtgatctgcccgcctcagcctcccagagtgctgggattacaggcgtgagacacagtgctcggccctaaggtggctttttttctttaaatttttcctccggtgttgccagtgaagcacagcagggtggcggctgatgcagcgtgcctgtcatttaccctgctggcatctgcgtgcccacaacagctgacatgtgggcacgtgctgctggggcctcggacaccacaggtggtccttttgagaactggatgatttctgtattatctcagcatagaaactgatgtatcctcaaatttaggacttggtgccctttccagctcgactgtcacttaatctcacttgctcgttttgttaatcacctgcagtgtggtggttccaattagtgtcatgtattgtttaatgctgagaaaaggagagagagggaagaggacttctcaactgctttagcttttatcaaagacggctgcagctgtgaagataggatgagcagggtaaatccttcacggaatctcgattatccagaagcttctttttttttaaccattttcagtattttactggtgtcgtaccatatcccgtctatgacattaagactttttgccaagggtcaacactgttggtttttttgtccatactttagtgaaaaatatccatttgtagtgactgcttatcagaataggagagaaatagagaaacggaaaggcctgggtaacccatcagaaggtggaataaatatgtgtataatcacacaataacgtctaagtacaaattgttgtgatgaaaggtactacatttttataatttgatattgatcatgttttaagtaataggctgtaaaatgtggccataaatttttggattttgaatttgagatttttttgtcatctcaatttcagttacttgaaataaaattttaaccaagtagtcttagatgaacagaccaggttcagttggccacccaaccgtgtctgtgagttctgcatttgtgaattcaaccaactgcagataactactcagaaaaaagaaacaataaaaagtaacaatataacagtaaaaaataatacaaataaaaaataattatacttataacagctatttatatggcatttacattgtattaggtactataatttagaaatgactcaaagtatatgggaggttgtgtgtaggtacaatgcaaacaccatgccatcttatatcagggactggagcgtctgaggattttggtgtccaaggggagtcctggaaccaatcccctgtgggtgagggccgactgagggctgagctttgtatgtgtcatagtgcccaccacatttcttcatgaccagggtcctgtgatacgctgcggcttcacggcccctggctgcctaaggggaatggcccacaattccttttcttttcttgtcacattgcctgtattctgtacttccatttctcctgtgcaagaaaagcattgaacgatacattgatttttgtttttaattcatattatgggcaaaccactctggggcttcagggagcttgcagtcatatatgccctttaaacctaacactcaaaactagggagtaataggagaaattgctcgcttgtgctggaaaggtggtatacttactcaaggtgtctggaaatgggatcatagtgaaagcagctctttttacattaaatgcttagtaaaacgggttttagaaggataatatattttacctaaaatgcagctctgttcaatacacacatttggatgccaagaagattttgtaaaccaaacttccttggtattgatttctaactccaggaagtaacggccctcacagtctgttatgatgtagttctcgcagtctgagaacagaggtcaatttgatagaagcaggagtagggaggggccagggctactgtgatttgccttcacctagcgaggggcatccccgcctctgcatggagggagaccctggcggcccagcctgcctctcagcccaggtgcctggccatgggcagtgctcatagttgccagccactcgtgattatttctctcctgacatgttgtgccacttcctctgtcattctccttttaacactgggacgttgccagttcatgtctctcttcctgacagcagagggtctgcattggggtggccggtgttgccagcagacccagcttcccactgcaccctgcctgcgggctaagctccagcgcgccctgggagcagggggtgggttctggggctgtgggccctgcccaatccttttctgccctctgagttctcacagtggttattgattgatcaggtaagtccagacccactctcaggtttatggtcttggcaaagagccagctgaaaaagcccgtcagaattcctttgaaattattttgcatttgatacatctgtttattgataggaaacaatttttaattagccacataaatggcacctttcccaaatgatgtcctaaatgagactatttgttaattgaatgtggaatagaattgattaattgccacatgtctatagaataatcttttggacatgggtgtgatttgtaaaagatttcttaaatgagggctttagagcaatatctttttttaaaaaagcagtttgaaacattgtatattaggtttaattagataataatcgatctagttttattctaagggttttgctaagttcgttattgtgaaacccagccgtatataaggaaaaatatgcattgttgccaatttttaacactattttctcttttccttctcttcccatcaccttttgcttttgttccatgttttggttgtggctcttcctgtcgttctcctcctcaccccctgcctgtcgcgcctgtccctccgcccgcccgtcttagcatggcaaggcactgacctgatgcataatcacgtcttggctgatgatgaccaaccaagcctagactccctggggcgtcgcagtagcctttctcgtttggagccttcagacctctcggaagactctgactatgacagtatatggacagcccatagttacagaatgggttctacatctcgtaagagctgttgctcatatatctctcaccagaactaatgcacttctgagcttttcttaacaaatgcttgttgtatcgcagcctgcttttcttagatgttttcttgctgttccttgtctcttttatgtgatattttaacaacttttgagagtgttcctgatatttcccattgtactttgtggaggcttaactgccgatgcgagtatacattcgaatgactgactattggagggaggtggtgtgttcacgtgagcctacatccgagggtgctcttcgtaaggggtagttgttgttttatagctccaaatggtttttttattctcagtgtagcaactgtttgatttctttctggatacagctgtatgaacacttttctattttatactgaaatcacacaggtttgtgatctaagtgccagaaccatggaggagactctggccttatctgtagggacctaaattttttaagtgctatgaacactgatcaagtagttgtggagagatgagaagaatatatgcagcaaaggtgctgtgagcccagttccaacggctgtgttctggtaatcgtgcagaacagcatgtgggctctgggccttggcaggtgcacagacgggcgggcgtcacgtgtgttcagagcttgtctccacctcacggctctgtgctcttctgtgtgctgcgttgtggccgtgaagtgggagctctcctttccaaaggcagagcttactgtcatggctcagatgttcactcgcatcttcaccccaaacttccctgaattgcagtgatttctgttataaggcacatagcaagcctgtaccactctacagtaaaatctctacactaacagtttaaagcccgaaagctgaagcattcagcctctgcaagtgtagactactggactgtagtagaggcatttggaatacttacaaagtcaagtgctgtggcttcagttcccccggctccccacccctgacatccatacttatgttgtctggaagagccatggacacatcattattttcagcaaccagctgcagtgaaactccatttacagcaaccccatagtataaaaccacaatgcctcattgtaatgggatattgaagttcattgaagaattactaggttgccatgtggctcacttatttaaaaaaaaaaaaaaaaaactcacccgttttcctgggatttgttgtaaggagttttcactggcctcactcagaccaatttctgcttcaaaaagcactgaatgtgacctgttgcattcagttgtagcatcaaatccacacctagtcattgcttgaggggccaaattgtgttctgtcccatgcacgctctatttggtgttaaaatggaaccttacggttgtgttttaagtattcattgaaaccagcttcagaaaacaagatgccatagtaaattgagaataacattttttccttcttcagggtggctgtaattccaggtggccgtgatttctttcttccccactgcccactccttcgccaaacccacgtattcagtgttctgatcttgtttgtgcagagtgaactctgatgcagtatcagtcttgtcctgggagccgggtcctgctgctcacaagcccagagctgccagggagctcctggcagtagcacgttgtttagaaagttgggtggcttcattcagcatggaacaagctaatggcacaggagacatcagggcagctgttaattccaaatatttgttcccaagtagctactgaactgctcacaccattggaagattttgtattttcataccaattagtaaaaataagaacattgaggagcagtcagagcccagtgttaatctccggcagagatggggtttatgtatgttcagccagatagtaaatgggatttttggagaaataagataactacaaagtttctatacttactataagtggatttagaagcgattttggttttgtattacatacggtagtcctctgcgtcagggagcacttttttgtttgcctcgagactactcattagcgcactggctaagctgcctttgccttctcgtaggcgtgggttgcctgtgtcatgggctgtgtagaccacaacactcaaacacagttgctgcacttggattttcctttaataccaagtatcatttggttatcttactgggacattttcattgatattctatacaccaaagttttgacggtttaccatcattccattttgtaccagttaaaggcattttgatgatgctttttcttgatgctaagatcactgcagaagaataacctgaccttttctttgcatttgttttgaatgtctaacaccattagcttttgtgatctggttaagaagtattagtgccacaagcctgaaaagacagttctcctgtggcagtggcgatgtggcatccagagggccattgtttctacttttgtgggacttcagtcatgctgataatagaatcttctgttcatacaattctgtaatatttatttgtacagttagtattctaatgaaaggatgaagagtctgaactagaaggtaggtttaagccatcaccaggcctttgcaaatggcctaaatggtgttccctttgaaataacgcttgccacaagtatataataagctatattaattgtgttttgcataaaattgccaaaacacagtaatgtgtatatagtggtataagatcttgaaaaaaatctctataattgtgctctttatctgtgaatgggaaaagccatttttagtaggtgactaccatttgaaaaactcaattggatgtatatctgaatgttgcattgtattgtacagtatgcatattattgtttgtggttgcatatggcaatgaagtgtttgttttatattaaaaaaaacctgttatgtacagttgaaataaattttgcatttgctagcc

SEQ ID NO: 335 - DNA, 179919 bp, Homo sapiens; identical to SEQ ID NO: 334

SEQ ID NO: 336 - DNA, 179919 bp, Homo sapiens; identical to SEQ ID NO: 334

SEQ ID NO: 337 - DNA, 651 bp, Homo sapiens
atgaagctgaatctggtgcagatctttttcatgttgctgatgctgctgctgggcctggggatgggcctggggttgggacttcatatggctacagcagtcttggaggagagtgatcaaccgctcaatgaattttggtccagtgactcacaggacaaagctgaggccactgaggagggagacggcacccaaaccacagaaacgctggtgcttagcaacaaagaagtggtgcaacctggctggccagaagatcccatcctcggtgaagatgaggttgggggtaacaagatgctcagagcctcagctctctttcagagcaacaaagactatcttaggcttgaccagacagatagagaatgcaatgatatgatggcacacaagatgaaggagcccagtcagagttgcatagcccagtatgcattcatccatgaggatctaaacacagtcaaagctgtctgtaacagtcctgtcattgcctgtgagctcaaggggggaaaatgtcacaaaagctcccgaccttttgatttgacattgtgcgagctgtcccaaccagaccaggtcactcctaactgcaattacctaacttctgttataaaaaagcacattattataacctgtaatgacatgaagcgccagttaccaactggacaatga

SEQ ID NO: 338 - DNA, 946 bp, Homo sapiens
gaacaaccagctggatcagttctcacaggagccacagctcagagactgggtaagtcaacaatccccagagctgggacaggaggggcagcgacagggcagcacctgagggagaggtgagctgaagttagtgcttaggagatgtggcacactttggggacaggaagaaaaggaaatgcgaccccagagtggcagcagaggggcctgtgggttgagacactatagagtgtgtcataaccgagaccggatcggggagtagttacttctcttcttttcttacaggaaacatggttccaaaactgttcacttcccaaatttgtctgcttcttctgttggggcttatgggtgtggagggctcactccatgccagacccccacagtttacgagggctcagtggtttgccatccagcacatcagtctgaacccccctcgatgcaccattgcaatgcgggcaattaacaattatcgatggcgttgcaaaaaccaaaatacttttcttcgtacaacttttgctaatgtagttaatgtttgtggtaaccaaagtatacgctgccctcataacagaactctcaacaattgtcatcggagtagattccgggtgcctttactccactgtgacctcataaatccaggtgcacagaatatttcaaactgcacgtatgcagacagaccaggaaggaggttctatgtagttgcatgtgacaacagagatccacgggattctccacggtatcctgtggttccagttcacctggataccaccatctaagctcctgtatcagcagtcctcatcatcactcatctgccaagctcctcaatcatagccaagatcccatccctccatgtactctgggtatcagcaactgtcctcatcagtctccataccccttcagctttcctgagctgaagtcccttgtgaaccctgcaataaactgctttgcaaattca

SEQ ID NO: 339 - DNA, 836 bp, Homo sapiens
tgcccctgaaccccagaacaaccagctggatcaattctcataggagccacagcgcggagactgtgtaagtcaacaatccccagagttgggacaggaggggcagcgacagggcagcaactgagggagaagggagctgacgttagtgcttaggagatgtggcacactttggggacaggaaggaacaggaaatgggacccaagagtggcagcagattggcctgtggggtgagacactatggtgtgtgtcacaaccgagacagaatcggggagtagttacttctcttcttttctcacaggaaacatggttccaaaactgttcacttcccaaatttgtctgcttcttctgttggggcttctggctgtggagggctcactccatgtcaaacctccacagtttacctgggctcaggggtttgacgtccatcagtaggaaccagctccaatgcaccaatgcaatgcgggtaattaacaattatcaacggcgatggaaaaaccaaaatacttttcttcttgcaacttttgctaatgtagttaatgtttgtggtaacccaactataacctgccctcataacagaactctcaacaattgtcatcatagtggagtccaggtgcctttaatgtactgtaacctcacaactccaagtccacagaatatttcaaactgcaggtatgcgcagacaccagcaaacatgttctatatagttgcatgtgacaacagggatcaacgacgggaccctccacagtatccagtggttccagttcacctggataccatcatctaagctcctgtatcagcactcctcgtcatcactcatctgccaagctcctcaatcatag

SEQ ID NO: 340 - DNA, 229184 bp, Homo sapiens
aggggcgagtcctgcgcgagtccccgggaggcgccgcgcgcttggaagggacggtcgggcttccccggcccgctgagggctcggcggcgggctcccctcctttccacctcgggagggagggaaggaggggagggaaaagtcccacggaggaggcagaatggccagtcgaggggcgcttaggcgctgcctttccccagggctgcctcgactcctgcacctgtcccgagggctggcctgagacgggactcccggttctcccgctgcgaagcagcgcggccccccggggccggggcagcggcgccggcatgtcgtctggcaccatgaagttcaatggctatttgagggtccgcatcggtgaggcagtggggctgcagcccacccgctggtccctgcgccactcgctcttcaagaagggccaccagctgctggacccctatctgacggtgagcgtggaccaggtgcgcgtgggccagaccagcaccaagcagaagaccaacaaacccacgtacaacgaggagttttgcgctaacgtcaccgacggcggccacctcgagttggccgtcttccacgagacgcccctgggctacgaccacttcgtggccaactgcaccctgcagttccaggagctgctgcgcacgaccggcgcctcggacaccttcgagggttgggtgagtagcggtgaccccttccctttgtgtccacccaacccccgttccccttatgtttttcaaaactcacccgggtcccgctttcccatcgctttgtggctgagggaattccctccagactttggtcttcgtccacgtggccgcggcactggtgacgcgaccgcggtgggtgtgtgcaggcgcaggtgtgtctccaggaagccggcctggacacgatcccctttcaggacagcggcttggcctaacgggaagtcgggcaggggtccagggcggtcaccctttccgcccagtctttgggtaaggagctccaactttcagcacgagagtgataggtaggaaaggcagggaaggagtgatacaaaagggacttgatttgggtaaagtgcttcaagcgctacttaggagaaagccgtacattctcgcgagtattattcataatgtttatggatacatgttggttcagccgctcagacgtgcacacgtgtttcggcttgcacatcccagaggtacatgagctacactggcagggaaatgagcgcctgggtctgcacgttggcagttttattatttagcatttttccaaggagatgagatttacatatacttgcaagtaacttagtcagtccgaggtgggagtcctgcagtgtgggtttctgctgctatgggtctgagaagaggctgtaaggactcctcaggaggttgttaactgtcttccctccccccatcaccagcctgtgttcctgggtattgacgtgtagctacccgcagctctccccttgcctctgcttttcacatagttcccaggaggcataatttctgctgtaaatcaattaaaacttctagagcgctctacacggtgctaacatgcttttactgcctaatcctcacactgtctttgtgatgcaggtgtcatcgttcccactttgagatgatggaatgataattataataaagtagtctggtttggcaaagtggagtacgccatttgaagactctcaggagtttaatagtttaagttctggagggagtcagttttgaacccaatatcagtattgaaaatgtttgaaatttacaagtggtgaaatcagatggatggtgatgaaggctcatttaggtatttattttatactttgtggaattagtaattttaccgtatattttctaaaattaaagatggcttgtggagctattcctttcttttaaatagaagtacaaaaaccataatgactaaccttaatcgtcaaattatattgagttaatttcccttcagcctaatttactttgtggtacttagaagtggggactagagaggaattgctaaaatacagttagatatttacatttatcctgtgaatttctggaaatgaaatagaagtgagtgtaggcatccagatggaattgttgagttctattagtgtctgattaggagttaggtcgggcaaagctctagaggaactaggttctgaattatggtggtgcagattggccagtggccatgagaagcatctcttcctggagatagcctagactcgtccttctcaaccataatcttcccacttgaatcacccagggacctttaaaaaatccccacttttaaagattctagataggaatctctggctgtgggaccccatcatccgtacttttaggctcaccaggtgattccagtatgcagtcgaggtggagaacctgcagcctacatgaagaccaaaagatgaggacttcttggtgtcataagtgtaggaagatccacgttatctgactaggtggcatgtacagagctgcttattgttccactggatgaatattcagtgtaaatcagatatcgatatttataatggtctgaaataattacacttagatgtttaatataacccactggtggtgttttggaaaacgttgagtggttggtagggagggtcagcatttaaatgaccttgaaaccagcagtttttcatgcgtttgcatgcatcagaaggcagattttttttttgttgttttttttaaaaaggttttgggtatttcagaactgtaaggatatggaacataggttgggcagagtgttgtttcttttctttttaaagaaaatcttgttaaaaaaatttggaaatatatggaatgcatgcttttttaaaaaagtatcctttataggttcaaaaatgctttaaaaaaatagagatggggtcttgctaccttgttgaccaggctggtcttgaacttgtggcctcaagccatcctcccacttcaacctcccaaagtgctgggattacaggtgtgagccactgcatctggcccaaaggtgcttttgaagttcaggattaaagaaatacttatttatctttagtattttaaattgacatgtagtttattcagagagttaaatgtggaataattgaatttactccataataaatttatggttgcaagtggaactacagattactgacttaaaaaaaaactattgaagttgcaggttcaaaaaacccccaaaacctagtgacttagtttttgctagatccagagaagctcttagctgtaggttatggatgagaggattcaatatggttaagatctcaattcttcccaaagtattcaataggttcagtataatctcagtcaaaatctaagtttgttgtagaaattgacagactgactttaaaatttatatggaaatgtaaagtactgagaccagtctaagaatagttttgaaaaagaacaagttgggggacttagagtatctgatttcaaggctaactgtaacatgaccgtaatcaagataatgtgatattggaataaagagagtcatacagatcagtggaatgaatagaagagagtctaggaatagatccacacatatatgacccactgatttctgataaagctgccaagaaggcaactcagtgggggaaatgatagtcttttcaactaatggtgcttgaacaactggatagccacatacagtaatatgagccttgacacttacctcacatcctacaaagacattaattcaaaatggattatagacctaaatgtaagagtttaactgtgaaacttctataagaaaacaaaattgtagtgaccttgggttcagcaaaaaatttttagatagcgtacaaaaggcaccaactataaaaaaatcagtaagttggactttatcaaaatgaaaaactattgcttcccagagaatgtttaagaaaataaaaacccaagccacaaatgggggaaaataactgcaatacgtaaatgaaagatgtgtaacatgaatatataaaagaactctaacagcacaataataatgagaaaaatacctaatttaaaatccaacaaatgacttgtaacttgtcaaatatttcaataggcactcaccttcatgccaaatagcacattaaaagatgctcaaaatcatgagtcattaaggaaatgcaaattaaaaccaaaatgagatctcagtatgttcccactagaaaggttaaaattaataagactgaccataccaagtgttggtgaggaagtggagcacctggaactctcatatgctatggtgaggaatgtaaaatggtaaatcatgttggaaaatagtttggcagtttcttaaactatcaaacatatgcctactatataacttactgtttagtatttactaaaagaaatgaaatcattcatacaaaagcttgtccacgagtgttcatagcatctttatttgtaataacccccaaagtggaaacaactcaaatgtcaacagatgaatgtttaaacaattgtggtttatccatacaatggaatattactcagcaataaaaaagatgaactattacacatgtaacaacaggaatgaatctcagaataattatgctgagtgaaagaaactagacaaaaaagtacggtttcatttatgcaaaattctagaaatgaaaaggagtctatagtgacaggaagcagatcagtgggtgcctaaaaatggagagtggaggtaagggaggtggattacaaaggaggcagaaacttttaggggagatgaatatttgtgttattctgattgtggcaatgatttcacagttatatacatatgtcaaagcttattaaatagttcactttaagtatgtgcatgttactatatgacaattatacctgaataaagctgtggggaaaaaaaccaatcagcgcttatccatattttactgaaggtgttaagtaagatgctagtaaatgacagaatttcagctgagccaagtctgactcttgaaaactacatttcctctttagtgcagaaaatatttatgagaatgggagcgtagaaaaaatgaaatcacaataaaacaaattagtttctgatttttggacatggtctcattttctaaattatcactgtcagttttttttctgctgcttctagaacatgtttattttgcataatttctctggcttccaaaatctgaagaattgcctctgtttaaactctattttcttctttcgtgtacttgctcttgatttgctgaccttctaaatggggaccagcatctaatgcttaatgcagagtgctggggacatggggaggcaggaggagctggaggctgcgtcatggaaagaccttggcgccccctcaggaaggaaggactggcttggcaggatcccaggctgttttcctggttcagccctcccgaagacattgtgttctctgcagccctggagggcctctttctctcaatttctcagtgaggtacctgttttgtaatcagtcctgtcaggtgaagcagccatgttactactggacaatcatggattatcttttcccttccttcctggatccaggtgtctgaatttataccaccaaaattcttccagattttctatctagtggttcattctcttttgtactttgtagtgccgttgtttattctcatgattgatttttttctgagccaattggaaggaatgtctaacactgactgatcaacccacagtgtttaagaggaaaaatatattttagaatcttgagggagttttatttcagtgtatgtgaattgtattggctatgtagcgtcttcattttcattgtaagaagaattttgctacagtgggaccggctgcttctcatcacaaacaggttgtggctcagatattttcccctttggagagcattttcctggtcatattattatcttgttgtctttcgttgcactcattgctctctgagatcattttgttaatgaatttgcttattatactttcctcctttagattacaaatggcttgagagcagggacccacctctcttattcactgtcctaaccctgggacaatgtctcatatgtagtaaacattaaatatttgttaaatgaaattttatgtgattgggggacaagtaaagtgtaagtactttgggagcatctttccatctttctaaaagaaagaaatgaaaatagttgaggagttactggatgaacagtattcctctgttaaatcaatcaatgacataccaatatgtgcttgaaagactgggcctgggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcggtccgcagtccggcctgggcaacagagcgagactccgtctcaaaaaaaaaaaaaaaaaaaaaaaaagaaagactgggcctgactgctatattctttgaatatggtaatggattgaaaaccttgtgtatggaaaattccctgctcttacgtcattttaaaagactatgattttaaaacttgtaatacgttataacgtttttcacttataattttcacgcccaaaatgttaaagtcagggcagaagcaagacatcagcatttaaaaggttgtgcctcagccttggagaggaatgaggttggtgggtggaacgtgaatcattttatcttatgcaactcttagtgaagttttggtatctagtaagtgttaagaatggtgattagtggtgatggtaaaagtgtggtgcatttttatgagaagagtagcatttgcgtagaataatagaggtgcctgggatttttggtagtccttttttatttaataaagcaactggggccgcgtgctatggcttgcgtctgtaatcccagcactttgggaggccaaggcaataggatcccttgggcccaggagtttgagaccagcctaagtaaaatagtgagaccccatctccacaaaaaaataaaattagccaggcatggtagcacatgcctctagtcccagctacttgggaagctgaggtgggaggatcacttgagcctgggaggttgaggctgcagtgagccatgatcatgtcactgtactctagcttaaatgacagagcaaaaccctgtctcaaaaaaaaaaaaaagctgaaaaaacagtcaactagattgtgttccccttttgtgttgacttcttagctccactttattagaatgtgataaaaatgagacctaagtggaaacaatccctgtccattgttttccactcttatcattactgtatccaaaatagtctttctcaattgccaaaccaatagtcatttctttatttaaaactcctcctctgtggttctccactgctcttagataaactcctgagtcttttttttttttttttttttgagacagaatctctctctgttgcccaggctggagtacagtggcacgatctcggctcacttcaacctccgcctcccaggttcaagcgattctcctgcctcagcctctcagtagctgggattacaggcacacaccaccacgcctggctaatttttatatttttggtagagacagggttttgccatgttggccaggctggtctcaaactcctgacttcaggtgatccgcccgccttagcctcccaaagtgctgggatgcaggcatgagtcactgcacccagccaaagtccagagtctttaaaatggtataggatgttctccatgatctgtaccctgtgttcctcttgagccttttctcttacatttccccaaattacaatgagcatctttcagttcctcaaaaggaggaacacttcgctttgctaattcttccttgtgcttcaggtctcattatgggcattaattacccagacaactgtccctgatgtgccagtctgggtttggtcctcctcctagtgttccctcagtatcctgagatctcttttgccgctgtctcctccaacctgaaagaacggacgtatgaatggattggcctctaatggaagcgtgtgacactggtcacagggagttcagggtgtagttgtttgaatgattgactaagattcatccgcttggctcttgtagtagtgactctgacagactattacatgtttctatttgaaatgccaagccctaggtgagcatccagccaccaatgagcatgtactaagtaccaggcattgtgctctatcctgtaaagtcaagtggacaggacacacatgacccattctttcgtagggcttgtaattccaagggggagggagattgggataaaaagcaaacaaaagcaactagggaattacagaagtacttacaggcaggtaagcccctggtttggggaggtggggaacatcttcctggaggaaaaacaaagagctgacttttaaggacccagcctagagagccacagcctgcttcagttaaatgactgtgaacagtctttgctcaaaagaagaaaaggaacttctgacctgataatgtttcccagagggacatcgcagatgcccttttgaaaggtaaatgttcctgacccacagaaatgtttccatctttggaaagtttgggagggaactgtttccatgcttgtgaacagatgacctgcaaaagaacttttgactccacaaaggcagaaagtaggaacactatatttgaaccatcaaataccttaagttttgtatagatcataaaataatcatagatgttgaagcaggatgatcatctaattcagaacaacaacaaaaagcctgatagctcttaggcctgcagacagcctgtaggtctattcatttggcacagatgtttttaacattgaaactgaaggcatttagtgctgtggtgctccagtttgccacagacccctccactccctgttatgaaaccaactctcttgactcattacttgcttggacctgggacattttaaattttgtgacactatagctcaagcctttgttttctgaatgtgggaaccaaagttccagccaaatcattactgttgccctaacaggggtgtccaatcttttggcttccctgggccacgttggaagaagaattgttttgggtcacacataaaatacgctaacactaacgatagctgatgagctcaaaaaaaatcctcaaaaaaatctcataatgttttaagaaagtttacgaatctgtgttgggctgcattcaaagctgtcctgagctgcatgcagcctatgggctgtgggttgaacaagcttgccctaactcatgagaagtgtaatatacatacatttaatatgtattaatatctatctaatctatatctacaaaaatacagatatacttacttagatttatttagatatgtaataatttattaatttataaaatgcattagtttagatatatatttacttagatttttacttacataaagatttgtgtcctagtatttcagagaaagctagcttactagtaaatatatggggagttaacttttactgcaaattagtattatattaactatccaatttaaaaagaaagcaaactctgccaggctggtatggtggtgtgcacctgtagtcccgtgtactggggaggctgaggcaggaggattgcttgagcctaggagttcaaggctgcagtgagagctatgatcgagctgctgctcctcagcctgggcaacagagtgagactttgtctcaaaaaaagaaacaacaacaacaacaaaaaaacccctctttttatttcgttatacaactcccagcaataggggaacactgtactttaatgggtgtcaggagaactgggttcaagctgtgaccttaggcaagcgtctgcttatctgggtcccatttccccgttatattgtgagggggctgcactaaacggtctccaaagacttttatatctctaaagcctctgcttccatgtgttaggcaatcacataatttcttcccttttggagtaattggtttggtttaaactgtcaaaatgaattatgtgttatcaaagttagtaactcctaagaattaaattggtccaaatctaaattgcttagagttggagaggatttagctcccatctaagtgacttgtatagcatcgctagtgatgttggtattattttcttggtttagaatcagccttaaggcaatacatttcaagccatgcagttgtatttcttgatttatgctaacgcactccttgttctatgggatggttgtaagttatgtccctgttacggcaagtcagagagagactgagaatcccactgttttgctagaagccattctcactagtttggcaattacagcattattgtcccaaagtatctgtagctaccagtctatgtatccacccagggtgatgacaaatactacaaatcactgtaggacagacattttaattagagggaggaatgagcccaagggtattgactatggtagtgtttaagtgctgtgttaaagaattttatgagacaggaaatttttgttgagaatcatggtcctatctggagatatttatcaagattattatgttagtgtgcttctgtagcaccagtaaattagagcagtatctgtcaaagcacataggacttttgtagtagaaagcccacttaataggaagcttaccagcagtgcttttattatgtactgccttcccaaaagttcctttgattgcgtataagttttacccttgcacgcctttgacctcacagggagataaatgcttaaaagttaccaaagatgtttagtttgtgcttgtggtaaaaaattaagaaatttgccagagcataaaaccatggtcaacatgatccctgtcataattgcattaataagtcatataggccagagtgagcatattctatacctcgtcctgtatttccaatttcagacctagcctctgttctccatgcacttagacaaaaaccgcaaagctgcatatttattcgtaagtcacatctgtcccttgtactagcatagctctgtctctccacctctcgtgtcgcaagcccttaaatatgatacactctttccttacaatggactttggtttttgcgtctgtgatgttggagggctgggccccttgagctctgtggtccttccggtgtcagagttttgtggttctggtaatggttccgttggacaatggaaattctgctcccttctgaaatatattcaggagacttctgatactcagatttgttctgggctctgaaattattttgggaagcgcacccaaaagtcatacgtgtattagcctaattccataaacagaatacatttatttatttgcaagctgtgggcctcttagatgctttaatatagattactgttgtttaattatggtacagaagagttgagagcagattccatctaaatcagtgcttttgaaactgttgtcgagccctagacccttttagagatgatgagagctatggagctgtttctggaaaaatgcacatatgtgcatattgatgatattctgggaacaatgtcatctgattagtagccctcctaaagcctttcctaaaccttaaggacacaggacctcaggttgagaaacctcagttgaaagggttcaaaaataaggcttttattaattcctaacattcagggtgtggttccagtgttttcctttgtatttgaggacattttcacttcaattaattatagaaaatagttacttagtagaaaacaggagctaggagctataaattttagagaaaaagatgttcttaaaaatgtgttctcacttatggcttctggtgaaatatactagatgatgacccattttaggacctatttggttgtgttatttaggtgttttcaaaagcctctatttttttaaagagtttgtttgaggtttgcagtagatgaaaacttaaaaaaacaaaactaggacagtttgagtgaccctggcttggtatcttttgttaatataaacttttcccttgtaaaaagaaataggattcatctttttcatacgctttttcttaaaacattcaccctctttttgagctgcagtgggcattatggtgttctgctgtgttagtctaagacaaaatgatgagattggtgaggcctgcctgatcctcttaccctttgagccccagtctcccatggtctgggtccccgtgacccagcagattttttggtcctctctggaattccagttcactcagtcagcatcttacagacaacccgatgttggtggaaactgagctgaatggagactgtccacagagcagccccctagctaaaggtaaagtgagaatccagctctctagacttcaggccaagattctttcccgactccacctcagtgtgtggtggaggcagcagggtagccatccagtcagtcattcataggtgtttattaagtatctaccttgtgcctgagcctgttctaggtgttacaggtagggcagagaacgcaagacccagcatctcggctctccagcactgccgccctagcacagggaggtggataacaagcaggcaaacgcacgatgaagaaaatgacaaatgctgggtaggtaccaagtagagaatcaaagcagggtgacttgattcagtgtgacaaggtggctgctttatctggagtggtcactgtctgcgaaggacaggtaaagcactgtgcagcagacttgctgcacagagcgggtgacaattcagctgaggcctgactgacaagaagcacacagccctgtgaagattagagaaagagcattccaagcagaggcaacaaaggccctaccgtgagaacaagcttggcaggtggaaaaacagtggagggtggcagaaagagagtcggcttggtgtcagaaagctcggggcattgtcccagatctgttgcttcctaggagtgtgaacgatgagcaagtccctccatctctgatgattagttttttcttttggaaaatggtgctaatgtttgctaccttataggcttggtgtgaagattagatgaactacattaaacatgcccagcacaagataggcactggagaaatgctagctttgggtgctttttaaattaattaattaatttatttaatttttttagatatgggctcgccatgttacccaggctggtcttgaactcctgggctcaggttatcttgcttcagcctcccaaaatgctgggattataggcaagagccgccactcctagcctggttgctttttttattttaatctttaacaaaattatttatttatttattttttgtaatcttggcaggcaaagctttggttgcttttaatttcctgaggaaatgaatatttttgacaagggccttctgaaaagaatcgtactggctgaggatagacacccacagggttgcctcttagaaaagagggtggtggtatgaaagtttcttaggggtggggtagggtatagtcttgttggcgccctcaaatgacatcatagaagcatctagttatctctacccccttcagtaacatgttttctaaagagaggatggggaaaggaaacaaagactctgaagtttattccgtatttttcagtttctgaaaagtgtatttgttttctatggactcataaatattaatggaaagtttcaataatttagatggacaggataattgcattgtagtggtataactgatagggccccaacttgtttttatttgttacaaaactatacatttatggctgagaattaataaacatactaacagtaatcataaaggaaataaaacctcagccattgtaaaaaataaaaataaaaaaaaccacaacccccccatctgccaaaactagatataattgattcttgcttaattctgaaagctcatttactttttggattataattttgtgaactaactctggataattttgcctattttgaatagttttagataatgcctattttggcatctccctgaatatttctgaccatcccttcaacatttatttggtctgtttaaagaagacacattaacatttgcctaagtcacatgaattaggatgcagaatctataattatggactaatgatacacaaatacaggctttgaggagtatttattggacaactaccataattatcagtgcatcatagtgtgatggttgggtgtcagccagattggggttcagctattcattctgcctctcattagcagggataatttaacccctgcaagcctgttctctcatccacaacacagtacctgcctcacagggttacttcagaacacagtgaggacttatgtaaaccatctacacagggcatgacatatactaccgcagaaaaatgattgttgatgtcactttcattaccaccactctaccctcagcacttcaatatgaagtgatgggcccagcccttttctgaagttaactttgaaagcagtaagatatttatttacatagaattcaagagaagggatttttgagtacaacttcctcactggttttgcttttaatgtaggattctggaatgtaaatcagtaggagatttctagttactggtggaagagaagatggcttccttatcccggaatcacagggattgggggtaaattctgtacataggtcctctctggaagttcttgtaaggaatatgggaaaatgaagctggaattattatagttacaatgttggctaaagttggttcatggaaaccttgaaattaagtttgttggtttgcttattcaatattggacagcagagggtctgagttagtgagaaccaacaaaccagaaataaatcaagttgcaatatttagctgcaaaggacagaaagaggcctttgaaaagctgaagtgagtacttttattgctgtaattaagggaaataatggtaaacaggctctttcaattggcattaaaatatattttccttggttagtttgaatatccaatacaagttggtggatgtgaattgttctgtcatgctttcaaggaggaaaactctagttttaaaagtacgtcattagggccaggtgtggtggctcatgcctgtaattccagcactatggggggctgaggtgggcagattgcttgaggtctggagttcgagaccaacctagccagcatggtgaaactctgtctctactaaaaatacaaaaattagctgggcttggtggtacgcacctgtaattccagctacttgggaggctgaggcatgagaattgcttgaacccaggaggcgaggtggaggttgcagtgagtcgagattgtggactccagcctgggttacgaagtgacagtctgtctcaaaaaaaaaaaaaaaaaaaaaaaagtacatcgtttgaatatggatttatagatgtattcaaggacaccaacaatttttttttttttttttttttgagacagggtctcactgtgtcccccaggctggaatgtagtggtgtgaacatgactcactgcagtctcaacctcctgggctcaagtgatcctcctgcctcagtcttctgagtaactgggaccataggcgtgcgccaccaagctcagctaattttttaatgtagagacagggtcttgccatgttgcttaggctgaacatttgatttggcttgcagaaaatatgaagtactttttttcctatgtggactcaattaaacaaaaaattttattttacagagataggatcttactctgttgcccagtctggagtgcagtggtacatacaatcttaactcactgtaaccttgacctcctgggctcaactgatcctcttgcctcagccacctgagtagctgggactacagtcgtgcaccaccgtggttggctaattagaaaaccttttttcttatagaggtagggtctcactatgttgcccaggctgctctctaattcctgacttcgagtgatgccacccttcatggcctcccaaagtgctgggattacaggcatgagccaccatgccccacctggggactcatttgaaggtgatcatttctacttttatttgtttactggacacttgttctgggacctagatctttcacagttgattttaagtgaaaggtttctgaactgtatatatacaatatttcagaacagtaatttcctttgcttcatagtacggcacaacagtgtttgcacttgatgtttagcgtagccttggttttggttgttcagaagcctttgttagctctttggttgtgccaagaatatattgtttttgagtctccttgccgggcctcctcgccttcttgtcatgcacatcctgtacctgggttgtggttgtattgatttgctggggcgctgctgttgcaaatgtctggagtgaatgagaatgtgtttgtgggtgtctgccctcaccttggccactgatctgctttcagccctgaagtactgccatctgcatgaacattagggacccccagcctcccccaccacttagtaaagtaccctgcacatgtttgggattcaggaaatgtttgtagaaaggaaaaattccttatcattccttaccattctctgtcttgagtctgagtcatgattcaaacacttttgctaaaaggttttcgcttgaaaaattcatattcaggtacagatttacttttttttggtgtgtgtgagtttaagagctgcctcaggagtagtttagagagaatgaatataccagtatggtttttattcccttgattacttaaataagtattaaaggtgtgtgaaaagattagctgaatcctaggttcctcaaacaaaatgttaacttttgtttgggtggtaagagatggatttcaaaatgggaaaaagcgagactgaaaccatcatccagcacacactatgtcaggaatgtattaatgacagcctgcgcttgataagaacaggacaccaacagggggcataaacaagatctaggtacaactgtgaccttgaagtgaccttgagtttaagttgccatttaaactcattttccttaaactgtccttttctggcaaaataagtgactcctgaagttgcctcattagaactccaatatgcatttttctctctgaactgtttctgatgggtgttgactccttctgttgtcatttggtcctataggaccaaacttgtatatgtagaattttattttaaaataggaaaaatcatgattctgaaaaattgtgcctgtcaagatattaaatgactgttcccattaatattattgccattaatattttgaagtcaaattacatagtgacagctctctgcctgaatgatacttacgttaaaaggaagaaactgtctgagagaattggaagagatgataatgaggcctccccaccactttcccttttaagcccctcacctatcacctactcctccatcccctagacttaagtaggttcccttacttttcttctgcttgggccattgtttagaaaggtctgagtcttgggatgagctggcctcctgttcaggcttagccctccacctgctctgcctgggtcccctctgtgttctccctgggccaggccttcccttctgtgttttcatcctctcctgtcctcctgacaccttcatttaattgtaactttttttttttttttccgagacggagtctcactctgtcgcccaggctggagcgcagtggcgcaatctcagctcactgcaagctttgcctcccgggttcacgccattctcctgcctcagcctcccgagtagctgggactacaggcgcccaccaccacgcccggctaattttttgtatttttagtagagacggggtttcaccttgttagccaggatggtctcgatctcctgacctcatgatccacctgcctcggcctcccaaagtgctgggattacaggcgtgagccaccaagcccggccttttttttttttttttttttttttataattaaagttaaggttgcagtgagctgagattgcaccactgtactgcactccagcctgggtctcactctgtcatccaggccagagtgcagtggcgcaatctcagctcactgctaccttaactcctaggctcaagccatcctcttaccccagcctcctgagcagctgggattacaggcatgcgccaccatgcccccagctaattttttaatttttcatagagacagaaaggtcctctaggttgcccaggctggtctccaagtgcggggctcaagcgatcctcttgacttggcctcccaaagtgctgggattataggagtgagccactgtgcctggcgaaaccttcattttaaaaacatacccaaatctttctgagcactcagcctttcagtcctctgttggccttgcccactatccttttgaggtggggcacagtgttttcctttcccttctcagcctcttccctgacagctgtctgcagatgcccttccctgccctgttcatttttcttcccggtgcccatccccaggagactgcgctggcgaagcccaggagtgacagtgtagtcaggtcagttcttctttgtcttgttggctgctaccttcttcagattcattgctcccctgtttctgtgtttttccaatgcttactgatgtgtttttaagtttctttttgtatctttcctcatccctcaacctagtaaatattggtgttccccaggtgggagggggcggggtggggggcgggggtgggtgggaggtggtttgtctttaccttcttttctttgtcatggcgcatggtctcgtcaacttttaagtctcaacaatattgcccatatgccaaggacttccaaagctctgtctcttgtcttcccccctgagcccaactattgcttctggaactggggcaggcttaggacaaaccactttatactccgtctcctttaatcctcacagtagactgtgagagaggaggagtgctgtggcacctgcatttctcacccgaggaaactgtggcttagacaggcccgatatcaggtccagggtcccatgtctgatatgcttgctggacagacctgcttggacatcctttaggcatctccaagtcaacatgtccacaattaaatatcccatctttccccttgacctgctcctcctcccattttcccggtcagaactggtcttgccgttgttcagtcacctggccaccattctagacttttctttctcctttacctctttccccacctcagttgattgccaagtcatgccagattggcttggtaaatactttctgactcaatttcttcttttccccacaattaccacactcgtttgtatcatacatatggattattgtgatggccttggaactggtttccatgaatctagttgtattccctcaaatccatcctccataaactgcctggatgagctgtctaaaactcagccctaacctccctcctgccagaagtcgtttaaaggcttcctgtgccctataaagttcaggctcctggggagggttcccaatcggctggccctgccttccccattccatcttccacctctccttgccttccagtttatgagctaagtactaatggacagactaggttttcttgcctctgctcatgtctaattcaccttatttacaataaatgttggaggaggaaggaagatactcctttgtaatttgtacagaaggacttgtataacattagaaaagatagggttgaataagttacatagaaaaaatatgtcactctccatgtaactacaaagacatccataaacaggcctgagcatgccacatgcacatgtcagcacagttcacagcattcactgagcacctgctgtggccagagaccacagtagatgctgggggtgaaaagctcaaggagctctccctgtagtgagggaggcagcagaaacccacagtttcatcatagggtagttgagtttaggaataggaatgggtacgggatagtaggggattgtgagcctgagtattcagggaggacttcttggaggaggtgatgcacaagttctgtcttcagggaaagtcagtagtaaccaggtcgaaggtagtgtaaattccttttctcctttttcctctttgggatttgtatttttcccatggaattttacctgtacaggtcattttacactggactaacaatgcttaagtgctttttaaaagcaaactgtgccagatttatcccattggtaggaactttcttcatgagttcagaggctttgtcttggttcccgttgtattgccagtgcatggcccctggtaggtgctgagtaaatgttggttgaattggatgccttgaggtgaggcatgagaaagggttctcctcctccccctgaaggtggtgaagatagttgtgacagttgagacttgcatggggctgaccttgtgaggtcctaagcctggtgaccagcctctgcagtgtaactgggctgtctcatgggaagggcagagcctttcctacgtggccaactctgtgttctgaacaggagtgccaaactcatttggaggggaagggagcgcccttttaaagcctcaactactaattaaattcaagcagaagatggtgaaggtggagctaactcatttattagcatataatatgatcaacctaactcatataaatgtagattatcttggtttgtcttttcctggctgcagaaaaggcttggagaggtgccttggattgtgagttagtcagtgagcagctgcttaaagatttgaaaaatcctagaatatgtcatctctgtaggctttatcctttaattaattatggatttttatctgcatatatgtgaagctaatgattgacttggttcggacactgaattgtcggcttaaacctgccattccactgggcttcatcactatgttctatgggtgtgaagcctttgttttttcagagacccatttccaccagcgggtttgcactgtaagtgtttccacaggaactctgccctttgccagtgtcactgttgtggctatgcagcagaacccacagggcggaggtgtttcagccctcactgaaaatgcaacagatcttaacatctcttgctgcaaattttccagtgtgttctggtctaccttggtatcttaaaaccaggctcactgactaccacatgagaaatgacagtggggtgtcttaaatgatctgttgaagaccagcagccaaaaagattgcccttagtgtttctctctaccggctaacattagacaatgccatgtagaagctgctgttagggtttgagaactgtgtcgcctcattctcaagatagccaaggaagtgtcatctctggagaaggcagttctgtctctttcagtttctccatggatccgatattgttctgaaagaggtggttttaccaattcgtctcacacagacttcttgcctttacttttatctgactgctgacagggtgggctggaatataatcgctacttaactggacttgactttcaaggcctgattggcgtttccagtatagcagttgcctgagtcatctagttttggaactgataaatcaaaggactggcttggaggctagtgtcctgtctggagaatgggcttaatgtaacttcagttaagaaattaatgaatctgaaatagttataacccaaggaagagattttcctaaagaatgtccctttagagaaataatgaccagttccctcaaaaaaaaaaaaaaaaaaaaaaaaggaaaaacagacactagactggatagaaaagacttacatgttgaggctgatgatttctcttatggaactataaaaggactggactctaaggaaatgagggtcttcaacttcattggtgatatttccagttgttctggagctgtgatagaaccaggactagagaatgcagggcacgatgatagatttttttttatgtagcacttttaaacataaaaaatatatatctaatgtgccaatgcaagacctggcctttttgtaatcaagtaatattttgagtaataattgattgcacaacatcctgtgacacactgtgaaagagtaaaattggcttaaaaattttaagtacaaagacatttcagaagagttttgtccataactttgttagactgaaatgaggaattacatttggcaccaggaaatggatctggattatttagaacaaatgttttccaggtttgaatcttctatgtggaagtacagcctgacttctttgccttttccctggtccgggatcctgacagtcagttcttcagctctgtgcctccagaatttcatgtttatgctgcacaaggcctgtattttataatggtggctcttttggacgatgacttcctcgatggtgaaacttccagtaatctccctcatcatactgaaatgatatcagtatatcatcagaacaccatggagcttgtcatttgagggacacagcttgcttgtgtgcttgggaaagaagaggtttagcatggtttcaggtcagtgatgagtccaatgatctctgcaagttcccttagctctgagaattctgatgtcatatgcacttctgccgccagagttgctgcttactggatgcgtaagaagaaaggaaaataaatgtaaaatgcctggcaccactgaggaagtagggtgaggagttaagttagacagtgactggcatttcccagccacactagtacagaagtgtcctgtggtacgaacggaggcaggctggggggttccattgtgtgccaggtgtttccatgaaaataaactgttgagtgccaggtatggcagctgcaaacagggatttggggggcaaaatttaatctttttttgtgatttgttgaatgaagtgcctaatgtgtctcagtaacttacttgagaggaaaagagccacaagcaaggtagtggagagtgctggatggttgccttgtgaccagacctgttcttttaaggcctctggagccagctgtgggacgatcaatccagcagctgcaggtacgcctcgggtgacacttgggtctgtagtcagcggggttgcctgtgactgagagtggcagagtggtcccttgcactgatgaatcctgaccctgctgatctttgcttgggtgatggctgtttgtgtgctatttctagaagttcctcccgcctgcctatgtgacctgttttcaccagatccagattgctagccccttaaagcttgaagaaccttaaaggtcatctggaacaaaagatttatttatttttagcccggtggccaccctgaaccccccagttgattgattgaggctagtcttgagcgtgccctgcttcacatgctagttttccagtttctactttgggagaatgaccttatcattaggctggccaagagggcttctttctgttcctgtcacagtactaggctgtatactcattcaccctcagttcccttttctggtatatttcttaacaaattatttccctctttccactatttttaggggtaacaagtctaagatatttacatataaatggctctcccttctcaaacccttttctagcaagcactttctgggaggacagtgtcttaccaggatcttctgtcactgtggtccctttgagggtagaaagaatagattgttgtgaagtcttttgtcagcctcttcatggttataaacgtacttagttttccagactatgtaggttttagacttcaagtgaaaagagtatacgttgttatgcagcaatagaaaacaaaacaactaccacaaaattgtattttttctccatccagaggctttaactttcaacatttgtatatggaggcaaggctgacagccacagcagtaatttcatgatggctgaaatagctgtgaactgtgcattaacttgttccttctctcttaaattctgctgcagtgttggagcagggaaggcgagcagaggagtgatgaatagagtagcaagtgggataatatacaataataggagatacacaataaggattaattaggtgtcaggctaagtatttcatgtgcattaactaatttaatcctcagaataccttcaagatattcagattctcttattatcctcctctttgggaggcaactgaggctcagagaggttaagatacttgccccaaataagtggtgaaggctgggcacggtggcccagcactttgggaggccaaggcaggaggattgcttgagcccaggagtttgagaccagcctggacaacatagcaagaccctgtctctctttttttttttttaaagttgtggagctagagtttgagcacctgcatggaaccactaagctgcattacacctgcctcaggtggttgatatgaagaaaagtaaaaatttttcagatggactctgggtatttgccttttaaggctatatgccttttaattctgatgtaaagtggtagagaaatgattaaaggtttaagagttgatagggccctgggtagcagggacactttacatgtgttgtgtgtgcatctgcagcagatgacagctccccaaatggacatgcctcccttgttcaagaaagcttgtcagggtggcaccaatttttttttagcaatttaatgaatgaggtatcaaatgatcacataatacaaatttgattgatctccttttggatatatctccccttaaacattgtgctggctacactatccatttctataatacctttgattttatcctctttactcctaacagtgaattcctaggtaaagtcacaactgaatttatcagcacaagcatgctgcatcatgttgtacgttctgcaaacagtaacttgagatagtgtgtcatttcccagttcttaaggctgtggcctacaccaatggtcttattttcccttttgattttttcaaaattaactgttattttgccaataagtttaacatttcattggagcaattattacgtgtctggggttatgcaacacatgggatgtgcagaaataaaaagatagtttccctgccctcaaggagcttgtcttataggggaaacagatacataaacacttctagggcacacagattttcatgtatgtgtgtactatggtgttaatgcagaattctgtaaaggaataaagcttccatgatcaaagcaagcatgggcaaatgcttcacatctttctgcctgtgttttgcgagcccattctgtttaatgtggacttgatttaaagtcgacctgcagtcctggacttcaaccaaacagccattatagtaatgaacatttaaaggagttatttttccaaagcattatagtttttcacatccatcttttcattccctcattagctaatgatgttgatgtcctcacaagcattgtttaggaatggcttaggaattttaccgtatgtttactttggcttgtctgctgccccttgctttgtaatctgttcaccggtgattcagttgtttctttgagtccctttgaaattgcaagttgacgggtggggactggtggggaaagaaatccagaatagatattcctaaaactgtgaagtgaaaattcaggagagactgtcataactctgcttatttaaggtggtttggtttgtgccaagctaaaggagggaatattgattgaattacttttttaaaatgcaattaatttttatttaattgttttccctggagttgtggggttgaggtattgcagtttaaagcagtttggatgtgctgataatttttttctgattatcttcaagtctccatggacagtgtcactgcaggtctattcatgctttcgttcctcctttacctgccttcatctgctttctctgggcattggtacccatacccaggtgtggtcagttggagtaactcctgccttgctgggcttaactgtggtgtttctgggcctaaggcaattggaacatctgtagtttatttcctaatcccaattttgtggaggtttgtgttctagctttgattcaattactcctaagtagtggcccgtattaagtagaggctgtgtgagacaagacacttaatgtaggccccttggagctgctgggtccttttcatcagaatttggctaatgatgcctctctcttttttacacactaaagcctaatataactagtaatgaacctcattaataatttgtattggcagatgtgaggtgtcacacattaaaactgttttacaccatgagcattgacttcattcggtcagtgagggaggatgcaaccacctttgccaaaataggaaggaagagaagacccagagttttcagggaacggaattaaatagcactttaacaagcttggcggaggcagtggggtgaggagaggaagttaataggcccagggaggagagtatctcactggtttctccaagctgattcttctgggtgccaagagagctgtggaaacccacagaggaatgccccggttcctttccttccttctttctggtaagggtttagatctatttatttgatggtcagccttccagttttatcagcaccggtctctttgtacaacttcccaaatgtacaaactccagacagatgagtacagttggtgttttccggggagggtgttgctccctgtggtctgtcacagccagagagcagggggccagagagaggactgattgcccatatgttccacatgagtcgtcagtggtgcacccagttttaaaatgctctgggggtgtgtggccatgaagtggattttgaatgaatagaaggaaaaagctcgtggatgaaaaccatgagccatttgaaccgtgtgtggtgtctggaaaaacaggtggtctggcaaaactgacaaagtttgcttggggaaacagaagctttgcctccacctctgatgcttgggctgggatgaaataagccacttttctgtttagactgtgtttagatggagggaagcttcttcagttctttattgggtgcagtgaatggcagaacttttattacttgcattcttaattttagttagccatgctgagctgggtttacacccaccttggtatgtaatttctgtgacctgttccgcttccttctctcctgtcacagtcaccaaaagccactatgggtagccatttgttaatatcacctttattaggagtcctccaggctcagttaaggtctccctccatctttccacccccactattttatgccttcgtagccactggcactctgccttgcggcacttgcacatatttataatcagtgagtcaccctcctagactgtaagcaccatgagggcaagatctgcagcccaccagcagcctctgcttccagcacagcacttggcacacaggaagcactctcttagtatttgttgtacttgtcagtgtttgttgcctgaatgacacagaagtgttccctgctggagaagggattcgagttaaatggaatcatccagagaatttgataaaatgatgatggctatccgtttatgctcttaaaagtatgcacttgagacctctaagtagatgtttatttgtttatccctttccagggttcatgtgtttatcttgtttccttttgtatgcattttctgctttgcccctcacatagtaattcttggaagcaagtagatcattgtttccatttcagttgagatcactttaggggcatgtcttggacttgatgacagatcttccactatcttatgctccctacctcacatttattgagtacctactatgtaccaatccttaacatttgttattccagtttatcttccatcagtcctgttgaggtagatattgtgccccattttacagatgaggaaatcaaggttctgagagattagataatttctaggaacatacaaccaataaaagggaaaggaagagtctgagttcaaacccagttctttggtgctaggggtacagctgctgtctgcagggcatgccagatgacacctttttgactcttttggtaggaaatggggaggaatgcttgtcaccttagaaatgctgttcgaggttgctcacacctgtaatcccagaactttgggaggccgaggtgggtggattacaaggtcaggagttcgagaccagcctggccaacatggtgaaaccctgtctctactaaaaatacaaaaattagccgggcatggaagtgtacacctgtaatcccagctactcaggaggctgaggcaggataattgcttgaacctgggaggcggaggctgcagtaagctgagatcatgccactgccctccagcctgggcaacagaacgagactccatctcagaaaataaaaaaaaaagaaatgctggtatgtccaagtctgtgttcactcttatgttcatggttgttttacaaaagctgtatttagcaagcactcaatgacaagttatgccagcactgtgcttggcataacttggatatataggtgaatgaggcagccatacagagaaatatgacaagagtatgttttaaatgccccaaagaaggtttatggaaggtgctacaggaatgtggagctgggaaaataaccatcatttatatagtgctttatatgctgtctcttgcttttatatttgcccccattgtattgtctttctctctcacctttcctccacgtctcctcccctctccggaatttcaggatttggatgcatgtgtacatttaagatttgttctaaatacttgaaagcacgcttgcttgttagttacctgtccaaagcctgttgactgctgggccccagaggaacactagcatgtgcccttgccccgcctgtttctttgtatacaaacagtatacaaaacatagagaagagaactgacagatatttagatctatgggcttttatagaaaataagaattacttttcttctgtaaggtcagtgtttacaccttgtctgcttgctccatactcctctagagactaaaacacctcattgcttctcagaatcatttctgaaactgaggctagaaattacaacagagactctcttctcacctcttcaccagcatcccttgcctcttaaagtcactgaaagaatatcccccctcccccatggaggggtcataacacttttttgtctgtctattccaggaagctcgagtgctttacaacgctttacccagcatccctgggggcaggatcggtgcatgtagatgtttactgtgccaaccccttaaaaggccttctcttagcttagaccctcatctaacccagactaataataaaaagtccccaataactttgctgttatagatcttacagtgctcagagattggccctttaatatccatggttggcaaacatttctgtagagggattgtaggttattttgactctccttgtaagtgccagtttgtcttaagtggcctcaatcaaggaaacaagtagttcggctgcttcctctttatggcatccttttgatgaagcaccacttactttactttgcatattagggtcccaggatacatgggtacatgtatttttaatctatcaatcatttcatataacgttaagtagaactgatttaggaaattgcagaagtttcataaaaagatactctactaaaaagctttaagagagctattgattcccaaaaatagttgattgggccatagcatcaggtgtgctgatgcagaaccacatcgttgtgatttatttctgctgtctttgtgaggggatggaggacacaggcttctggaagaacatgtttataagtcttccttctcccagatggcgcttccagctaaggtcctgcagagttgcattctgccacccttcctggagcctgagagatgggcgaggagtgcaggtggtggtgttaggtggtggcatgtcaaggaggcaggcaggaaaaggcagactgatttttggtagcattagtctttcttctgtccttctctgcttttctttattctgaattttaagatttggatgcatgtgtacatttaagatttgttctaaatacacgaaagcacgcctgcttgttagaaggacatatttgagggaactaagtggtgttcggaggcacagtgacgattcgagagattctggaggacgcatgttgggtgttggtggttttccagttggtatcatagtgtcatattctcttcaattgtaggtttagctctttgggacccaaaaagacaagattagtcaggatagtgacatgcacttggcatgctgtggcttctgttgaggaaaaagtgacccaaatttgaacatccaacttcaattcttagtaattggcaatggctccttgcatctctttctgcttgactataaaactataaaatgctgctattaactttgaaggctgccacttacaaggctaggtgaacagacttttatattaacaactcagattaaccctgggaagcatctgtgctccctaacggagaagttgctttcacgtttttcacggtcaacctgggtggccctcaccatcaggagtgtggaatctcaagagtaacagcacaaaggggtggcaacttgaacccctgggttctagtcccaggtcagctgctaactgctgtatgaactcaaggaagtcatccaatgggatcatcttttgacaaaagaatcaggccattaatcaccaaggtcttttccacctctgaattctgtgatctctactcttgtaggtttcctccctaataatttctgtaggtctgctttttgaactatttcccttatttatcctttccttaaaatcaggtttgttctcattcttctggtcccacccacatccacatggctgttaaagaacacagtgaattgatgcagaaagatgtcccagatataggccgggcgtggtggctcatgcctgtgatcccagcactttgggaggccgaggcagatggatcatttgagggcaggggttcaagaccagcctgaccaatatggtgaaaccctgtctctactaaaaatacaaaaaattagctgggcgtggtggtgtgcacttgtagtcccagctactcgggaagctgagacaggagaattgcttgaacctgggaggtggaggttgtagtgagctgagattgacagagcgagactccatctcaaaagaaagaaagaaagaaagagagagagagagagagagagaaaggaaaggaaagaaagaaagaaagaaagaaagaaagaaagaaagaaagaaagaaagaaagatgtcctagatatattgttgagtgaaaaaatatactaacagagaggcatgcctggtatgacctatttctgaaatgagaatgataatagtatcagtataggcctgcatcgttaatttgaagcagtttaagtcagatgtgtttctgaattcaggattttttcagttttacataggacaatgtattaaatacatttactattaaataacacctccagtgggggctggggtggcatctgtaatcaaaaacattaatacttctgtggcaaaacatggatattcacactaagtggggtaaataaagattacacattgccttatgtcagttcaggtaagattttgacaacaaatgttacaaaatttgtttgggttttgaaactttttgaatattgggattgtagataagagatcgtggtggacctgtatagccaaagtggggaaaaatctggaaaatgaagcatcgagcacttagcaatacttttcttgagtggagaagtagggtggaattatgggggactttcatttcccaagttatattctttactagtaagcatgtataattttataatcagaaaaaatgattaaagatacttatgagatataaagatttacataaagtagctggaaacatttaaccaatctgtagctgtttgagacttatttatattaggacaactaagacttgttttctcaatttttcaaacttttgtaatgtgattatatttcatacacacttaaaattttttgtaggtgatagtattgggaaaaacgaaaaggaatatgtgatcgtaattaaaatgtcagtggataaaaataaggcccttggagtaccctgtgggaaatcaggagccacttcctcctggatgctttatgtagcacattatactgacctattaaataatgagaatcaggctgggcatggtggctcatacctgtaaccccagcactttgggaggctgaggtgggaggatcacatgaggccaggagtttgggaccagcatggacaacatagcaagaccccatcgctacaaaaaaaataaaaatataaattagccaggcatggtggcacatgactgtggtcctagctacatgggacactgagacaggaggactgcttgagcccaggagtttatggttacagtgggctatgattgcaccgctacactccagcaggagcaacagagtgagaccctacctctgaaaaaataataataagaagaatcacatggatgaagcaaatgatgataaccaaaatataatgtatgggagatcactttataaagatgtaaggctatacaataatttaacgtgtttttgaagtaacattgcaattcctaaggggaccaaaatgaatggttggtcttaatgggctttgtctgaaaattgactggaacaattgcttccaaacagaagatacttggaatttcatatatggaatatagatgagatggttggcatttgaccatttaattttatcagtcaatataaaatgatctatattattcttaattttcacacttttccatatttctaatcctaatatactcatttgttgccttttcccacttaattgtataattgcagttcccatgttgcttataatagctgcataatatttcagtcactggtttacataatttaccatcttcttattgctgtttctatttgtgtgtgtgtgtgtgtgtgtgtgtgtgtgtgtgttacaaataacacttccgtacctatagctgtttctttttcttttcctttttttccccctatatttaggggttgttttcttagggaatatttttttctgaatgcgtgaggaacttaaagtttattctataagcatttattcagcatctactgtgtacagggccctggagatacagagatgaattttagaacctgtgcacaagctgtctccatttcctggactctcttcctccctctcccttcacctgacgaattctccatttaaatcccactttgccaatgaggcctttatgtattccccagagtattttaggcttttctgtactttttcttctcatttagtcacagttatattgtgtacatctcagaataactaagattacttcatttttgccttcctcattagactattaaacagtaaactctgagaacaggttttatgtctgatttattttccttggtaccctcagtacctgggacattatgtctggcatataccaggcacagaaattcaaatgagtacttgcataaatgaattagatgaacaaatatttgaatatgattcttgccttgagaaatttagattagaactgaaaaatggattcaatggataatttcgatgatgtgtaagtgctttatagaaaatagaaaataaaccttttcctagctattatcttttcctcctttacagtgaatcccttggaagaggattcaattccagcaagtcatttaatgtcttacttttgcccatactctgcagcagaaatgggcttgtcttattttctgctaaaactgttgcttttctatgcaaatcctactttatttctcattgcactgaacaccattatcattcacctttttcacttctttttgacatgttggttatctttgttttttttttcttattattaaaaatcctgtttcttcagcatcccctttttcctggtcttatctgatagctgtacctattctgctgtttatgaccttttaaaaactgttagctccttgagggaagggatagtgtgatcttttggtaggagactttaaaagatccactttcttatattttagtgtatcccttgggtcaaatggaggatttttttttaaaggatgatcatcaaataaatattttaagtaatttgaccaaaatttatcttcttacctttttactaaaaatatacactaaataattttaagggaagattttatagtctcatattcaacatggaaatttcttgattagtattgccctgactttattggttgcttcacgggtggcttctgaattcatttcttggaatgttactattcagggccaactttgttagtattgctacgttgtgatttaattttttgccacttacacattctagccagtctggaagatctccaccaaaacacctgtatagttcagtctgaatttagaagtgtcacttgcaagagaggcagcaacgtcaggcccgtgagactcaagagaagtctctttccatgatagatcttcttatacttggtagaaactggcaagtgactcaccaggggtggaagcctggaaaacagcctgccgaggagggtagtctttctggtaacacatcgccacccctttgaagcatccagagaaccggaagagcaggaactgcctgtcagactgactgagcgcttggcattctttcatggaaagatgacaactcatccagggtgaaagaggaagtggaggggggtggcagggaacaggagggtgaccttacatttccattgttttgcaggctgcctggtcgagtgcagtgggttgtttgggggttgggaggaattggaatcatgtacttctattgttgctgtccaaagtggatgtcctgtgctgtgttgccaaggaggggagcttgtacccattttatccttgtgctccttcgtaatccagatggtttgtgatctgatatttctttcgtgcttagccctggactctatcggttagaatcctagtatcattttaagaactgggattctcctatgccaaatttctgtgaaatctgagagccaacagaccgacatatttttccgggctatctctggctttgacaatggcatattttgagtgtcagttgatttttgtctcagtttattggcttaagtagtaagagtcaagggattgaactgcagcagtagtgttattttgataatttattaagtgttgtcttgggagatcttggggggaaaaagagtttagtttagttctttcttataggaaattttgttttgttttgtttttgagatggagtctccttctgtcacccaggctggagtgtggtggcatgatctcagctcactgaaacctctgcctcccaggttcaaacgattctcctgcctcagcctcccaagtaggtgggatgacaggcacctaccaccacgcctggctaatttttgtatttttagttgagacagggtttcgccatgttggccaggcttgtctcgaactcctgacttcaggtgatctgcccgcctcagcctcccaaagtgctgggattataggcatgagccaccacacctggccttatttagttctttcttactatggctagaaccctcccaagagtaaaataaagacttcagtggacaaccagtggtgagttcactttctagagaatggcaagtcatcggaacactggtcagtactcccaattctatggcatatctgcacatctgccatctttggtcagcaaccctccaggactgccttcttcacacctgtgcgtgaacttccaagctatactgggcaggttggtgctgcccgtttctcccatgctatttaacgattactccatgcagttactgttcttcttaaggcctctccacccgcctcactcttttaacatatgactttgtatctgactttactaagcaacttgaaacttcttagaatgagctcctccatttcctgtcctgatgcctgcaaacttatgtgtagtcacagttatcttcatctggttttctccaggggtatcccatctgctcctgcatcctcctaggccttgctctgttagtcattgtccctccctctctttctaattttcagccacatttatttactgtctgtttctccctccaatgtgttactgtctctttctccttggctgtcaaatgttctctgcgttttccatttttgtgcttctcgtacctactaatgacttacctatttgtcaactccagtggacacgctatagtccttatctttctggagcttcttcttgtatttaacccaacacatccactctcttctctagaagagtttttagcttctgcaaccgtccatgcttctgttctcttgctgcctctatgtcttgtatctccttggtgggcttctcttcctttgcccacctgttactgttggagtttagttctgggagtgttgcttttctctcctcatatatactctggccttgggacttcatctgctctctaggttttcactctctgtgtgccagtgattcccatgtctctgccttgcactgcctggtgaccagattctgctggttgtcatgtgagtatctgaaagcctccttaaattttccaggagctgaatgcatgaccatttctcctaaacctccccttcttttctgaatttagagaccatattatatatggtggttaagattggggctctggaatcagatttggatttgaattggggctctgatacttcctggatgtttgagcttgaacaagtcacttaattccctgaccctcagtgtctttctttttaaaatggggataaaaatactatccatctcagaaattcttatgaggtagattgtaatgcatttgtacagtgcctggctcagaataagactggaataaatgttagctgctgctgttctctttcagtttccctcatccacggagacatccaagccagaaacctgggagtcatctctaatgccattttcctttagctccttaatgcctgttttctttagcttccatacatagccagttacccagtgtggctgatttctaatcactgtttacttcttccttctggacatttctgagttttcctttctcttgattcccattaccactacctgtgtgaggcctttatccttactttccaagatgaagccacagcctcctgcctcctttatgttcctgtgatcctccctccagtgtgttaccaggctgcctctctgtgtctaacagggtttccaccctggttgaagccctcttgtgatgctccattatatgcaaatcaaaggccaatctccttagcatggtattcctgggtgtcctcctggcccttggtggcattctagcctcccttttaccacttcctgattccggcttcatccttgagcaacacagtcttgctgtgttccctgtgcaggccctgctctttaggctctttcccacctttgttagcgacactgcttggaatgctcccttccctgcttttgacttagtaactcctcatcctgaggactcagctcagctatcacctcctccaggaagccttctctgacccttccaggataagttaggtaatcttccatagagtcctgtcattctctgtgcccatgatgcacttaccacgttggatcataatctatttatgtgtctttcctcccagcctcagtcctgaagggcagaaaccatgtgtcattccacctcatatttttgtgcctagctggatgcttgacatgtagtaagtgctcatgaaatgtttgttcattgaataactgaattcaagaaccagtagacctctggatgaccctggtttcctgtttctgtggaccacaatgctctggggcagtgctgcgtatcagaggttcaagccatggctggagcagccacccctgaagtagacaccctaatatccttcccactgagttcctagttctacatgctggagtgaggctgtcaactctgaagtgtcagagtgtgtctgaaaatgattgctgtgaaaaataaaatatttcacattgcaggcctcatttttaagttatttttcccagagaacattttcatattttagaacttatggtaatgttaacactttctatttgcataagcacttccctgttgggagatactgcaggtgtaagtttttctgaggagtgtcataccaccatggaactattttccatcgatctggagatagggaacttcttgtatactctgagagagaacttctttgagatgtaaactagactgacctactttagaggctgcctgtatcctaattttctattttaaaagagtgatggctgaacactgaaaagctcgggacattttagaactgtgctgcccaatatggtggccactagccatatgtggctatttaagtttaaattgaattaaaataaaatgaagtggaaaaaattaagttcatcaattatattagccacatgtaactgatgactagtggctacctaccatatatagaacatttctattattgcacattattctactggacaatgctgttttaggatgtagaagtcctgatggataatatcaaagccaccttaccacagacagagttttacagagctgtgaagtaattcttactgggaacaccagatacttacttaccattttatatagcgtatgtggcattctctcatcttatcattagagcatgcctgtatctttagcgacaatagcattcaaacaccaaatgttatattgtctgtctggaaatgttttcttatacaactcaaaggggaagagaggaatatgtcgtgagtaaatggaattatttttctctgcaccacatcattataaaaactcgaagaggttgggtgcagtggctcacgcccatgatcccagcactttgggaggccaaggcaggtggatcacttgaggtcaggagatcaagaccagcctggccaacatggtgaaatgctgtctctactaaaaatataaaaattagacgggcatggtggtgggcgcctgtaatcccagctactcgggaggctgagccatgagaatcatttgaacatgggaggcggaggttgcagggagccgaagtcgcgccactgcactccagcctgggtgtcagagtgagactccatctcaaaaaaaaagaaaaaagaaaaaagaaaaactcgaagaggctaaaacgtatcctggaactaaatatttacatttcttaaagccatgtgtgttttctttggatgaaaggataacaaatgatttgtatcgttggataatataaaaacacttcaaaaagttaaaattgaaagaaaggcaggatcttctacttttctttattttcctccccagttacccaacccacttggcttccaggagcctgagaagttgaagaagtaaacagaggtttagttcagctgttaaccatgctaggaagttctagctatctggtaataccatggaactcaccagaatctttcatcatggaccagctgctttttacacttggataccagtaccctagatggtgggagagactggaaggatcgttcaggtcaggggtgatggacttctgcagtccctctcacatacactgttcaagttacctacagtagctacgcacggaaagtagggtgtgagtcattccatgattgacaaccccagtggaccacaggtgactcccacctgggtggcttcgggaactcagttcagaggctgcagcaggtgggatattttttggattatggagagctgtttgatttcacatcagtgggttcttccctcaaccttgttcagatcagtgcctgagtaagttctaatatattaaccttttctgagagaagagatgtgaggatgagggtggagggtgtgaatcttgttttttcaccatcctgttactcttctgcatgcggtgtccccttactgaggaacagaatagaggagctgtaagttggggtatagtgtggcaaggtttgtgagagacttaagaacaaagggtgtttatcataggtaattatcacagtgttgttagagtgtaggcagagcagctttctaaccaacattacaagtttattttgctagtgaaaccttttatttaccaatgaagcattagaatttcagagagttaattgtttgtgaactttgttcatggtctttctgaaactttcaactctctgtttagttacaataaggctcattttatagcctttattgtcctcttttgagaagaggcagtataggtagataggaacatgggcttgggatcagatagactgggaatagaaatccatgcctgacgcttggacaaattgtttaaacttctgaatgttaatttcttaaccagtaaaatgggaataataatgcttaccttacaggcaaggggacaatttctttgtgtggaataaaaaaaggaaggtaagctgactcattttcagaaagatctttaaaaattaataaacatgccatattccttaatcttatttatgattacatttggtttatttaagttttaccatgcatatctacttagtgttatcaaactataaggaggaagggctcttggtaaaatcagtgagataatctcagagtctgtgctcttaggaaattaataaaaaaattaaatctgataaaaaagatctgttttaatagcaaattcctttttaagactaattgctgtattatctaaaaggaaacaagctgagtgcagtggcccatgcctgtaatccaaacacttcgggaggctgaagcgggaggattgcttgagctcaggagtctgagaccaccctggtcatcatagcgatatttcatctctatgtttttatgttaaaaaaatagctaagtgtggtgctatgtacctgtagtcccagctacttgggaggcagaagagggaggatagctttgagcccaggaattcgaggttacagtgagccaagattacatcactgcattccagactgggcgacagagtggcatcttgtcttaaaaaaaaaaaaaaaaaaaggaaacaaggggccaagggaaatggggagactaggaaattcaaaggattatttattggcaaacagcaaaacccttgattatttgaatgttttgctattttgagtaatgttatttactgattacagtgcagtctgagtaataacaaatccatcatccagagagtttttgaggctagaccactcagttttgactgttcacatacattattacatatttgtaaaagttgagtttcatgtgactgacacagaagaggtggagtaatcaaatgttcctctctaggatactatgcagtgatcataaggaaaggaaatgaaggttcccttttccctaatgcctatattgctcaggccagcactcctgaagatgcttgttctgttgaagctccataatgtgtcgatgaccctctttgcatctgaggctgggttaatccccagaggtacaaagacaagtcagggatggcatctgtcttggagatgaggttatcctgaaggggatgtggacattggcacaggggataccagtatcaaatgattggtgttgaacagggagctgggagatcatagaaaacagcctcttccctcatgtgagaagaagggaggttagggcaagacttcctggagaagtcgcctagacggagtcttgaacaatgggtaggacttagatgatgaacgggtgagagagaaggaggaaggcattgtaggctaagggaacagcatgagtgtcagtgcattaaacagtctgtgtatgcttgcaagggcaagcctttccatgtcaatagcatataaagcataagggtgggaatcaaggactataaaggggtagttgggggcccagccatgaaaagccaagtatactctatgaaggcttagagcatatgcttctagctgatggggaactgttgaaaaattttaagcaggggtgtaaatggccagattttcctggtttgctatggcagctcattgagtcatagatttgtggctggatagcaggaaccgatcatgataggctcaatgtgagatgatgaatatgtgtaagaaagcagtgaaagtcagggctggagaggagaagatgggtttgagaagtacacaagatttggagttgatacaattttgatcaactggctacggggagtggatgagatggaagagaccagaatgacacttgaagttctggtggccattttgaacctggggaatataggaggaagaatgggtatgtaggggccaaggtaatatactgattttaaaaagtgtccatctggcaattgaatgtgagtctgacgctctgggaagatggcgtctggagatgggaatctgggagccatcacctagaggtggtagttagagccatgtgagtaggttggtgcccaaagagaactctgaggatgaagaaggcaacgggcaggggatggagtccaagggaacaccagacagaagtggagggatggagggaagaggaaatttctagaaaagactcagaagaatgggtctggaggtagaatctgtggtgtcacagaagctggggcaggggacagttttatttttaataaaaattttttacatatatatgtaaaaatatgtaaatatataaaattttatatatatacgtgtgcatgtgtgtgtatatgtgtgtgtgtatatatatatttgtgtgtatatatatatttgtatatatataatatatatatatatatttgtgtgtatatatataaataaattgcccaggctggttttgaactcctggcctcaggcgatcctcctgccttggcctcccaaagtgctgggattataggtgtgaactaccatgcctggcctggagacacttttaggagatttatagctgagatagctaacccaagtcacccttagtatttgatgaagtagcaggcaagatagaatgggattgggaacttgaagagaatggagactgtttggaatatcccagtcactgaaggaaatgggagatgagatgattgaggaaaagtaaaagaagtgtgaagagatgctgaggctcagctgagattagaaactgaatttacagtggcccaagtgtgtgtggctccccagcctgtgtgtcagaggcagcagatactgagactggtccagggtggatttttaccagtcagatgtggcagaaagaaggtgtgaggacgtgtgtatgtgtttgcagggggtgcttttaagaataggaatggccaggtgtggtggttcacacctgtaatcctagcactttgggaggctgtggctggtgaattgctggagcctcaggagttcgagagaccagcctgggcaacatggtgaaaccccatctctaccaaaaagtacaaaaacttagccaggtatggtggtgtgtgcctgtagtcccaggtactagggaggctgaagtgggaggatcacctgagcccagggaggtccaggctgcagtgagccatgattgcaccattgcgctccagctcgggcaacagggtgagaccctgtctcaaaaaacaattaaaaataaaaataaggaacaggaaggagtgtggctaggagggacctaagaggatagaaggaagcagttcgtagacctggatggcttgtatggttaaaaagcagatgtaatagaagggcaggaggcggtagggtgatgtagtctccaaggtagagcagtttgagggagtggccatgggaatggctgagagaagtggcctggaagtgaaggccagtgaggtagaggatagcccacagggaaacctttgtagaaatgggacttttattccacttgtaagattcacactgaattatagcattggatgtgtagaataagaaacttcattttggtgtttgagaacacagtagataggtgtgtgtcctaaatgttttgagccatatgcaggggcaggtataggatagtgtatctgaagatgctgttgggattctattgtcatttatttatgatgtggtaaaaagtctgactttgtgtctctttaaaggaaagttttgacaatgaatataacttataataatacttttatgtatttacacttttcaaagtcatttcataatgtttgctattcagtttagtttagtggctctgggtaatctatttaaagtccattttcagtttgttagtttctgtagactacaagtgtagagggaaaatgtatttcacgtatttcactgggtaagagaatggattattagcaagaacttaaatctaaaatttaagcagtttctagtgctgagggacacgatagatttatgctgaattgtatatttctgtatttgatttttttttaaactgcaggcatctgtgtcttccaaggtgagaaaaaacgttaaaacatatcatgtattttctggcctcctactatgtaccaggtggtatgaggacataaagaggcagaagatacgattcttgcccctagatagcttcacatttagctgaagaaacaagacataaacacaggaaaagttagctaatcatgcagggtttaaatagcaaggcatgacatgactaatggggagatgcattgtttaggcagtaattcctacaggagttcagaagaaagagattattttaggctgtgacagtaaaggaagggtgtaaagacttaaaaggagaaaagagaaaaggcttatgtagaggaactgaaacttgggaatgactgaagccttgttctaccacttatgccttaccttgtgcctcaatttcccaatctgtataacataatgatgatgtgttacctcccagactgtcagaagatgagacagtgattgcagaaaagctctttgcaaataatgcctggtccctccatactgtgtagacagtaaaaatcgtacactttttgaaagtctttgaaaatttaggttactagggtataatttctgtcgttcaagtttgccaagtaggattttttaaattagcatattgccagaagtttgactttcttctttttcccagtaaggagagatttgtaagactctgaaaaaattttaagcaagcaattagacacattattactttgggaaaattgcttttatggccaggcatccttttctgtttctttatttccttgagcaaagataatgattgataaggaagtaaaactagaaagaagccagatccaaacttagaaggaaaatattttgtcacgtatggaagttcagtggaggttgcaggttggctgatgaccactttgggtgaacccagcctgacactcagcattttggagatgatagtctcagagttcacaggtttcctgtgtataaggaaatggatgtcggtcatttcaactgtactgttaattgctttgggaaaatgagtggtattcattaggcaaggaagcttgtagccagccctgtaattaatgtgaaaccttttcatacagccagtggctcttcagcatctctgtactttatgtttatgtgtatacttaggcttgcttcagtggccagaggcttcaaggcattcagggctctgggggctcttattataatggtaatgaaaattggaccctagaactttggacctccccagccttaaatccactgagaggagctctctgtctagggatgtggctccttctgctggcttcttcccttctctaagatagcagtgagatgcactaaacatgagatttctaaaacaaatacttcgatgagtaggaaagtctgttttcctgaatatatccactttcctacatattccattgcttgtggaagcaatgacccaagggttatatgcaggactttttcttactttggcagactggagacccagagctcagagaaggcagaaagtgtgttaaagaacaataggaaaagtggtgagagacaggcagatgaaggaagcatgaactaccatcacagagaaagggtagagtcagcaggtaattctcaaagggatgtgcatctgcccctaacccaatctaaatgcctgactcaatgtcctcagaggacacgaaccctggaaaacaagtatgagatgatactactcaggtattgcgtgtgtgtgtgtgtatgtgtgtgtgtgtgtgtgtgtgtgtcagaggtcagccctgatgtaattgccaccgaggtcaccgtggatgaggtcattgtgggtgaggttacagtgcaagagctgtcttttggtgctgttctggtcttgtgatttccctattttcagcacccagtaggtaggtgctcaataaatgtttgttggaggaatgggtgctggggccagccccctaactctggcctctgttggacgttttgtgacctggaatcattctagaaggaaagagactgcccagagtggatttgtgtcctgcttgtgactttcttggtaacaactacaatgaatatgctccccaggctcttaatctggagaactcctttttttttttttttttttaaacagtctcgctctttcacccaggctggagtgcagtggcgcaatctcggctcactgcaagctccgcctcccaggttcacgccattctcctgcctcagccttccaagtagctgggactacaggagcccaccaccacgcccggctaattttttgtatttttagtagagacggggtttcaccttgctaaccaggatggtctcgacctcctgacctcgtgatccgcctgccttagcctcccaaagtgctgggattacaggcgtgagccaccgcgcccagcctggagagctcttgatctgtaggtgaatcttagtatgagggccttggaggagcttccaagtgtctgagagcctcatgaaatgggatgcaaagttaggaatttctaaggagaaagtcagaggagcctctgattcccagccggctgctaagcccttccttaaccaaggttcaccctcccatgttgcctgctgggctgccttacagcagcctctagttccaacatctgctgtagatttctgacactcacagtctacccttcacctcttctctggctattaccagtacttcctcactatccctagtcatgggaaaaaaaaaaaagagaaccgtgtccccaagatgatcttgcctttgagccttgtgtgtttcctgacagggaaaaggccctgtactgccatgtcctcccctctggctgcttcatgccgggtcttctgcctaatacctgacacaaggagactcctccagactgaactgcgaggaaaggctttacaggcagaacaggctctgcagagttgctgctcagtaggccaggggtcagcagacttcatgctgtgtgccttaggccacatgagtgatcctcctgtagatatttcccatcagtgaaaacagagctggcactgatcacctcctctcttacagactgcggagctaaagtgggctgctggttggaatgtgctgtgaaagttggaatgtttttgcaaattttattttattttttgaatttgaagtagaaagctgtttgattataaatggtgacttttcccttctaaaatcatttaaaatttttgtaccctttgaaaatgacatttaattataggcactcaaagtgcagttgacaattattgttatttttggggaattgtttaaaggatgttcattcatgcatgcatttttttcattatttacttattcagaaagatgtggaagtctaatatgtgccaggcactgggaaacagtgatcctgctgctcatatttccattctacacccaagctgtgtacttggtcatgtggcttggatctttgtaaatctcctttaccctctttgccctgaagaacgttattagaacttggtatgcaaaatacaccattggctgattgttggaatacttttgagcaggtttgtaaccactttcagtggatgctgtgtgaagacccactaaagcagtggttctcaaggtgtagcttgcatcagtatcaccgggagggtttgttaaaacagcttgctggacccccatgcccagattctgtttcagtccctgactgcatttctaacaagttcccaggggatacttatgctgctggtcttggggatcacactttgagaacctctgcattagagacatttctttagacctaagggctttgaagtctcttctcctgagaaattggtgtggtttcattagggtttatcgtgaaccttgtttgtgaacctggttttctttttgtttgctttgcttcgcgtcagaaattcagattcaaatttgtagctcaactttaagaaaattttaacagttacatcttaacttttcccagccttgatttcctatttcattttccccattctgattttacatgtttacacaatataagttcctgtatactgactgttttgtggaatgtagtatatattgagaaatatgattgcagtcagtgttcttttcttggacatttgtctttcgaatcaactctaaagtattacatgttttgactgtttaatgcattagttatgggagtagattccccagaagaattatattattaatagcaactaaccaaaggattggaaagaaaaaattgggaagaaagtgacagaaagttcttggtaaaaaacagaactttatttttaaactattgatgcatagatagtatctacaagcagtaatacatatgcatatatctgtatgtttatatgtgtatatatatgtgtgtatgtatggttttttatttttatttttatttctttttgagacagagtcttgctctgtcacccaggttggagtgcagtggcgtgatctccgcctcccaggttcaagcgattctcctgtctcagcctcccaagtaattgggattacaggcgcccatcaccacacctggctaatttttgtatttttagtagagacaaggtttcaccatgttgctcaggctgcctcgaactcctgacctcaagtgatccgcctgcctcggcctcccaaagcgttgggattacaggcgtgagccaccgcacccggccatgtgtgttcttttaaaaactgagaaccctaatacataaacaatatactttctttggttgttggagaaaaagcgaagggatgaggtggtgatgagaacagtgaaggcaaactacagtggttgcccaactttactggagtcacctggagtttgttaagtgcgatgccagtttgctaggcctgggggtggggcctgcatttgtaataagtgtatcaggaaattctgacccacgagaggtgggagaggtttagcactgggtagaaaaatgaaaggcccaatctgtattaaacctgctccaaatctttgtatccatttttggatgaggagttcctgttcagattttctgcaacttttcctgaaatcagagtgtaatgggcacaatatcattcatattagtcagtcttagctccagaaagtactcattatgttagatgttcattggaagtagtttgtagctgatttttttctctttcttcgctctctgtatttctgtcttctacttctgtttttagttgaagagaagatactttaccaacagcttgtctgaaaacaatttgcagataggagtactcatagaaaactcttggggttctcactgtgggtcttctccaggggtgtggataacaccaaacactgcagtatggaaactagcgcaaaatgggatgtgctgtgacactggccagctggagacagttgggacaggggatgacttaacgttaacatgggaatgttacatacacagtctagaaaggccagatattcttttgcactgctgcctctggctctcttttcatctatttagtgaataaccaaatttatcacctgtagtaatcagttactaatttagaatttaatttctttaagagttacctggatttagggctcagtgaaggcagtttttatttaaaagcattttcttgaataaacattttagaacagttttagtattacagagaaactgtgaagatagtgcagagaattcccatatacccaacagtcagttttctgtattattaatgtcttaggttagtatgctacattgtcacagctaatgaatcaataatgatacattattactaattaaacttcatagtttatcagatttccttagattttacctactgttccatttctgtgttaggatcccattcaagataccacatcatgtttatatgtctgcttaggttcttctagtctgtgacagtttctcagactttccttggttttggtgagcttgacagcttgacaagtcctcgtcaggtattttatagaatgtccttcaaattgggtttgtctaatgtttttcctgtggttcaagggttttgggaggaagaccacacaggcaggcatagtaccacatttcattccatcatgtcatatcaattgcataattagcttttacatgcatacatgctatcaaaacgacctatcactgttgatgtgaaccttgattgcatggctaaaattatgtttgtcagatttctcacataaagttcctcttccccttctttccatactgtactcttgggaaggaagtcactgtacatagctcacactttagttgtggagaattatgctctacctccctgagggaggtagtatttagagaaattattgggaattcctctgcttgggagatttgtctattctcccccatttatttattctatcatttatttgtatcagtatggactcatgcatattttatattttaggttataatctaatatcacatgattgtgctcctcaaattgtttcagatttggtttttgggagctgtttcaataggctcctgtgtccctttgtgacatgccacccatcctggtgggtttttgttgttgcatgtgtgctttttaaaatcacatccttattctttctggcactaaaagatgcccctggctcactttgtatattctttgccccatccctagaatcagttatttctccagggaccctggttccttttgttggagaatggttttagaaaccaagttctgggcactgcgtgtccttgttgctactgaggtgtcattgcttttaggtctgttcagctgacggaacagagaaataggtgtatactcacccttgtatatacacatatctgtaaatatttctatatgtatccatctgtatctatattaagttgaacatgagttcatgctaatgttttcaactccgatacagtgttacagacctttttttactagcctttctcccttgtctgcaaactcctgctctaacagtgaaaaactggttcctaccacccaccatccatttacttacatgtatagtggtttcagaattgttaacttgtatcccttatgagaaagaactttattggctagagttcagtggttatgtgaaattcgttatgtaaaattcattttgcccttagatctagagtccatactcatttctgaaggtccttaagccagcatcttttccctcacttctttcagtgaggttatttcatgcattttgatacagttgattctcatgtcatagtctgcatttcatattccaccccaggatctcttgataccctaactttttaaattgcatatattcaagttctgtgtgctataaagttctatgggttttaacaaatgcttagtgttctctgtctaccattatagtatcatagagaacaatttcactgccctaaaaaaaattctctgataggcctcaactcatcatttggcttaacagtcctgctgagagagtcctgccagttgcatctgagagacagtcctgccagttgcacctgctgagagagtccttcagttgcatctgaaaccagtctggtttttaattttacctgatgttcagaaaatgctctcaggctgtcaccgggctgaagaactagttgggttgtagctgtggctgtgaatctggttcccaagaactggctgtattagtctgttctcacactgctataaagaactacttgagactgggtaatctatgaagaaagaggtttaatggactcacagttccacaggctgtacagaagcatgactgggaggcctcaggaaacttataatcatggtggaaggcaaaggggaagcaagcagcatgacggagcagggtagaaagagaaagggagagtaaaggggaaagtgccacacactttcaaccaaccagatgtcatgagaactcactatcatgagaacagcaagggggaagtctgcttccatgattcaataacttcccagcagcccctcccctgacaggtggagttacaatttgagatgagtggggacacagagccagaccatatcattccgcccctggcccctcccaaatctcatgtccttctcaaccaattatgcccttcccaacagtcccccaaagtcttcgtttttgtttttgtttttgagacagagcatcagtctgtcacccaggctggagtgcagtggtgtgatcttggctcactgaaacctctgcctcgcaggttcaagcaattcttctgcctcagcctcctgagtagttgggactacaggcatgcgccaccatgcccagctaatttttttgtatttttagtagagatgggattttgccatgttggccaggctggtcgcaaacttctgacctcaagtgatctgcctgccttggcctcccaaagtgctgggattacaggcatgagccaccatgcttggcctgtccaccaaagtatgaactcattgcagcattaatgagtccgcaatccaaagtctcatctgagacaaaggcaagtcccttccacctatgagcctgtaaaatcaaaaacaagttagttacttctaagatgcaatgggggtacaggcattgggtaaatgctcccactgcaaaagggagaaattggccaaaacaatggggctacaggccccatgcaagtccaaaacccagcagggtagtcattaaatcttaaagctccaaagtaatctcctttgactccatgtctcacatccagggcacaccgatgcaaggggtgggctccgaatgtcttgggcagttctactctgtgcctatgcagggtacagcccctgcgactgctttcgtggcgttgagtgcctgtggcttttccaggtgcaagatgcaagctgtcagtggatctaccattctggggtctggaggacaatgtctgtcttcccacagctccactaggtagtgccccaatggggactctgtgtgggggtttcagccccacatttcccctttgcagtgccctcatagaggttcaccatgagggctccatccctgcagcagacttctgcctggacgtccagatgtttccatacctcttctgaaatctaggtggaggctcctaaacctcaactcttgccttctgtacacccacaggcccaacactatatagaagttgccaaggcttgaggcttgcaccctctgaagccacagcccgagctgtacattggccccttttagccatggttgaagctggagtggctgggacacaggatgtcaggtctcaaggctgtacagagcagtgagggccctaggcttggcccccagaacaatttttctcttctaggcctcccagtctgtgatgagaaggggtactgtgaagatcttggaaatgccctggagatcttcccattatcttgcctattaacatttggctccttgttgctgatgcaaattcctgcagctggcttgaatttctccccagaaaatgggtttttcttttctactgcatggttgtactgcaaattttccaaacttgtatgctgtgcttcccttttaaatgtaagttccaatttcacaccatccctttcttcactcatatgagtgtacactttgagaaacagccaggccacatcttgaatgctttgctggtgaggaatttctactgccagttaccctaaattatctctctcaagtttagagttccacagatctctagggcagggccaaatgccaccagtctctttgctaaaacataggaagagtgacctttactccagtccagtaagttcctcagtctccatctgagaccacctcagcttggacttcattgtccatatcgctatcagcattttggtctcaaccattgaacaaatactaggaagttacaagctttcccatatctccctgtcttctgagccctccaaactgttccaacctctacctgttacccatttccaaagttgctaccatacttttcagatatctttatagcagtaccccactcttggtaccaattttctgtattagtctattctcacactgttatacagaactacgtgagactgggtaattcatgaagaaaataggtttaattgactcagatttctgcaggctgtacaacagcatggctaggaggtgagggggaagcaagcacgtcttatcatggcagagcagagagagagagagtgaagggggaagtgccacacactttcaaacaaccagatctcgtgagaactcactgactatcatgagaacagcaaaggggaagtctgcctccatgattcagtcacctcccagcaggccccttccccaacatgactggattacaattcgagatgagatttaggtgtgaacacagagccaaaccataccacgggcaaaaattgattttataagaagtgagagaatgagacaggtgaatattttgaaggcttgtgtggcaaatattcattagccaggtttattaaaaactcagctacttgggaggctgaggcaggagaatcacttgaacccgggaggtagaggttgcagtgagccaagatcatgccactgcactccagcctgggcaacaagagtgaaattctgtctcaaaaaaaaaaaaaaaaagctcataaatacattaagattttattcacagtgtggtgggtgtggtactcaaggcctttaatgggattttaataatccaaacctaattcagtctccagatgactgtgcaatataatggagataatgctgctttacttttccttactcagaaggtggttgtgaaggtctgctcagggtagccagcgtgcctttcccaacacccttctttctgttttgctggttctgctttctctcattctctaaacatggctttggtccttgattctttgctctttgaactgtacaattgttccttgagggtcagtcagctgtcttgtggttcagttattcctgtgtggatgactctacctgcagcccagccctttattttaagtttcaggtcccatttatctttttgtcacacatttctaatctccctacaaatcagtatttttaaaaaccagagtcatcccaaaccaactgaccctctagattgccttacttcttgcagatttagtcttaccgtcttccagatactacagctgcctttgggcttttcatcatcccttatccttagccaccaagtcctgctgagcttcttttgtaatacttctctcctgcctcctccactgcacacttgtaccactgagacagtctcttaattctgcccagcacctccagccccatctacacccctctagtttgtcctccagcatgttgttttaggactgttgctagcctaattatttgaaatgaaatttcagttcttaacttggcatccaaacctttcgtccattgcatttctagctttaccttctaatttctagctttaccttctaattcacttaaatgagatacaatttaattaaaccatgtattccttgcagcttctgtgctgttttccacatctgtctctttccccatgttggcagggtaaattttagaggtgtaatgaaatttgcaggtggaagttatggggatatagattgtctttagcttaatgtaaggatgacctttccaacagaattgctaatgatggggtgggtatcatggaagaagtctacctgtcatctcccaggtcatctactgtcatctcccctttaaagacctcatcttccatatctgcacatttggcttctcctctcttttgaagctgcttgtttccatgtcccatgatgctaaacttggggactcctcccacctctcagattgtattttctctggttctttctttcactcctttagtgaatttgctttttcttttcttcttttcctgtgctctttcttgaaaaatttcactgctcttagacttagtgtttaccttttgagaaaaattcccaaatgataaccccagccgtatgtttaactacatgatttgtctttatttccaacatcttgccagatatttctatttgagtacttttgtgtccaaatttaaactcatttctttccctttaaaacatgttctttccctgagttccctggctgattagtggcaacagagatgggcagatctttctgtaaagggccagagagtaatatttttgtcttcatgggccataaggtctcaatcacagctactcatcttgtagataatatgtaactaaagggttgtgactgtgtttcagtaaaactttacttatcaaaataggcagcagctggcattggcctttgggctgctgtttgctgaccctgatctaggatacccaggccccaaactccatactcctttggcctttccactgcttttgtttgctctcttcacatgattattaattttcactgatttcacccttagcaaaccattcatacttctagaccatagctgtctgtctattcattcatctagtagacaaaatcttccttttacatgttaatctctatcattttacataatcaaaaacctctagtggctccccttggcctgcaatctaaggttacagttctctgggtgtagctctttctgtgttttgcctccagccttctctcttactcctgtatggacattcctccaatgacactgatcaagtgtgtgttctgatattagttctatcacttctcacaggttgctcctgactcagaatggtctcacttcccactaattgaaacttgccttcaggcctcaattcagggtctcacttcccaggtaaagcttcgccctagcccagtgattgctcctctcctagggctttttttttctttttctttttctttttttttttttgagacagcatctctctctgtcacttaggctggaatgaagtggtgtgatcactgcagcctccaactccagggctcaggtgatcctcctgtttcagcctcccaagtagctgggattacaagcatgtaccaccacatctggctaattttttttatagagatggggtcttattttgttgcttaggctgttctggagctctggcctcaagtgatcttcctatcttggcctcccaaaatactgagattacagatgtgagccgccacacccagcactgaatagtgcttttgatgttgccactgacctattcagttgagaccgcattgggttgtaatttgtggtgttcctccctctccatctgaattttcagaagctgttaaggacagcccagtagatgctcagatgtcataggtaaaggtcatacattgaactctttgtctttcctccagttctgcttcccccttggagtccctgtctcagttaatggcaccagggatcatcattgccttgtgattctgactccttctctttcacctccaccctacctgcatcagttacgaaaagtccagctgctgctccctcctatgtctttctcctatctgccctctcctctccatcccttctactgctgccttagctcaggtcaccactgtctttcactcagaccattggacttgccttgaacatgaattcccaccaccagcttctctcctcttataatcccaacagttatgtatcgggatctgacatgtaggtatgaccttgtaactttcctgattgaaacccctcagtggctccccattgccctgggataaggaccagcctgccagcatgtcgtgaggccattattgattggatgcactttcctctgcagtcctatttctgacttgtctcatttacacagcttacatttgatcatctgtaacccctatacatcttctgtgcatttgcacactccccgtctctgtgtagatgccccccctccccaggtccacttggaaaaccatcacctgaatttctaggcattgtacaaacgttccctcttttgtggagctttcgtctccttccctccagaagaccaagaggagtaaaggtgttatcatagaataactgttgggatagagatataggcttcatctattttctaatgcctcctcagattcagagtcttccaaagtttccctgcagactgagcaatgaataattaagcaaacaagtctctaaaacatcttgaaatgcttatgtatgctaaatatgtagttttgagttcttgttttggttttgctggagcttttgccttcttcctccattacaatggatgatgagaatcaacaatgtagaattattctcggttagtttatatcttgtttttaacctggtatcttcagtgtgttaagacatttttcctttcttgtgggggttcccctgcaaagaaggaggctcacttgtggggccgatgaccactgtctctaggcaacccagagaggtgtgaaagaaagaagggggctgtgaggctgcagggagtatattccccatctccagccagggtcacacctgtcacttctgtttagtacctcttcctagtaaggagaacgtatgctccctttctggaagggtctacttagcagaaacgaggagtggcgagctcatgtggaaagtgcttttttgatgtgttctttcatgtaggggacacacggtgtggaggggatgcacaattactcttctgtggttcctctttcttactccagggtctcctttgccatgaggtccctagggacgtcttatcagaggagaagaaaagtaccttcttagttcttttttgttttgttttgttttgttttattatggggtttcactttgtcacctgggctctccggggtgcagtgttggaatcgtggttcattgcagccttgacctcccaggctcaagtgatcctcccacctcaacctcccaagcagctgggactacaggtgcatgccaccacacctggctattttttattttttatagagatgagatctccctgtgttgcgcagactaatcttgaactcctggactcaagtgatcctcctgccttggcctcccaaagtgttgggatttcaggtgtgccttggcctcccaaagtgttgggatttcaggtgtgagccactgcagccaaccccttcttagttctggagagcagagtcttgcctggcatcctggtgctataccaagagtcctctcctggtttccagagaggacatttgacttcttcaggagaactcaccccactccttttggtccattaggagcaccagaagctttggacctgatgggctgggcttggtctcttcagagcctctgtcctcattcacagaggaggtatcaggtaggccttccagcacagaattacattacctgggaatttaagtgggaggaattgcagtggagtattttgaagatcctaaggcatccttcatttaatttacattttcgattcttcagatattggaatcaaagattgagacacacacataacactagagcacacagtagaccatttctaccttgagctatctccttgttagagaaaaaatagttttgactgtttgtgattttttactacgggcagaaaaactttgaaaaattaatttcaatgtaaaagagttttacttttgccagatgataacacttcctatgctagaacctgggggtactgggatctgacttgaagtaattctaagtttaaatttatagcaaccatgtgggtctgttcagctgggaggggagaaatattgcgagccataaggatgtattttagagagtttctttagtagtcttcagatgtctacttgccctgtacaaagttcagaaactgtttaggacttggaaccttagaatatcagatagaaaaggattgacaggcttagtctactctgtttttgagatgccgaagccaggtgacttcccctagtggcaggtaggcaatgtcagagttgtgatcatggcctggggctcttttccaacctgctctctgacctcacataggatccggattgagcagggtaaagggtggaccagtaaaggctttaatcagtaaagtaatgacagtgttttccttcatttgaaaccagtcagatttgatactacttttctgttcagtttttgccatcattgttttctggaagtttttaatctgtaatacctcttagtatgctttaacacataacacctagtgtcattgttatagagatgaaagtagaaaattagcagggatgtagtatttgcctattgcaacttcttttcctttaaaccccttcccatgtcggggggataccttgtgtgtctgcagcatgtgatgctgactcggactctccaggcagctgactaacggcacctaaactgcctgctgcattttccctgccccagcacagacttgcttagcagctcccgcctcgggccctcattgagaaccatccagcggcacatcaggctggtgccactcccagtggccttggcagtgaggaggtgaggcgagagcaccctcaggtgctagtggcacgagtcttgcccaggctcccaggggaatgagtggtgtgatgacctcatgtgccagaagccagggcaggcatgcttgaggctgagagaaagcaacagatggacctcaggcagaagcagtcagagcagcctcaagggaggctggtgcggcaccagcgtggcatcttcccagcatctgaatgttggcttgaccttcgctgtttgtgtgacctcacccaattcagtaacctcactgagcctccctttttccatctgtgcaacggtgatggtagtacttcactctgcaagcggtggaggtgagagataatataggtcaagcatttagcagttggccaagctaaagacatagctgttgtttttgttattagaaacacagcctcagccaggcacagtggctcacaccagtaattttagcactttgggaggctgaggcaggtggatcactggagctcaggagttcgacaccagcctgggcaacataatgagacctatctctacaaaaaatacaaaaattagctgggcgtggtggtgtacacccataatcccagctacactggaggcttagttgagaggttggcttgagcccaggagatggaggtttcagtgagctgtgattgtgccactgcactctagcctgggtgacagagccagactctgtctcaaaacaaaaaaacaaaaacaaacaaaaaaaaacaagaaaaaccaatacaatctcatttttcctgttaggttattcatacaaacctgttggaattttttttctttaggaatttgaatgctcatttttaagccagacagtttcaggtggaagagaatcatgaaatgctttatcatgtttttgttatttatcgctagagtaagacttaggaaagctatagaaaagagccatccagccaagaatttgaattttgtcaacttctctattacagaggtttgctcaaagcccatagagtctagatgaaccttctacctttgcccccaaaattgcttttttcttttaatatgctagatccctttgcttattccaggctgaaatgaatgttatgtagctagaagtttcctgtctgtgatcaattctaatggcttttgtgaagggaaatggttgtaaattattaccagttaattaaatgagtgtttctcttgagtcctttgtgtaggcttttatccaagcctgtttagaatcatggaacattacagctagaatatttttagacaactcttgtttcatggacaaggagacttaaccagtgatataagtacttgcctaactcctgcaaagtgatgccaaggaaaagcaaactttggctgagggtgtaggagtggctgtgctggggatccggtgggtacatcaagctaacagagtataatttctaagcagtgagcccttgtcatccatatgtcaccggtattccttggagccatcttggagtgcttttattttttacaaagtgctatcttgtaggactattctatagtaaatattacctttcctatttttataggtgaggaaattgaggtggtcagatgaccttatttagctcttagatcaactcagcagatatgtattgagtgtttacttggttcaaggaactctgcgaggctccttgggaacataatgtcagatcctgctggaatggaggttacagacttattgcaagtgatgagatatgtgtatgaaaatgtaagtaattgttcaaggtatagataagtgttaataatagttgagatgtgaattttgagaccggagggatcaatgtgaatatcaaatcctggcaccagtttcttccttctgctgctcatgaagctgtgtcatcttctgtgctcggtaacccatccaacctgtagccctaggagctcctctggggagtcttgagtaccttgcagttgtcccgaccctgggagtcattcaataaaggttcaaatgaatgaatagataggtgcggtgaagagagacaggttttccaagcagagaacacggcatgagcaaatgtgtggctgagtgatagagccaggagaggggcctgactaggacagcaggttttaaaaagtgatttttttcttctttttgtattttaactttctaaagtgacaatggaaggaagggaattttgaaaacaaagtttggatagattagtgggaaggcagcaaaaggggagcccaagtggtcctgaaagccaggtggagcagggtgttttattctgaagactctcggagaccagcggaggctttagagggggaagttgatgagatcagcactttagaaaaggctgctttgtttttggtggggtgttccatgactgcaggagaaaggatgagggaggaggcctgcagtgacagggatcctagaatgatggagggaacgaagggaaaaacagatggtcacggtgcctcaagtcggagtggctccaggattttaagcctgggaacgcagaagaacagtggttctagtgattcagtgatgaccactggaagctttaggaggaaacatgggattggagccctttaaagctggaattggccccttagagagaatctggctcaggcttcccagatggtggtccgtggtctggctatatcagagttacctacagaacttttaaaaacagcagatgcctagaccccgttcccttgccccagaaaatttaaaatcagtagatcacctgtggggtctgggaatcttatatttaatccctttctgtgattctttggcaaagaagattgaatggccttcctgatgtcgcagattggtcaggacagagcaccaggacccaggtcttctctagcattgctattactcagccacaatgtgggagataggggataagttcagatggggaggtatagtatttgaggcagcgctgattcatgtgagttcaacactgatggctctttgaggaaggggttacttggcatgagaactcaagggttagatggctctgagggtgcacgttgggaatcattcagtcaagaaatgctttcccgagtggctgctgcaaaccaggcataggatattttcagtccacttcggggactcaaaagtgtagaacagagtagtagaaacaacatagagaaccctaaaggctgaagttgtgtttatgttttcttctctgagctgttttgagtaaatttaggtgtaagttacaatgtatgggttgaaattcattattttgggtatggatgtcccgttgttctagcaccatttgttgacactgagtttttatacttttgttcatttgtctatttgtatagaagaatcacatttttttaaagaccactgttatctgggtttcaacaagggcccaggagttgttctttttaccaagagaagtggtctgtaggggagggggttagtgtgtttattgctccttgaatgactgttatagtaagaatgctaagtgtgttcatttctatgtggggctgccctagactctgacctcagctctgttctattagacactctgtcagtgcattagccaatgacataggtagcctgaggccctgatttggggagccataaaactgagaaggggagtgaatgaactgactggatttgcgatccagtgaacgctatgacctgggacaagccaaaatattgcagaaaaaaaaaatgaagcacttaggtttttatgaaggttttgagcctaaccactgcacgagcacaggatgtgggaagcaaagccttatggcagctagaaaagatgcagaggttttagttcattgcaagctcagcctgggtcactggggcttctcagagcgcccatgtattctcgctgcattggtaaagggcactgtcactgtcaagatcaacgttaatgataatcttgctcttgctggtgaaagtcaggtcacacactcagcctgacttcaccctttaatgggggtgtgaagaaattggggcatgtcaggaggaaactgactagaatggtgaaggaggagaaaatcatgtcctacatgaagttgctgagagtttgagatacccaggtctattttatttactcatttgttccacaaaccattttctgtccccttatatgcaaggtagggtctcctttggggacagggcataatgactacaacatgatgtgggttccagcagtagtcttcataacaggtgtggagttgcccacctgtctgaaagaggtctggaaaggtccccctatacaggtgggtcttgaattgatggacaaataggagttggacaagtataaaaaggaagaaaggagtttccagccagaaagatcacataccccaaatcactaggcaataagctacagatgggtaatgtgtaattttcataattttgactatattccccagtatgctgcttgatccataatgcgtttggttgctctctcagaataaatgaaataacatacctccctggagagtgtacaagaattaagagatggggatactggttgtatgcagctgcagtggtgggaagagcttaggctgaaaggtaggaaggggtttagtgtctagggctatgtgctgtgctaaagaatttggaccttatcatggacaggagaggaaacactgacggtttctaagttaggaagccacatggtcagattttaatttttgaaacatgtcactggcagcagctggaggacagtagtctggaaatagaaggcagctagaagcccgttcagggaggccagatgaaccacggcagtaggagtggagcaggggtagatccaggagagacttcgagagtggacgtgttgggatctgagagcgattcaatgtacctgctgaggagctgggcttctggcgtggcctactgggtaaatacagggctcaggagtgagaggagggccaggaaagggtggtgtcctggaagtaaggaatgagagattcatgaagaggaagatgtcaagatcagatgcggcagagagatcaactgagatgaagacagacacatctttgtatctgacagtaggacttcataaaagttgctggagctgtttcagtgctggtgggaggcagggaggcagacggcaggggatagcacggatgttagaaggcatagagggatgtgataattgttgtcgaatatttgacctattctctttggctgacaatttgaatatgttttttgagtgcaagtgatagaaacccctactcaaactggctaagacaaaaggaatttataggctcaaataacaaaaaaaaatcccaaagaatcaagcaaggcttgatctaagggtttaaatgatgttacgaagagctgttctctttctgtccctcagctctcccctctttgttggcttcattctgtagctcagtggggggacaacacaggtgccggacactcccaagtttgtgtccttccagattgaagtttagcagaagcgagatcttgtcccttccttgtagatccaggattcctagttggacctacttggatttttgtgctcaaacctgaaccagtagatgctgataccgggtagggagttgtaattacactgatagccagagagaaggaatgtgcctgccccaggccagctgtgcagagttcagtcagtgctctgatctgctaggcctgctcacatgtccactctggagttaggggcagaatcccagatgagccatttggactacatgtgagggaggagtagttctcaaataaagctcaagtgttattcccagaagctgggatggatgtactagctagagacagtgtccactggagctgtagagggcgaaactaaggtaaatgagtggaaattattggtcttgctgcgtttgtattcatagagaaagatctgtctatattgtacaggaatgaaataggccagctgttaaggtagtgaattggttgtcactggggggtatctaagcaactaccgtgaataaatgataacagcccatcagcagtgtatagaaggaacaaataacctccaaagccacatttttcaaactgtttctctgtgacacagtaaggaatacatctttacattaaaacctactgtacccttttatatgtatacaaaactacacacaaaagttgcatgaaacagtgcttttccttactacctgtagcatgttcatattttctgttctgtttttattctactttgaaatccctattgtccgctgggtgtggtggctcatgcctgtaattccagcactttgggaggctgaggtggacagatctcctgaggtcagaagtttgagaccagccttgccaacatggcgaaaccccatctctactaaaattacaaaaatcagccaggtgtggtgacatgtgcctgtagtcccagctatgtgggaggctgaggcaggagaatcacttgaacccaggaggcagagattgcagtgagccgagatggtgctactgcacaccagcctgggtgacagagcgagactctgtctcaaaaaaaaaaaaaaaaaaaaagaaagaaatccccattgtgtgcaacccactaagttgctttcatgtctctctaaaaagtttcaacctgcagtttgtaaaaccctgttctaaggtccagtgtcttaccacatctgccctaggtggacaacacttgaagaccgtgtttaaatccggcttttccaccacagtgggtgacatgggtcaaaaatgcggaaggaaacctgttctacttgtgagagctcctgcttctaactggtggaatctcctgctgtctgtcagagtagctcctgacccatcttggggtggaaaggcctttgtgggccctcagggaagtgttgaagggagtttacgggctggctgtgggctgcaggatggcggaggcggccaggcagcaactgtgcctgtgccagcagtagtttatgttgtgaggtcgaatgtatgtgtatgtatgtattctctggcaggcctttatattgaagatgagggagtgtggcttttaaaaataatgtatttttgacttgaaacaagtcaaggcagagagtggagacaattagaggctgatatcctgtttagtcatctctctagagagctctattttcagagctgttctataaaggttcacaagtggtattaagatagttaagaggatattgttaacagtagtcatgatgcaagtagctgatttgaacagggaggtgatttatagtgtggtaaccacattggtaacaggttttatgcagagaaagggtgggttgtaagaataggttgttatacaggttaagctttctgaatctgaacaaagcaggcatcttttattttgaaaaagtatataatcagggtgtggtggtgacctagggtaagtccagtgcatttttgggggctttgtcatgggtagatacaataaattttaaaaaagtaaacagtactgttaagaatctttgagattggctgggcatggtggctctcgcctgtaatcccagcactctgggaggccaaggcgggcggattgcctggtctcaggagttcaagaccagtctgggcaacatgcctctctaagccaggcatgatggcatgtgcctgtggtcccagctacttggggggctgaggcaggaaaatcacttgaacccaggtggtcgaggctacagtgagtcatgattgcagcattgaagtccagcctgggtgacagagggagactctgtcttaaaaaaaaaaaaaatctttgagatcatatgtggaggctgtgttagaaacgctaggccaatgccaggcacagtgactcacacttgtaatcccagtgacttgagaggctgaggtgggaggattgcttgagcctaagagtttgagactgggcaacatagtgagaccttgtctctacatacatacatacatacctagataagcaggcaagctggttatggtggcacatgcctatagtcctagctacttgggaggctgaggcaggagaatcgcttgaggctgggagttcaaggctgcagtgagctatgattgtgccactgcactccagcctgggagacagtgagaccctgtctcaaaaaaaaaaaaaaagagaaaaaatgctaaataatgatgccatagacttttcagattggaagagtgaggctcagtgtggtaaaggaccttgcccagggtccagaaccagctgtgacagaatcagactagagttcttggcctggtctagtaggggggctctttccactgtaccatgtgactatttgcagcttattttaaatttaatatttgaccaaaaatggtcattcgtatctctagtgaaacttctctatatgccagtcttcctcttcagatgaaaggtcaaaggcagaaatggagccacagccaaagaaagagaaaaataaaataaaaatggagccatgggcagaatctgaaaagatttatttaaggacaattgtaaattcatgtatttgagtccacaagagcctcacaatgcaaggcttagaggtgttcatggatagtgaagttagcatccggtaggaagaggggagtccgcccacctaagctagtggtgatcagaacagagccagaggtgctgttcatcctgggcgccatgctgtatggggtctttcggaaactggactatatgcagaggacgacaccatatgaaaagacttcaagctgcattgcttgcagaatgcatgtcttgatatttcagctgataggtaacttcaaggtatgttgatactcccgtgactaattaagagtagcagtccgacacagtgtctcacgcctgtaatcccagcactttgggaggctgaggcgggaggatcatttgaagtcaggagttcgagaccagcctggccaacatggtgaaaccccatctctactaaaaaatacaaaaacagatcagatgtggtggcacacgcctgtaatcccagctactcaggagactgaggcagaattgcttgaacctaggagatggaggttgcagtgagctgagatcatgccactgcactccagcctgggcaacaaagtgaaactacctctctctctcaaaaaaaaaagagtagtgaatgcaaggctcctaaacttccttccctagtgcttccttaagattgaccagactttggtggaaatatgtagcagagactctttatactttttactccataaaactaaagatttgcagttgaccaagccacatgtgttcattaccttgtatgttgccgttatttctctatttcatattcttgccatgtggtttagtaaaatgctgctcttataagccatatgcataagatatggaggtctcaaaaacaattaccaagtatgtggatgtgcctgtctatattatgacaagccaaaaatgggagagaataaaattcaagaggaaggaaactgataaaatgtggtttcttttcagtctttacagttttttgagctttcacttgtttccctgccactctactatttaatgaaagacttagatttatttgatttgtggctgtgatttacacattaggcctctctgtgatgaattgtttaaggcccacaaaaatattttaaaactaacatataatatacatttttttttctctttgtaggtggatctcgagccagaggggaaagtatttgtggtaataacccttaccgggagtttcactgaaggtaagaatgagttttgggtagtttccagaatacatgtaatcttggtttacactcagtaggaatttctatcatggacattataaaaaagagcatgttgtaagagatgcttaaaaaatcactttcataagttgggctggctagtattttgttgcccagtggtctattggttcaggttgccaaattaaatatatttgctaaatctggcaatctcacgtttcatttaacacactcaatgagtttttgtttttagccagtgtcatcgtagctgaatggtttttgcgtctttttggttcatgactgtggaactctacgtctttggttttgtgccatcttttagtttgcctgtgaatgtctatgaaagaaatttagggatccagttatcttctttataatctctatctcatttgtgacctgtaagggattctgttcttcatctgtggctaccgtactccctactcccccatccaatattttttttacttgaggtaaaatttatatgggggtgaaatgatagatcagaagtgaacaatttgaattttgacaaatgcatacaactgcataaccagcaccccaatccaagatacaggacatttccattattgtgaacatttccctgtaccctttttcaatcccctgctcccagaggcaataagtaaagtgctttatttcaccacaggttagttttacctaccctagaagttcatatacatggaattatacagtatattctcttttatgtctggtttctttcactcagcatagtttttagaagattcatatcattgtgtatatcagtatttttttcattttatttctgagtagtagtatcccattatataaatgtagcatccatttgtttacccattctcctcttggtggacttttggggtttttcctattgttgtctattatgaataatgcttttattaaccttcttacacataaatttttctggacataacactttcatttatcttggataattatataggagtggaattgctgggtaataaagtaggtgtgtgtgtaacttcagaagaaacttccagatggtttccaaagtggttttattatactcccaccagcaatgcatgagagttccaattacttcatatcctcattaacactttctatggccattgcttttcatcgtagacattctagtgggtatgaaattatatcctgtgggtaaatttgcatttccctgatggtgagtactttctcacatgcttattggtcatttgtttgtttatttgataatttccagttccagtcttttgtcctgttttctaaaattggatttgtctttctattattgatttagaggagttctttgttttctggatatgagtcctttgtgagaaataggtattgtgattactttttcccagtctgtggcttgccttttcattttcttaatggtgtctttgagcaaaagttttaaatttctatgaagttcaatttgttaatctcatcttttgtagttcatatgttttatgtcttcagagatctctctgtcataggatcactaagatattctcctgtttctttttttgttttttttttttaagaagcaaatagttttaggttttatgtttaggtctgtatgccttcttaaattgatatttgtgtgtgatgttacagaggagttgaaacattttttttcaatacacgaatgcagttgttctagcaccatttattaaaagtctcccctggccccttgaatcaccctggaacctttgttgaaaatcaattgaccatataatgtgggtctgtttctggattatctgttctgtcctgttgatctgtttgtccatctgatctctctttcttttctctacattatgccagtattacactgtctcattactgttgctttatagtgagtcttatggttacatagtatgagccctccaactccgttcttttttgtatgtttaaggttattttagctattctcagtattttgcaatttgatatcagttttagagtcagcttatatatttccagacaaaatcctgctgtattttgaattgaaattgtgttggatctatagatcagtttgaggggaattaacatcttaacaatcttgagtatctttaaacccatctgtagtcaaattagtcaattctgtagtccgtggacatggtctttgctcgtaaggcatagccagtgtgaggtttcagtagaaatcccaaggtgttttaagcccattaattttatgtcactcaagcttctaactctttctcctatgggtgggaaacagctgaaatctcagttcctatctttcagcatcctagctcttgctcctgtctggacctcttagagtttcccttgcacatgcacagtttaggaagatgtgagggcttgaagagtttacatatgtggaggttcttctttctgtggccccatctttccaggttttctcccctcaatatccagtcatctggtaggcttgaattttgtcaattctgccttcaagccaataaaactgtggttccatattgagttctatttacccaatcctgcacaacctggggaataatctggagaaaagccctacaaatgtgggtctcacctaatgcggtttccctccttcacgtgtcagattctctctagtttgtatgtgtttttggttgttctctcacatcatcaactagttgtttaaaatatattttccaggtattttaatcttttggtgggagggttggtccatatcaagctacttcaccattactaaaacctcatgaagatttttaagcatgtggcttaattgtttgtatttttggtattggcattttgcaaaattggttacactttctttgagaaatagttttctccactcctttcagccaaccattcccattcatatgggtgaattgttttaatgttaaagtttttcaatatatcgtctgcattattaaatcttgtctttttgcacaaacctggatttagcagaaacctagaatacttgacataaaaaaaaaaactgttcaggttacaatttgggggggtgttctgcctgctccaaggtctttttgctttgcttggtatcttttatgtacagagaaaaatgagtctgttcctagcctagtcaaataaaatcaatgtagtattatggaacattgttgataaaacattctcatcatgcacgtagaacatggatcagctatggtagaaagaaacacaacagtgagaaagaggtcaggaggaggagtgggtaagattctctctcattcgagctgaatcaactctctgcattaagttacaagggactggcgaagtaaagcaatgcatgttagaccaggtctgattgtgccataatcattacatgacttttttagagccatgccaactctctaggactaaatgctcaccaaatacatctgattgttctcattgtatttatttcttagtttcagtgataataagaatgaaatggtaagtcatactagaggtgagttcttactaggtcattgcagttgtgtctttcagagctgaccctgggtaaaattgtgagatgagttgagtttatctttggtaattccatctttgctttaagctagtcctttgtctctgcctacagttgtcccttactgcagcaagaagcccagtggtccctgtccagaaagagttgctgataaggaaaacagttaattcataggctaattcacactacagtgatagagattgatgtcatagtactctattcctcttaggtgtgtttgcatattttaaaagatgctggaagagctgctttatccatgagaaatagacttttaatgctaaaattttaatattgaaatctacgggtggggtatattttaggaaccccatatctgttctctgtgtctctgtgcgtgcattgctttttcattttggctcctagactggggctcagcttgagcttgcacgttgctgctgcctttaaaacaccgctcccttgtcacatgcagaggacgtgatggctgcctgtctgtgttaagtaagaaggaaatggagcccccccccgcatttgcctgccacagctgtggcagcaacctggacctggcactgagagcatgtccctagcttgacctcgctcctggaagccaccttagattatgtccagccataatatgacaggttggctggtgcaacatttggagctctagttcccatcttggatactgaaagccttcatggaaaagcagtgtaaggtcaggcctgcccagtgtgttttggactgtgaaaagggcattgtcctaggatcctggaggcactgtcaaagctcaggaaatgttggctgatcctcagtctgtctcacatggttgtcttgaaggtcagatgatataatatatggggaagtgctttgcaaactataaagtactatatgaaggtatgttagtgggattttcatttccatgttcctattgtcacagcaaggagatcccagtcatttcccctacccctgccctgggaccatcttgtatactcagcaggttcgttttatcttaacattgactttatggccaggcgtggtgtctcacacctgtaatcccagcactttgggaggctgaggcaggcagattgcttgagctcaggagtttgagaccggcctgggcaacatggtgaaacaccatctctacaaaaaatacaaaaattaaccaggtgtggtggtgcacacttgtagtctcagctacttgggaggctgaggtgggaggattgcctgagcctgggaagtggaggttgcagtgagctgagatagtgccactgcactccagcttgggtgacagagtgaaaccttgtttcagaaaaaaaaaaaaaaaaagaaaagaaaagactttattttatacaagaagcctcaagaatttcatggacagtggctagcataatgttggcttatctccatgcctgttttcatgatctcctatgcgggttctgccataagctcagattctataatctcaaagcactcctttaaaaaaaattacttaaattggacggtggtctgtgatatacaaggctggtattggggctactgactgctacttacctcattttttaatttttcattaattatactgaattagctcaggcaaaactattttgttaaatgtaagacatgattgagaagtgacataagaaaaacctgctgggtgcagacctgtaatcacatcatagatgctggagagataaagatgaacgagacatagacactctcacaggagctcataggagggaaggcagatacatattatgtatgcaatgcagggagccaggtcccatggcaggaataagcccagtgcatagtgttggcacatgggactacataatcaatttggccaggagggtttagagaaagcttttctggggaggtgatgtttaaaacaagtctgaatgataaataggactgtgcctagaagggaacagagttcaagagagggagacagtttgtacaagaaacgaaaaggagtgtggaggtgctaaaggtagggggtgtggaggtgctgaagattggggagtgggatggggggatgtggccagagatttcggagggcttatgtgtgggcttgcccaggacaggctcagtttgttggttacaccagaataattatacaacagcgccactgttcactttcaaaagggtgccaggtcagacaataaattgcatgttcacaccacttgtaggctaatagaaatgataagataccagtgaagggttttaagcagagatctgatttggtggcagtaagttcaagggtggggaaggggtgttagttgataagactagatctaaggtgtggagaaccattatagagacttggaaggttgtctcagggcaagattattagggcctgaattaggttggaatatgtaggggtggagaggagggggacagctttgagagatgtctgtgtagtaaaatcagtaggaattagcaatccactggatgtggaggatgaagaaagaggagtctcagatgatgctcagatggtgcctcagagtcatttaccagggtagaaactgggagaagatgatgaatccagctttggacaagtggagtttgaggtgcttgtgggaaatctaagttgcaatgtctgggagaaattggaaataagattccggagtttggcaagatgcctgggcctgagatgtagctccaggtgccaggtggaagacaggcacatggataaagaggcccattgagaagatttagcaagaaaaccagcaaggctgaccagcagcagaactctgtggagcatcaacatttaagtactttggctcatgaattatagtttatcaaaccaaccaaactatgctgaaggtttacttaatgaacacccattttgctaagatattacttgtgaaatagtatctgagtgcttgctgtatgccagggactgtttcaccagattgtttaccgtcttccaaattggcaccaaaatgtttgataatgaagttagaagaaagaacagaacacaaaaggctttgaaaagtaatgtttgcattggtggtaacagtggtttcttcaaagtttgatgatacaatgtgctgtgtgaaggtttatgcctaatgcgggggtaaaaagaacagatgaacctactcaaaacctgcagtgaggggtcttcactgaacttagatagagcaagaaaaactcttttacattcattgctttgtggaagtctctcacagagctcaaggcgtataaaattatcaactggatcagaaacccctcaccactgttcatcttgttaaaggtgtcactctgcatctgtgcagaattcccctaggcactgaggcagaagtagaagtgatttattattttgaaaaagctgcctaatgtcaatctttattctaactaagccttcctgaagctaagaactggatctgaagtctgatcaaattgaaatttattatagtgatgaaacagccctggatttttaatgcagccttcagattccatcattgttgccatgtgtgtgattgtcactatgttggactaatttttgtctggaagagtggagtagcaaaaaaaagaatagattgaaacaatggaaactgaggaaaatgcattaaactaaattcataactgctttaattggaagagaaacaacagaaagaaattaaagtatgacatcatcttatgtgaggacaaaaagatgtagctggattattatgctactaagaaatatggtgtaagattttacgatttgaagagaacatagtttgcagtaaatgaagtttgcttggactcagggaaccacaaacttaaatggttggcccacaaataaaaaaccagacatgatgtgtctcctgatggaagcccacacaacatcgtgatcttgccaaaaagtagaggtagttttgcccaaaactcaagccttagaccagtcaggcttccagatccaaccaccagttaagaggaaatataggggacagaggagcattttaagttacaccatgggatgtaatcagcaaaatccagactgtggaaaaattttacaggaaaagagacttggtttcttctaccaaacattggaagaaaaaagtaaaggaaagagaaccaaagtaacaagagagaggcatattaatcatttgcaatatatgggccacattttatcccaattcaaacacaaattataaaagaaacattaactcccaggaggcaagtgaagaaatggaaaccgtgcctggatctgtgaggatattacagaattgttgatgttatttaggtgtgattgtggtattgtggttacttaaaacaaaaagaacatccattagaaatacacttaaaaatatttactgatgatatgatatgacatctgggctttacttcagaataatgcagaggtgggcagaggagatgggatagaattgaaacccgattagccatgagttgtttactgaagctgggtgatgattatatgttgcatgtggtttattatagtattctacttttgcatgtatttgaaattttcattaataagttaaaaagtaaaataaaatgacaaatttcaagaatatctgcttcttaaacaaaaaccagaatctgggttatgacatcaaaatgatgcttgaacttgaacattttacctctttccacttacaaattaaagctggagggttttttaatgtatatgttttatccatgattctcagtttttatgtatgatgaaaaagtaagttaaaaattttaaatgactaaagtactgtgcttcagaaagacttttttaaattgctaaataaataataagctgtgagtcaaaaactgcaggtaggaacaggtgagtaagataattccttttgttccgtcataaagttctcactcacagtgaatgacaagtagattatctcctactaataattacataacattttgcagttgcgaagtttaattttaaggtagtttcctaaaagaataaagtaaatcagaaggattaatggtagaagtatctttataaagatagtaagaaaaaggttcttagtgtacttgtttcttccccagagttcccaaggcaaacataaaggtattctattttgtacaagtttttggggaaggaaaacttcctcaaaaacaaaaccctgacaaagaacctgttatttgtgaatttgaagcttgtttagaaaaaaaaggccttttacttctgctaaaaccttgaattgttccttatttgagacatttaatatgtaacttggaaaagatatacatttgtcctggggagacaatggaaaggcacttgaattttggcatctgctttttctctctactaaggcagtgcacaatggtgcagaataagagtctgatctttttctttttgtcccattgcctcagtttttagctcacatttcttgtctcaagcccactggtttacaaataattacgttctctgctaagtcatgtggcacatggaccatcaaggcagatgaagcatgtgttactgctttgaagctgcagcccacagttaccccctgtatcaacacttcagatgcatgtcatttttaaagagaaaaagtgatttctggtggtagttgatttatagcattcctttctcagatttcaagcctggtgacaagttgttgatttaatttttttaaaatgtagctttaaaaaaatttattcttttggcatattagcttgaagaatgagtgaccactttagtttttgtgtttgttttttgctggtctaagcaattgtggctatcaggttgaagacagggtaggagagaaagaaaggaattgagggaatgggagaataggaactggaaacgggcgaatgatgtttttaaaggattgagactaattgtcccttgtcatagatgctctctcgtcttctccataatatctagctcatttgttgaatgccttctgaggaccagacactggagttggcttgtaatttagcaaatagcaatgggagccctcattttattttctggtagcaggataaactcttacctagtaactgagtacctctacgtgttcataccatgctatatattattccattttctctctataacaaatttctgaggctgttgtaattctcagtatgcaaatggtgaaccagactcagagacgctaatttactatggtctttcctggatagtaagtgccagagcccagacacaagctcagattgcaatgctgaggtccaagatctttctacaccatccagctatctgaggagttgggggtgggggggcagcattttagtttttttctttattccatcttagaggaaaactgtcctcaggatagcataatcccaccctccagagagtcttgtcttttgggatgatgtctttttgcaaggcttcccttgagttcctcctccttaaactggaggaccaacattcacccaggaaaggtgcagcattctcagacatcaggcatggatgggccagaaagctctaggcagattgagtttaagatttgctcaggttttgttgtcagtaggttctcttaatgtacatcttaagctagaactcagaagatgaaaatacaatcagtgagttcagcataggtatgatagctctatttgcctttttataccccagtcatcattggcttcactgtacctacttctcttattttgactgactgtaagtgaaaaaactaggtggtggctttgttggaaattttaaaattcattctcaaagtgtgatcctgcagacttctgagagttccagagacattttcaggaagtctgcagttccaaactgttttccttataatacgaagattttattcatccttttttccccactgtgttgacatttgccccaatggtgcaaaagagaaatggtgggtaaaagcatggcaccaaactataaagtcatcattgtattcttgatggccacgtagttgcaggaggaagaaatctagtttcacttaagaatgtctttgatggaacagtaaacattattcatgttattaaaggtcaatccttgactatatacctttgtaacattctgtgtgacaaaatgggaaatatgctaaaagcattcctgcttcatactgaaatactgttgtgtctcaaggaaaagcacttgtgtgattgagttgttagctgagctagccactttttgcatggaacaccatttttactttgaaagaatgacagacaaaccatactgtggaactggcagatttttcagacattgtctaaaaaacgaatgaactgcgcctgttacttcagggaaaacaactgtaagtatttggtgccagtgataaaattagagccttcaaaacataattcgaattttggaaagtttatatccaccattgtgagcttgacaacttcccagtacttattcttttctcatgagtttgttgttattaacgattgtaatttttaaaaattgtgttatgagatatgtcaacatttagaagatgacttccaatgattcagtgaacacgtattttcacaatggccagtacgagatgttataaaatcatttatgggtcaaggatctcttgaaagcgtaaggtagactcatgtatattaatttaaagtatgaaaagttcattgatacagttttatattgcaaccaacttttgagaaactacgccttgtttacttttgtgtggtattaaagaagaatatctgcaattatctgaaaaatctattaaaattatatttttaaattactctgtgtgaggctggactgtattcatgtacttcaactagaacaacattacagtggcttgaatacagaagcagatatgagaatctagctgtcaggctgggcgcagtggctcacgcctgtaatcccagcactttgggaggccgaggcgggcagatcacgaggtcaggagatcaagaccatcctggccaacatggtgaaaccccgtctctactaaaaatacaaaaaaaaattagctgggtgtggtggtgcgtgcctgtaatcccagctactcgggaggctgaggcaggagaatcacttgaaccagggagtcagaggttgcagtgagccaatattgtgccactgcactccagcctggtgacagagcgaaactctgtctcaaaaaaaaagaaaaaaagaaaaaagaaagaatctagctgtctttttttttaattaattaattaatttatttattttatttttatttattattattagactttaagttttagggtacatgtgcacaatgtgcaggttagttacatatatatacatgtgccatgctggtgcgctgcacccactaactcatcctctagcattaggtatatctcccaatgctatccctcccgcctccccactagctgtcttcttttaagtcagacattaaagagatttgcaaattgtaaaataatgccactctctctatctttggggggatgtttgaaaatgtagttatattttattaaaatgtgtatactaacatgtaatggaattgttattgtttttaataaatgataaatatttttaaatgtctccatttaaatttctaatttgacaaatatcagtagaatccattcaaaggggtacttggaccaaaaaattttacaatttctaggttatttttttcttacattctttcaaaagcccagtgctttaaattttaatgaccacagggagaaggaactgacacatatttgtgtatgttataatcagaaaaaaatatgtacagttaggtgatacaggtgacagaattgtcatttttttgaaactttctttttgtttctgattatttctgctgtgcagtgtactttttcagccagtttttgttataagcctgttctcataaaaataaggtcaggaagtgacaccaaaacaactcagaagcctgtggtggtttctaactttagagctgcctgttacagatagcttcatgctaaacctttgcttgatttgagcagaacaaggcagtcacgatacttctgaacaagtgatcagtgctgtgagcactaaaagctgaacctcaaaaacagctcaagatccatggacagagcctcaggagacacatttctatggcactcgcttactgactagcattctccttttctaatcaaggttcttgaaaaacagaggctgactcgtttgttaatttttttcaagctttattgttttttccttgaaattatagtgatgtggtattctctctatggaactgaggtttgggtaaaacaagaatgatttaattttttgatagaaaagttaattgctccagtgtctgttttcattatacttccattttatttccagcaaccccttatctctctgctctctttgtttcaaatgaacaagacagtagagtttgttttccaggccacttgtgttggtaacccttttcctaagctttccctaataacaccctgtgtcagtggacaggtagtaggtaggaagacctgcttcttcccttctaccgtgaaactcgtcttcagcatcattctttcatcctgatggctgagagttgtgttctggtctcaagtcagcagtggataacccactgcatgaagttgatggggagtgtgggcatggacaacagtggcctgaggttgcagatacattctttgtatatgtaagagaccaccttatattttgtaagtggaaacttagttctcataggattttggagaaaatcagttgcctcctctaggaattttcatttgtttacaaaatgtcctgggtcaagcaatacttttatgttatccccacttaggtttagtggatccatccatccatccatccacccacccacccacccacagagtatttatgtagaaaactatgtaatggatgtatatattcatgcatgtgtgtatgcatgtacttagtaatgacactggtttgttctcacagaactcaaaatttggtgtgtatgtggagacataaacaattagaaaggttaacataatatgtacctccacaggtggtacatgctatggagaaaataaaacagagtaagaggacagagatgggtcctatgtgtatgctgttttgttcaaatcagatggtcagggaaggcccctctgatgaggtatcatttgagccagaggtctgaagaaagggagggagtggaccttgagtctgtctattgggatggggaacaggaagtgcaaatactgtaagggttgcagcagggagaggagtgtagctgggccttgaggtcaggggaggtgcccacatggttgttggcacaactttggtgccctgctaatgtcactttcctcttcaagaatacccttgtcacttaagtgatgttcacttatgcttgctgctggcttaccatttggctcactgagcacgtcttttcccctttggttaggggcttgaagagcacagcatcacatctatttatgacttgatgtattttgctaatgcggaaaccattccaaattcatgataacaactttctccagttctgtgaattccctcatggtttctttttgttctaagccaaattaggagccaatccccagcttaataagcattaaaagttcaaattgactgtctggaaatctataacaagtccatgcactcctaaatataattagctgtaattcagttctagttatggattattaagaaattactcttatttgagcacctcactcatcaaaaataaagtcagaaaatttaggcgcagctggaatcttctgctcttttttttttttttgagacggagtctcactcttgtcgcccaggctggagtgcagtggcgcaatctcagctcactgcaacctccacctcccgggttcaagcgattctgctgcctcagcctcctgagtagctgggattacaggcgcgcagcaccacgcccagctaatttttgtatttttagtagagatggggcttcaccatgttggccaggctggtctcgaactcctgatctcaggtgatcggcaccccttggcctcccagagtgctgggattataggtgagcgccaccatgcctggccaaatcttctattcttgaacttgtggtgaactatcatttgttgaggagttttaataagtgttagtgatagatctctactaaataactggagaggtaagtaggttggagctcagtcttggtaccttatagggacttagtatatagcttttggaaagttaattcttactgaattttgatgatacttcttgtttcatgtaaatgtggatgcttccgttatgtgagtcctaagatttgggatttaccaagtactgagaataggaccttcaaaaaatatgaaatgccaagaggatctgttttaaagcaatggaattatttgagaattttgaaaaatacagattctcaggacccagtctgaatgagaatctctggggaagaggccaaggaaacagaattcaggtaagcaccttggctgcttccagtggttggccaatttggatatccctgttgtgtcctaaattatacctaatttgattaaagttttggtggctgggaggtttgctagttgaaaaacacatacaggaaaaaaaaaatgtacaggggagtgtattgctttggtgtagtcgtttaagagttgacaaaaaccccaaatgtattcttttaagaaccttttaaaatgctgcgacaagggtcaggttacagtttttgcgttgttaggggggcacatgagactcagcagctacaggccttgttaatgtctgcaaacactcagtgctaatgtggagactcaagccaggcttgaaagtgataaaatcaggatgggaatgttggctttgctgcccatcaactgttagactggagacaagttacaggcatttccttttttgtggggtaactgagaccaggaaaagacaattgaaagtggttccagttaaaatgggagccacagttttttcgtagtatatatctttaaaaaggtttgattaatactgttcttaaaatgacaacaacaattgtgaaaggaaatttcattcatcttatatttatcagtgtttgggttccagtggcacctgtgtgctaattcttagaaccaagaatggatcacataactcagtaggtatttctctgactgatttgaaagcatgataacagcttccacttcacgctgactttctcagcattgtgccgagcagagttatttttgcaaaaaggtttgaagatttcatcagtttttccagtagacaggcatggctccaccagtgttggtctcctctttgttggtgatgaactcgacatccgagatttactctgtcaggggtttgctgtgattggagtagtgtattagtcaatttcatgacttcccgcatccactacaagatctcactttttgatccggggctgatttttgtggcacagtttgtattatgggatgtatctgctactcagaaagggagaacaacagccatttacatggtgggcaggaatagggtagttttaagcaaggaggggtgttagagtagggactgatttaaaagtggtcattctgttcatcagagactattctcatgctctgaccatttagtttatctaaatcttaggattatagggattttaataattaatactcagatgatgagttcaggtgtctctgtaaaatgaataatgcatttattattaagtctaaataccctaccattctgaaggcgggactgcatgtctaataccaccatcttatctaatggttccttgggatccacccaggcacaggagaacataacaatgcttggaggggttctaacctaggacttcagaaagaattcatcgacaaagactgaagcttaactctaggagggaactgtattgatttccttaaacatactaaggaatggcaattcagtaggactctgctgtccccttccagcccctcctcagtgaggacctggtggggacactcagccagagtgtgaaaggaacagcttcagggccctgctcaaatgtgtctgggagctgtcactttttccatgcctctttctcgggtgttggacgtcctcatttgagacttttaattcctacattcttggtctttgcctctctgaatgcttgaaggtcacacttaggtacagcctttatagaaccttttgtctgatatgcagaatattgactgcatgctggctgtgtctgtctgtctgtgcctctgtctttctctagccagggattacagactgcccatgggctgaaatcagcctgcagaccagttttgctttgtatgcagcatggaataatgcttttgaggttttccaacttgagctcttcagacagggcagggttctccagtgtcccacatcccctgttgtctgaatttcctctgaattcacacctctatgcctccttctctggcctcagtttgcaatcctgaatctgagcatttgtcccatgtgtttactgggcagtgtgcagtggccttgggggagactttgaaacatgttttagtgagaaggatcacttctttactgaagtcaaaactgaaaatactttcccttcgtggaataccatacaggcgtctctcttgcactgttcagcatcccatcctactcagtggcattcccactctaggttttgggtagtacagagtctcactgctttggggagcttttgggggcatggtggagagagaaatctcttcattttttcaatttgtttggatcagaagattagcctgctttcaggtaataggtctacttttagtgatgcctacagttccctgaatgccccccaaaagttaatttctggtgtcactgttaatccttacagtcaaaatttcctgggaattgctattggggatctgtagctgtgctggagataggggcatgggtaggggaggaccatcagttttggatcagatggacttggttctgctgcctgtccttccttgctgcgtgaccttaagcaatggttgccttatgtgtaaaacaaggggctaatgatacctaaacccagggttgctgcaaaggttacatgagcttatgcacacaagcacacacccacaaagtgtagcattaggatctgatgcagactatgttcccacccacttgggaaggaaatccgtgccccatttacttccatgtacttggtggtgaatcatctaaaagatactggaaaaatgtgattacagatgccccctttctcggccattgcttcaaatcctagacagctattgaacgtcaccggatagacgtcatattctaggagggtgtcaagtacatacaggtctgtgtttctatgtgctttttgtaggagctatcaactataaagctgtgggtatgagaatttcagggcaaggtcgggaaggtgtaggagggattcactaactctggggaaagtgtgtgctgctttgtcagtttcctgttcgctaggccacagggaatatgttggctctttctgaatctgcccaccagagccaatgtcataccttttcccaagccactgcttgagggtccagctaattgatgccaccgcattgcctctcctggtgaggaccgactgtgccatgggggtggtggctgtgggcgtagacagccctgttcatgggcatgcacactgccatgggtgctccatgggaatgctggtagatagcagaacatggatcaggagttctactctccaggatagcatgacccagccatgggctcaaggaattgctctttgggatatgtttgaaactcatcccctactctggccgattctttcagtacagatacagaaatgcaatgagaaccttctccctgtagttctgttaagataaatgagtggtagtggctcatacctgtaatcctaatactctgggaggctgaagcaggaggattgcttgagcccaggagttcaagaccagctgggcaacatagtgagatgccaggcatctccaccaaaaaaagaaaaaaaaatccaggcatggtggtgtgcacctgtattcccagttacttgggaggcaagaagattgcctgaacccagaggtttgaggctgcagtgagccatgattgtgccactgtgctccaacctgagtaacatgagtgacacagtgagaccctgtctcaaaaaaaaaaaaaaaaaaaaaaaaagagttaatgtttataaggtgtttctaggtcccaggaaaaagaaatgttttaaaagtagattgtatatgctacttgttattaatttcttatctctagagattgaatggtaagagccagggccagcattgtacattgtcaggcagcattgcccctgtcgtctgccttttcctcctgttactaggagcttgttaggtttggtcaccagcctgatgacctgatcaaatgttgcctgtcaacttggagtgactgtggttgtttattttgttatttattcaccaataaattgagttggttcactctgtgtatttttacagcatttggccttttcccaaatatttgccttagtttattaaattagcttctcagttataagttaaagtgtgtgttgacttttatgattttaattttacaggcttggttggctttgaatgaccagatggcatctcttgagtctgtgagcaggttttgtttcacttaggacttcacccccaccccgttcttaaaaatggtgatatgttaaatccactttaaatctagtatttgattattaattaaaatatctcttatgcattttgaaggtaaaattacaattttgttccatgtgaaatgggagcatgtgttgacaaaccgttgattaacttgagtggatttgggttaatctttttactctgctccatgctgcctgcctgtagggtaatataaatccgttgggctgttgctaggctcagctgcttctgagtagtttgacaggtttcatcctgttaaaggctctttttctctaggccctagattctaggggtattggggtgatgctggtgaatggagtctaactgcgtatttgcttcttgcttccagcaccaattgtggccaatggagtgaggcaaagagcactggtgtggctaaattactccttctgcagtccccagcatattattggatgctctttttccctctcccagagctttccttatcttctaatttcaaagataagcgttacctgtaggcaacgcacccgacctctatccctgttgtggtagctacacataaacatagccatcatggccaggtcccttgggtggtcacatttcctactgttctgatcaccttccactatcaacactgaccagtgtgcctggctaattccaaaccgtgcgaatggctgtgttgcctgggctcatgaagcctgtcaggaagagctgtggacagatgatttttgaaaatgagggtgattgcaaagggacagaaagtatgagacatcgtggatgctgtcttttccttaggccttcagtcatttgaagtcaggacttccaagcctggatatccagtgggcttctggggaaagtggatcagagctcagcaaggattgagccccagcgacttccaacaaaccatcccatccaacagaggctgtcttcactatgcagacctttgagccacctcagaagacaccagccttcatgctcatcctttacacgtctctttggttcatgtaccagtcccttgtcctcctcggtgaccaagataggaatggtgtcaacggatgattatggcatgacatagagtaactctttgcataaaagagtggacagggcaggcacttaacacttgaggacccctgttccagtcagccacagatgtatttattaggccttaaactgatgggatggttcttggatttttcagtttaaaacctatagggggactttacttttggccaaatgctgaaacaagtattggatttatcttcccatgtgaaaaacaaaatatggacaaaataaatgaaacaatgatttgtaagacactggatacatcagacaacaaaggccaatgattcctgagagataggaaacaaatgaggtgagacctctgagttttttcaaactgccttaaaagagtttccaagctatagcacaggaaaagggaaccatgtggagcccagcagactccctgagttgaggattggatctgagagtccagagagactaaggccactagagatcatgggatacagtactagagaagagacagctgcaccaagacataactctggaggtgtacaaagttctgagaactgatcagtgtaaagaagctgcctgagtctggggaaagcaccattcaaaaggagcaaagataactgtttctggtgctcacacggggccagaaatagtgcttctgccaccaaccagactggaaaacttcaagagtcatggagcattgggtagagtagagtacatagaagggccttgcttgcttagtggggaataactaacccaactgagcatggctttaaatctaaaaagcaagatctgatagggccgaactatttctgagtaacttagctgtgtcccagatcaaagctgattttatagaaatacaaaactatcactcaataggcaaaaaccagtgtctggcatccaaccaaaaattaccagatgtacaaagaagcaagaaagtacaacccataatgggagcaaatcaaccaatcaaaactgacccagaattaacgcagatgttacaattagcagataaggacattaaaatggttattataactatattccatatgttaagcagaaacatacttgtctttaaaaagacaagtagaaaagtgaaaatggagaaaataaacaaaaagaccccaattggatttgaaacatgggttgcttttctatgactccatccttatgttacttcaaccgaacccatatgacctgaacctggcccctgctaatttatctgaaccataagctcctacttatcttctcagtgctctctctagccaggactgtggggtcatccctgcagtgctaactcagtgatgcccaggggtcacttgaccctttaatcttccttcatgcctgctgtgccaatgcctgacctgagcaatcatctcacagatgattggatgttgctggctggacccatggcatataaatttttggcattaagcagatacttagcaaaaacggaagcattcttcttgtgttggtttctcagcaattctaaaacttttacacctgaaagccccttcccactttttttcccactcatattctctttctcttactctgctgaaaaaatcctgcaagatctgccatctttatgtgcctgctgtccctcagtgtggccatctcttttcttcctttctgctggctgccagggaacctctcttcctacagaagctacaccttttcctgggtggatccatcctctctggcctcttaacacattctcacatgttcatttacctggactgaccacactttgtttagtcccttgctctcctttggctgcttctcctgtggtgatttaaacagaaaaaaaaaattcttcacctgatcatagtatcctcagctaccatcctatttctttcccccctttgcagccaactatcttgacaaacgttttgtatctgcgtctcaccaccaactttctactcagctcctgcttcgctcttgcccagacactttctaattacaaagtgtacctctcctttctctgcaatctttcgtgtgaccgtgatgctgcatttggttctgtttcatgttctccctttgggcacctcaaacgactgcaaacccttggcctctattctgagtggtggtccccagcaccccagctccttttctcccattcccttcagtgatgacaaccttcatcatttctttttaagcgccccccccccgccccgcccatgtaccctgtgcctatattctaagcaagtggcttagatcctacttaatctggaaaattgcatcaggtgtgagtgacttccctcaactacactgactttatctgcattcccacccatcctgagtccttagcctctgttccagaggatagttgtcattgcttttgctaaagacctgtgcttcctcacgaactttgcttccctttctttaacttctccatttccttctctcattttctttctctgatctgtaaacatggccaggcctcctcctcctaaaaatctccttgggtactttctaatttgtctcctttttttcatccggatatgttgagagtacagcctacatactaattcttcacttcattgccttctattttctcttccagccgctacttaagctctctggcttccctcaccactattctgctcaagtagcgcttgataaggtcactgagggcatctatattgccaaatccagtaagcagtttccaggccccatcttattggacatctctgttgtgtttggcagtgctcatcactcttccacctcagagcccacactttttgacttctgcaactctgaagtctggatcatcccattcttcccttctcttcctttctcgtatctttgggcttctctaccaccctctgcagtttgtatccttgggggatccatcttcagcccgccgctgtccccattcacatctctggtcatctgtttcagtctgggatttcactctgcctgttgctctccactcctccgtctatatctgcagcccaggtctctcccctgagttccagcttcctgtgtccagtcgtgtgctgggcactctcaatgggcttcatttaatcttttttttttttttttgaaatggagtctcactctgtcacccaggctggagtgtagtggtgtgaccttggctcactacatcctccgcctcccaggttcaagctactcttctgtctcagcctccctggtagctgggattacaggtgcccaccctcatgcccagctaatttttgtatttttgatagagtcgaggtttcaccagattggtcaggctggtcttaaactcctgaccccaagtgatctgcctgcctcagtctcccaaagtgctaggattacaggcatgagccactgtgcccggcatgggcttcatttattcttttttttttttttttgagatggagtctcactctgttgcccaggctgcactggctaagttttttgtatatttagtagagacggggtttcatcatgctggctgggctggtcttgaactcctaacctcgtgatccgcctgcctcagcctcccaaagtgctgggattacaggcatgagccactgtgcctggcccatttaatctttcagttagcaaacatgcatcttctgtccccacactcttgaatatgaaatgttgaatataatgaataaaagcattccccctctgccaagcaccatactatcctgattctgtttctatccctttgtccttcctctgtttccttcctgggctcttgtgttcttcactatcttagaagtgggcgcccattctcatagggcctttcatctgcagggacactctcagtggttaccttcaggccccatttttcctgtgagccctggttctgtgctgtctttcaaactcctctggctcagaccccagttgtcattttcctcccatatcagcactgtcttcactccatttctgtcattgccttcttctgaacactgaagcttgaacacacacattttccccacctacacattttgtctttcctactaacttaaaagcaatttgaagtgtgtgttctattgtgtacctgtgcacctctccctccccaacatggtgatatgtgagggtataaagtgaggcaaagaaaaggcaaaaagatgaagttcctgtcatttcccattttaacaagagttgcagagggtccccctaccccccatctcccacagcaactttgacattaagtgatcacttcaggggtggtatttgtggaagaggtttcacccacacttccatttccttaggagagctgaggaagggggttagccattgaaggatgaagatatgtaatcaatttaatgaggactgtcatttggggattttacaggaatttttgacagcatttactttaggctacactatgtggaatcttcctttccctttgggtagtggatcccttaatgccatatttgtctggttccatatctttcctgtcaccttcagttttttaaaaaaattgtgataaaatgcacataaaaatctaccttctgaaccatttgtaagtgtatagtccagtggtattaggtacactcacattattgtaaaaccatcaccaccatccatctccagaattcttttcatattgcaaaactgaaattctatacccattgaatactaattctccattccctctccctccagcccttagcaaacaccattctgctttctgtctctatagatttgactactctaagtacctcctataagtggaatcatacagtctttatccttttgtgattggcttgttttgctttgcataatgtcttcagggttcacccgtgtggtagcatgtgtcaagattcccctcccttgcctcttttttcttttcttttcttttctttttttttttttttttttttgagacggggtgtcactgtcaccctggttggtgcagtggcatgatcttggctcactgcaacctctgccccgcccccgggctcaagccatcctcccacccagcttcctgagtagctgggactacaggtgtgcaccaccaagcccagctaatttttgtattttttgtagagacaggattttgctatttgcccaggctagtcttgaactcctgggctcaagtgatccactggcctctgcctcccaaagtgctggcattacaggtgtaagccaccatgcccagtcaatttcctccctttttaaggctgaataatatcccattgttagtatagatcacatgttgtttgtttattcttccatcagtgggtgcttgggttattcactttcagttttaaaacaatctcttgttagtatttaatattggattttgtttatgttgaaaactttggtctcaaactcagttgagatctccttggcatatatctcccagcttggctcagctgctgggcgtgaagaagatgatgaggccttgtcctgagatacaacaccccctaacctcttcccagctctccctcctctctctttcctctccccacccctgcttctctctcctgtccctttccccctcccccaagagtgatagtaagtaaactcacattgtggcaacacccgttggagtctcctgcccttagctttctgttggggagagaatagtctgccacctgaaacactgcatgccctctaaggccaacacccctttcctttctcagactcattctgactttgaggaagtagtccagagtagtggaagggcttagcggtcctgtctccaggaagcccttatgggaggaggctctcagaacttaaattgtggggtactttgtgcctttgtcctcaggtgaaattctgggacaacaggaaaattgccacccaacattgttttaacacttaaaaattagaggggacctagactgatatgatatttataagggctgtacataggagccctgaaattctgtcttctctctccatccctttttcagtatccttcatacttgaagaggaggggttggggtccagtatagaatgggattttaaagtccctttattaatcattatttccagaggcgagactgctccttaaggatagacgtctttgaaagggcttccttcctgttgtctggacccaattgctttaccacatagaaccgtcattactttccctctttttggcggtcttttttgagctctcattgttggtctaactgaaagcacctgatttctagggctttaactgaaagcacctgatttctagggctgtcagtgcagcacagcagagactgctcttcaaatggtctggcttagtggtttctaacccttttgattaagaagaccactgctaaatttcccagagcctcacctaagtgttgtactttgtgtctcttttgactaatcatatacttaatgacaaaaatttggtaaattagtgaagcctttaattgggcatatttttaatttatgaaagtatatcggcacttgtgcatatgttaggcttatttttcattcggagacagtgcttggtgcattgtagatttatggttccttataaggagtcctccttctgtctttgaagtcttagacacacagcttgggaatggtcctaatagactgtttcctttaaaaaaagaaagaaagaggagcctgtagtgtgattgaatctctatctgacaaggcttaacagtctaaatgaaaacatctaggttgaaagtgtgtttgtgtttgcagtacatttgtgtatgagggtttttgtggatgttttcaaggactgatgaggaagccacacatgggttatttctctactgaaagggtagaggccaggtcatctgacctactgattaaacttgaaaagggagagtgtgtcttttgccatctcaaaggccagctgtttattgaatttctccaccctgcaattgtcttacatacggaatagttcctggagaaagatctaacatctgcgcaggtctatcctgttctgtggctgtgtttactaaagtgagttctgcgcttacattcacacactgcaaactgcacgtacgatgtaagtgtacttgtcatgtagagttttaccaaaactatattagattatactctgaagcatgttttgcatctgacaggtcgagctcattcattcagtattaagtccctcatgggccaggctctagcctgtgtcctggtgataaggaggtgaatgtgacagaattcctattttcaataaactcactgtctggagaggaaggtgatcatcaaaataaattttagcacgatgtgtaatgattaatgcacagaggatctttggaatctccaggaagaaggcctgacaacctctggatgaaggatgggatggaagataaagtggacttagagagatgtatcgtgtggctctgtctttatccctggaaaggttagcctaagcatggggtaggtgctggtttcttttgctgagaaatgtctcagagaacctcagagtagcaggaggcctttgtgatagattggccagcagtttttatttccctgacctttcagcatcaaaaagtgccagttggaccctgggttttgccttggaattagtaaatagatagttcaacagcaatggttgaaaagcctcttggagtctgtcccatgagagtaaggatgttaattctgaagcctgggccattttccatcctgggaattatactctgccccttcctaaattcccattgtggtttcaaatgaagaggccattgttcactttccttcctaaaagaagcaatatatttaacttctggctctttgcctgactgatggcgagttgatctctctgaagccaacacccgtggcttcctatcaagagaaacactctgcctccatctgatttccttcttgggttgaagttatttagatcctacactggctcagtaggaggcttgcctgccgttatgtcctactaggtggtgacagggcccttgattccctccctgtgtttaatagaaataaagacagagtcttagcgctttagggcagctagttgttctcccaaagacctattataggaatttaaaagcaaatgtctgatgtgaaaatctatgctattttagggactttgaagcacaacacaaaagagtatcactttgttgaatagtttgggtccaggcaggtgtcctagagcagaagttttcatttatttttaagcaacaaaattctttctttcccaaatgaaatctcctacagaatccaaatactgaagggtttctcaaccccagcatgcttggtattttgggccagataattcttgttgtagaagctgttgtgtgtgttggaagatgcttagcagcattcctggcttctaccctccagatgacataagtggcacccacattctctagttgtgacaacaaaaatgtctccagacattgcaaaatgtccactggggagcaagatcacctccagttgagaatcaatgcaatataatctagaaaacagacttttaattaagctcctcctttagaactctgcccagggtccctgactgttagtgtttgagacctggtggggcgttctgggctacacagatgcactatcctagagggttaagttgtcattttaaaaacctgggacatagagaacttgttataaacaaagcaaaagagctaaaattagacaaatccacaagtactttgaacccacatgtacactaaatatttctgtctatgtattatgtatacattgtgtacttggatgtgtagcataagggaagagtcgaagggtggtgtctgccttactccttatgtgttgaggtttggctaccacaatttgccctgttttgccagagatgccagttgaaggcctgtgactgacagcccagtgatagagtcaccctcactgcacaaaatactcagcttctgtgggattcagtggccctggccctgctcatgggcattccgtggtgagtgggccagcacctgcagcctctttcaaccagactggttggttggagcttggaccatggttattccaaggtggatttttatccttctgccctttgtactaaatgggtcatgtgtgcctctgtacgtgtgtgtgtgcgtgtatgtgtgtgactacacgtgtctgtgtctgctcttctcctttcagaagcccagagccactctgggcctggccactctgagcattggttgtgtgggggatgctgggagcttggcacatgctactcctcctttttcctcccttagaatgatgaaagtgttgttggagcctgtcccacagacagaaactgtacctcatttatgtgggcatcagtataaacaagaacaataccactatgtgagtcaccctcacctgcggggagacgcataggctcagggagggaatttgctgccagagggtctcagcttcagtctgtctccccggcagactcatcctaacttcattccacagctcaagtgcagtgtgaatcagcaggcagcctgtgcctagctaaaggactctctctgtgttttgtttgtttggttgcttgtgaagatctctgggcacatacagcagtgttttattttcccaaaagatcgcatgaccactacagttagccttgggaacagattgagtaagcacaattcatttgatctatctgcagatctccagcccttctaagaaactcacttccaaaaatgtttcaggagtcctgtagaagtttgcttagagttccttaaagaggctaagcgtcagttgcaatatctctctatcaaccccatttcccccagtgccactgccatgggctggaggagtgggtaacttgcttaggaacttgggtaagggacctgaagctccccacccactctggccctagataggctaaagatttgaaattagtttgatttatgtaaatctctggtgtgaattattgctatcagataaatacacagaccattgaactgaaaacagagcctcaacacaggttgccattgctaatgttagtttatagtagccattatctagtagtgcctttatcagtgaccccaggtgtataattggtttgttgtgaaagaggagtggagttcccaggatgctttttgtcccccatggttcccttataagtgactgtatttcctgagctctctgcacttttgtcaccttttgtcatcaatatatacaatcagtttcaggcaatattgatagggatgtgaaaactaaacactataagattgaatggacttaatagctaggagttgcagaaaatattcctacatgtatacataacttttataatgtacaaattgttcttatgtgcatactcttgcataatcatcacaagtcagccttgtgacttaggctctctcttggccttatcttgagagaatttatgaaatctgataatattgcagccccgtaggaaaacttttcagtgccttgctatgatctctgaaggcctatactcctccttcccttcctaggctggtattgacctgctttttaaatctcatctcctaccagaccttcatattcattgtagttctagcagtagtgtactacttgtaggtacctgaatgtggcaagctcttttctacttcttactaatttatggaaacaccaatctacccattcattctttcactgctacttgtatgctaggcattggtgatatcccctaaccccctggtccttggtctaagcaggcataggtggtgctgtgtggtaagagctttggtcttggtgctaggggagctgtaaggagggcaccaagccttgacttgaagggattagggaggcttctccagtaaggcatctccaaagtaagtcattttagtgtgaggtggatgggagagttaggagaggagaggaagaaagagattagggcaggtgtggaccccaggctagacagggatggatgagtgataaggtcttgatagtgggtagtgccagatgcaggtgtatagttttgaggactttgccctaaggcctgaaggcagccattcaatgtttttgttttttgtttttttgagacagggtcttactctgtcacccaggctggagtacagtggcgcaacaatggatcactgcaacctcgaactcctgggctcaagtgatcttcccacctcagcctcatgagtagctggggctataggcatgtactaccatgcccagctaaatattttgtttttctgtagagacagggtctctctatgttgcccaggctggcctcaaactcctggcctcaagcgatcctcccctcctgccatggccttacaaagtgctgggattataggcgtgagccacagtgcctggccaattaaatgctttttaagtaggagcatagcagggtgcagattgctgcaaagcacctttctagaatatatcctgttcccctcattctccctctagtactttctagtatataccccgttcccctcatcctccctctagtactctgctgcttaggctttaggttcaattcaggcatcactgtctctgtatgtgctccagattccccgggcaccatcgggggtccctctgccccacagcaccctggacatgcatactggagataaagcagcaattgcttttgtattttaaccgtctagttgtgtgtccttcctcctagaccactggttttcaggatttaaaagtgtagattcttgttgcccaccccagatattcttacttactgtgggatagagtctaggcatccccattttttttaaaagaagcagaaacattgcagtaggctaatcttattgagggcctggtttatacattatgtgtgtgcacacacgtatgcacacacccccacatacttgatctcattcatgcttatatctgtatttcttttatttttattttctttgatcctgtcattcaaatatccatatttcttaagaatgtccggtataaatttgctatgctacaaatgtttgattgaatgaatgaatgaagttgcccaaatttacgtgtgaagatgtgttggagcctaagttaaaattcataggtgattccgaggcaaggccctttcacagcatcactcttacaccacagttgctacactgagatggcctttgaaaagcaggcagtcccactgaaccacagtatcctagagactaagaaacggggacaagagatctttaacttgcattttataattttcagtggcacatcaataatctgcagggatacactaataagatgggtattggacactcattacgacagaccctggaggatccaaaactgtaaaatctagctctgatctcctacaaatttttggtctacttgagggtaaaaggcagaaatacacagacagttgaatgactgtgccagatcgtgacagttacctggagtaccgtgcacagaagggcaatagaatgatgcagtgactgagtaagaaagagcatgccattagctggagtggtctgcagatacctttggatgaggaagcacttttatgaggtttggctttagaaaagtgagaagccattccaagtgggaggagtgacatgagtggaatcctggcaggagatgggctatgaatggtgagggcatcagtttgacaggaacataggtttgtttgtgtaggggagtgatggttgacacctaaagggagtgctggttcaggattgggagggccttaaatgataggtggggctataatacagttggggatgtgtggcacattcagcaatgtaaaagtctgttgtcctcgaccccagatccattcaccttattaatgaaggtcatgaatttttaaatataataactgatatggataggttttgtgtcctcacccaaatctcatcttgaatcataatccccaggtgttgagggagagacctggtgggaggtgattggatcatgggagcagtttgctctttgctgttcttgtgatagtgagggaattctcacgagaactgatggttttataaggggctcttcccccttcacttctcccacatactctctttctcacctgctgtcatgtaagacatatctgcttccccttatgccatgattataagtttcctgaggcctccctagccatgtggaactatgagtcaattaaacctcttttctttataaattacccagtttcagtatgtctttatagcagtgtgagaatggactaatatagtaaattggtactgatagagtggggtactgctataaagatacccaaaaatatggaagcaactttggagctggataacaggcagaggttggaacagtttggagggctcagaagaatataggaagatgtggaaaagtttggaacttcctagagacttattgaatggctttgaccaaaatgctgatagcgacatggacaatggagtccagggagaagtagcttcagatggagatgaggaacttcttgggaattggagtaaaggtgactcttgctatgctttagcaaagagactgacagcattttgcccacaccctagagatctgtggaactttgaacttgagagagatgatctgaaattggaacttatttaaaagggaagcagagtatagaagtttggaaaatttgcagtctgacaatgcagtagaaaagaaaaacccattttctggggagaaattaaagctggctgcagaaatttgcgtaagtaacaaggagccaaatgttaatcaccaagacaatggggaaaatgttcctagggcatgtgaaggacttttgcagcagcccctcccattacaggccccgaggcctagaagggaaaagtggtttcatggactgggcccaggaccctgctgctctgtgcagcctaggacttagtaccctgcttcccagccactccagtcatggctaaaatgggcaaatttttaaaaagtcagctcaggctgtttgcttcagagggtgcaagccccaatccttggtggcttccatgtggtgttgggcctgcaggtatacaaaagtcaagaattgaggtttgggagcctcagctgagatttcagaggatgtatggaaatacctggatgtccagtcagaagtctgctgcaggggcaaagccctcatagagaacctctgctagggcagtgcaaagggaaagtgaggggttggagcccccacacagagaccccaccgtggcactgcttagttcagctgtgagaaaagggccaccatcctccagaccccagcagatggtaaatccatctgcttgcactgggcacctgaaaaagccacaagcactcaacaccagcctatgaaagcagccaggagggggatataccctgcagagccacagtggtagagctgcccaaggctatgggagcccaccccttgtatccacatgacctagatgtgagacatggagtcaaaggagatcattttggagctttaagatttaataactgccccactggatttttgacttgcatcaacctgtagcccctttgttttggccaatttatcccatttggaatgggtgttcttatccagtgcctgtaccaccattgtatcttggaaggaactaacttgattttgattttacaggcttataggcagaagggacttgccttgtctcagatgagactttggactgtggacttttgagttaatgctgaaatgagttaagactttggtgaactgttgggaagccatgattggttttgaaatgtgaaaagatatgagatttgggaagggccagggctggaatgatgtggttaggctttgtgtccccacctaaacctcatcttgaattctaatccccaagtattgactagagacctggtgggaggtgattagatcatggggggtggtttcgtccatgctgttcttgtgatattgagtgagttctcatgagatctgttggttttataaggggctcttctcccttcacttctcccacacactctctgtctcacctgctgccatgtaagacatgcctgcttccccttctgccatgattgtaagtttcttgaggcctttccagccatgtgtaactgtgagtcaattaaacttcttttctttataaattacccagtctcaggtatgtctttacagcagtgtgagaacagactaatacaataaccatgttctcttctttctggagatctccagccacatttgacttccaggtctgtgggaagcagtccaaggtgcaacctggaacactttcatttggcttcttcatgtagaggaacatttacatgtcgctgcttgttccttctacccatggcctacacacactgccaagctgtcaccttccctgttgtgcaatgtgtttgccatcaccttcaatgaaaacaatttttttaatgtcagaattttcttagttattaatcccaaacacagacaccagaaacatgatccagaataaagttttcagttcacactgagcttgtcattgctgaagtaagactcttagctctttcacaagtatggacaaaattcagtaggaatgttttcatcacaagtcttacttcttaataatgctttgatctagggtaatttctctttagtcttggatggtaattttgcctgaggaaagtccaagaggtcttatgtgaagatttctgttttgtttagagtttgccacaaatactggaaggagaaagttttctgtaatttatacagctttacattagaaggctatagcttattttaaaatggtttctgttcaaaaaattttcacctacaattatagtataaagtgccttgtccttgtattcacagaggaattttctcatacaactacaagaaaatgtggaaagtttcgtctgagaaaattcaactttttcatctctcataatttactgcttcaggaatgcaatttaccaaagtggattagaaactgtttgtaatggggaaatacgtgcactctttgaaggcagttgtcgacaaagagtcaaactctaaaatatttgaagaggtttattctgagccaaatatgagtgaccacagcccaaggcacagtctcaagagatcctgagaacatgtgcccagggtggttgggttacagcttgattttatacatttcagagggacataagacatcaatcagtacatgtgaggtatacattggtttggtctggaaaggcaggacaacttgaagcaaggggtggggagttgtatgggggagggtgcttataggttacaggtggattcaaagatctgcttattggcagttagttgaaaggataaattagttattatctaaggacttagaatcaatagaaaggagtgtctgggttaagctaaggggttgtggaggctgagattcttattatgtagatgaagtctcataggtgtcagcccttagagacaatagatggcaaatgtttcctatatagacctaggaaaagtgctagactcaacagttaatctctttaggattgggaggacctggaagaggaaagatctagttatgttaaagagattctttacggatgcaaattttcctccacaaaaagatgctttgcagggtcatttcaaaatatggcagagaaacatattttgggataaaatattttgattttcttctttggttgttttgtttgtttgtttttgagacagggtctcactctgtctcccaggctggagtgcagtggcgtgacaatggctcattgcagcttcaaccttctgggcttaagtaatccttctgcctcagctgcccaagtagctgggactacaggcatgcaccaccatgcccagctaatttttgtatttttgtagagacagggtttcatcatgttacccaggccggtctcaaactcctgggctcaagtgatccacctgcctcagcctcctggagtgctgcaattacaggcatgagccacttcacccagctgttacctttatctatcatgtgatgctagctgagtgtggtggctcacacctataatcctagcactttgggagactgaggcaagtggatcgtttaagaccaggaatttgagaccaacctgggcaacatggtgaaacctcatctccacaaatatatatatatagatagatagatagatagatagatagatagatacacacacacacacacacacatatatatatacacacatatatatatatatatatatgtatctcacacgatgctataccagagtcaggttgagttggtatttttgtagagacagggtttcaccatgttacccagactggtctcaaactcctgggatcaagcagtctacctgcctcaccctccgaaagtgctgggattataggtgctctgcactctagcctttgtaacaataagggtctattctgtcggttttaggtctctattttagtgttaatgctggtcagttgagtctaaactccaaaagggagaggatataatgaggcatgtctgactccctctttgcgtcatggctttcactagtttttcaggggttttttttaatccccttggttgagaaggggtccattcagtcagtagggggagcttaaaattttatttttggtttacaaagtgaagagctttcctcttttaagtcctcaccatataaccagtctctaccagatgctgagaatagcttaaactttcttactgtcttatttgagcctggggtggtttgttgtaggaccttatcaacatagattttttgataattgatctactttacttcgatgtctgagtaaagctttaacctggcccttaaacaccaaaaatgctttagtgggagctcttgttttgggaaaatgaaaaatttctgtgtctatcaatcacggaaagtattccccactggtttgattctgaaattcaatcattgcctatgaaagttaaaaacatttttttttccctgtagctagcttttactctgtctctttaaaatacctttttttggaggagaggtggagcaagatatgtgtaactatagttttttctttttttgcttagatggtttaaagaattctgcatgtcatagttgacattccatcattatcctgtgttccacagtcaaggccaaaggttaaaaataagttcttaaaggaaacaaaattaaagcaagagggaattacctctgaattgttttagggactcctagcattttgcatgagtttctgttggtctggagaatagaaggaagcatgaaaggtttcattccttgcaaatcaagtgaaactggctcctaccctcttcttcaatacaaacatgaaacagaaaaagtagactggaagaccagaaagggcacagatttttataccattttcatcaggattactatgttcatgttatggaaccaatttgtaagttttgggtaacagcttaaatagaaacctatagaactgaggcaaccttctgtttctcaaagacagatggtgaagcaacatttataaatgctttacagttagagagcatatgctctcgtccactgttttttgtctttgtgatcaaagaaggatttgaggaatttcttttaaaaatcagtctgtacaataactgagtacattactttcagataatggagaatagtcacacccattgttttcagggcctcagggaatcctagaatgtgtgtcttgtggactgtgtcatagttggctagttacagtggcagttactaaaatcaaatctgtttcaattaataaagaacttgacaatgaaactaacaagacccattctaaagacgccaggaaaataaaataaaaacccatatgtactaggaattgtaaatagagaggaagcagaaacaatgtaatttgaattatcttattaaaattttaaaatattaaaatttaactagtttctcttattcagctagagacggtataaaaacttggcagaagtgtgatttttgtctatctgctggccagaataatactatatagatgggattttgtaggttttagtctctctaccccgctgtcttccaatatgtatgcagaaaaagtaaacatgatccctaacctttctgaaaccttctttaccttcagtctacacatacatagtcttgggcaaagagttatcaggtaaattccatggaatcaagagtagaggcatatgttgcttttcttaataggaaaaacagtgactgtgtccccctaaataaagtcatgattcaatgaaaagacaaacagcccaattttaaaaaaatgagcaaaagatttgaacagacattttctcaaaagaaatatgaatgggcaatacacacatagaaacatgctcagcaattttaggctttagggatatgcaaattaagaccacaatgagataccactagaaaggctaaaatgaaaaagaccaacaacactaaatgttggtgagactgtggagcactagaacttttcatatttttagtgggagttcaaaatggtacaaccgctttgaaaaatggtctggcagtttcttacagaactaaacagaccactaccttgttacccagcagttcttaggtatttacccaagacaaatgaagcatatctctgtcaatagaaaagcagatgccagccatggtatgattttgaacagccagtggaataaaagaatagggactatatctgaccttgctgttagagtagttaggcagatatgagcggggcaggagaggcccccctcccccacaggaatgtcaggcaaccatcaggtgatggtcaggtggttgttaaactgtctcactaacatactagttggtcacagcttgcaccagggaaagcagactcccagtagatagaaaacaccttaagctcttaatcagcagcttcctttttttttttttgagatggagtcttgctctgttgcccaggctagaatgcggtgtcgtgatctcagctcactgcaatcgctgcctcccgggttcaagcgattctcctgcctcagcctcccgagtagctgggactacaggcacgtgccaccacgcctggctaattttttatatttttagtagagatggggtttcgccatgttggccaggatggtctggatctcctgacctcgcgatccgcccgcctcggcctcccaaaatgctgggattacaggcgtgagccgcggcacccggccaatcagtagcttcctcataggatctcaggcgttggatgagtgggctcaaacttgcatgctaagagacaaaatggtggagtttagctggtgtatgaccttcctctaggaacactcaattggtaagggaaaaatgcctcaaatgaacatgtgcacagcttcagtaaacacactgtacatgcggcccttcccaagtgctggcaggccactgcacatgcggacagcccaccccaaggaaaaaccaagggaggagagacacaaacctcagcaccatgccattgtgtaaaaatcccaagtcaagcgtcggacagggtcctcggatctctcaaattgcccacttggccctcttccacgtgtactttgcttcctttcattcctgttctcaaactttttaatatactttaactcctgctctaaaacttgccttggtctcattctaccttatcctctctggccaaattctttcctccaaggaagcaagaatcgagttgctgcagacccatatggattcgctgctgctaatgttgccatttggatttttttttctttttagagtgttctagaatgcatgcttagagaagggaatgtaatcctaggacaccactcagctctgcaacagtatagctctgcagtaatgagtaaatgctgtttgttggtttactttaaagctctgctactgaatatatacaaatatactgttatattttcctggtaaaaccttttattatacaatcacttctttttatttctagcaattctttcttttacagtgtattttatctgacgttaatgtggctgcattgcatgtcttttggctagtatttgccctgctttgcatcttctttaattcatttactttctactttttctacctatgtcttaggtttgtgctttataaacaacaggtggttagatttcctatttctagaagtttattgagattctccctctaccactgtctctaccaattccattttttcccacctctattggtttggaagatagaatctctctctctttttttttttttttaagtgattatacttggaattttaacatgtctgtgtaactaagtctaaagttagctaccactttaccctcctactgagcaatctaaggatgttagaatgtttttaactccagtcactttcctcctggcttatgtgcatttccttgatatttttgatatctttttatttttcttttgaagctccattaactagatgttattagttattccatccttctttgtttctatttacttacatgtttataattttttaacataccactttcttgtatagctcaaaccttccctcgaacatttccctccttcttcaagtagattctcttcaagtacattctttatttagcgaaggtatttggtagtgaacaatctcagttttctgaaatatctttattttgccctcattctggaaagctagtttcttactttatttttttaatagacagagggtcttgctttgttgcccaggctggtcttaaacttctggcttcaagcagtcctcctgccttggcctctcaaagtgctgggattacaggcacgagccactgcgcccagcagtaacgctagtttcactgggatcatggactcttaagagctagaaggaacttcactgattatttgactcagccttttccatttccagaaaagcctgccaccaggcacagaaagaatacatgacttccagagtccctcgctatattgtccagactggttttgtactcctggcctcaagtgatcctcccacttcagcctcccaaagtcctgagataataggcgtgagccaccgtgatcccctttacctttttctttttttttttcctttatttcttcttaataaaaaaaaagtgggggggatacatgtgcagagcgtacaggtttgttacataagtatacgtgtaccatggtggtttgctgcacctattgacctgtcctctaagttccctcccctcaccccccaacctcttcaaaaaaaaaaaaaaaaaactatcaaaaaatggtggccgaggttcaaagctctcaccttggttttgtgataaaggtggttaatctttggtgttggatttcaaattagtctgtttacagtgagcaacagtacagcagttttaaaaatcatgttgaatcagaaacatgaagaaggcagcagagctttctctccaccatgcacttggagaaggaaatgactcggcagcatactcctcatggctaatatcctttaagatttttccaaaatcatgaaaccagaacttgagagcttaaaagggactttagaagtctaccagtggataagagagaaaaaaaaatcaaaagggaaatggaataagccaaactaaagggcaggattcttttagttctcagcaggaaacatatgtttatctggaaaagattttggttggacaggttgtttgtgtaagaatcttttttgtgaggaaggaagatcaacctgggcttgaaggctggggtgggggtagagagaacagtccctgagcttcaagtaaatgagaaaaatacacagattttaaacagaggagccctgctttcacggggatcatatgatcgtgctatcagcttacttttaagttgtgataatgtatacatactttatgaaatatgattaaatggtaactttagtattagtggctacaagaacagaaacagcaacttttaaaaagatatgaaaagatgttttgggtgaaagtagttggctgcgcaacacatagagtataacatacatcattaatttaagactgtagatgtacagtatatatttggcatgtacaccaggattttcagtgattattgatgtaataagatttatgatttttaaaaagaaactcttcatgatagttttctgtaccacttacattttccatagtgatcatcatattgtctttataaacaatgacaacaataaatcaaaaagagagatcttacatggtgcctcttctctgacagctgagaccacatcatagctacgttgttcccttacattgcatttacattacatttaaaatgttatcaggaggacagaggctcatgaatgagacatgttctctccagttaaatttagtaaagaagaatcagagaaaaatctccagataactggaaaatgtttacattttcaagtatataaaaccaggatacattatcttgtttaagcttggagttgacaataataccattttgagatgtttttcagatagaatgacagtgagagtcatagtggggttgcacctccacatgatgcaacccaaatgtgatggaacagaaacatttttcttcatcatcctgaaaccgagcagtgatgatccgctgaggaatgtttaattttcatgtattaaaaaatgaagaatgtctgacctactgttaatgagaaaaaaaaacaccaaaaaggaagaaagaagaagtggcagctaaaagcctttttatggatgacgtcaatagaggaaaatgaaatattcatagaatcacagcaagagaataggaattctgaacatttttgtagaaggaaactgtaggattcttgcaattgatagtaggacaggagggaatttccatccttatgtgtgcagaaaggagtagacacagtgaaatttgaagactattgtaaacattttctacttcacttcaccttgaagaagtctacagaaagcatatatggcatagctgggcagagtggctcatgcctgtaatctagcactttgcgagaccaaagagagaggatcacctgagcccaggagtttgagaccagccagggcaacacagtgagaccccaactctactttttaaaagattttttaaaagcatatatggcagttaaatttcagtgagaaatcaggaccagggtaaatgtaaatacattactatagcagataaataaatatggatgccccacccatatttcctttcatcccacaacagaaagctggaaatgctgaaaaattaatacctcccacccctgaagcagccatcagccagtgaggaatgggagccagaggataaataacccaacttcctcacccgctgagggtgttcaaccaggtccttgaaattcccgacaggaatcgagcctcagttgcccaccctggaaacctgctcagtaatacgcttatcgttggtttccttccctttcctgtctcacttctgtaatcccctggtgcatctgggggttccttcccgaataaactacttgcaacttaagtccctatcttgaactctgctcctgggggaatccaaacaagaacaggtggagacagagtagaacaaggataagcaaagcaagagaggagatctgaagacgtctctaaggttgtttgagtgactccaaggatagtggtacaattagctaggagaaagagagggtggaggaggccgagaagagggttcagcccaacaaatgccaagttttaggtagcttggggataccttgaagagatgctgacaagctacttagaaataagtttattagctagaagccggagctggccaggcacagtggtatgcacctgtagtcccagctactctggaggctcaggtgggaggatggcttgagtccagaagctgtttgaggtcagcctgggcaatgtaatgagacctcatctcaatatcaacaaaccttatctcaatataaatgaatgaatgaatgaatgaatgaatgaatgaatgaaaccagagctatagctgtatatttgggaatcctcagtgtacaggcagttgatgaatgaacatccagaaagactagaagcatggtatgcagggaaccttggagcatacacatatttaaaaattgggtggaggagaaaagccagtgaaggagactaagaaagacgattatagagagaagaaccagagctgttattggagccaaggcctctttcttcaaggactgagaaggggagagtttgtactttggagtttgcacagatcacagacatgaaaaaggaaagatgatgatgagtggaaaatgggaggtcaggactctcctcccatcctgatgtggcaagaggcttttctcatggttctggatggaactttggccctgttgcagatgctcacatgcaacgttctgttctaatcactgttctgctggcagaggaggctggagtgatgagtgagcatgggctcagcttgcgtggatgctatgagccgtaggtcctactcaagagagtcagtctagtaacaaattattttcctctccttcttttgccatcccatttagtttgcaggatggttggtgtttgtgtgggctgagattcctcagagggaaccaaagccctgagaaacatgtgtagcagctgttgatttgggtctccacagtgagatccgggtctaatacagtgagtccaaccactttatctgagtttggaaataactatgagtacatagttaagctgttttcaaaaaacacagaggattctgtactgctagtgccattgagggggcttttgctgccatttattttcaacttatttttttgaggtggagtctcactctgtcgcccaggttggagtataatggcgtgatctcagctcacagcaacctctgcctcccaggttcaagcaatcctcctgcctcagcctcctgagtagctgggattacaggtgcccgccaccaggcctggctaatttttgtatttttaatagagatggggtttcaccatgttggccagacggtcttgaactcctgacctcaggtcatctgcccgcctcagccttccaaagtgctgggattacaggcatgagccgccacacccggccttgctgccatttttaaataccaaaaccttttgttgcagtctttgtcacaggtgctggcacaaaattcctggtaccttctccctgctctaattcaccaagttctccttcctcttttccaaagactactaacatggaagtcttccttaattagttacaggactatatctgcaactcctgtgatttattcgctcagtgcccgtgtcactgtcacccactggtggggtgtgcttgttgtaaatacccatttaaatgtttacattttcaagtatataaaaccaggattgtaaaataccgttgtatttccagttgtaaatagccgtttagttaagttaggcatttgtttatcacgcgtcctaatctctgtttgtgtcgttactgtctcagagatcatcatcatctgtgtttacatttttatgcatcattctttatgcaagtagttcttattcagtgtttttgatgatgttaagcaaaattctgttgctaccttacctcattaccttcccgggatatattttgcagatataaaccaataatattttctggttctttcttgactagtagcttttggttaactctaaggtttttctgtttgtttttctcacagttgttttctcccacgtgtacaaatgataaaacaaattatctcaggaagaagaaaaaagacatttgatagtatatccagtagttcaacaatagtcaacggagtctggtgtcctcacttctgtcattggctgcttgacctcacttaaccttcctgttagtttctgtttcctcactagaaaatttattactttctagggataccaggagacctggtgttaataaagggcacagtgcagggtgtgtggaagattttagtgtcagttctagcacaagctagctaaatgtgtctcggggtacattaacttctctaggccccaatttcctaggtattcattcttcttctagacaatagacagttgaattaaaaaatcctttctatcgaccaggtgcaatggctcacacctgtaatcccagcagtttgggaggccgaggcaggaggatcacttgagcccgtgagtttgagaccagcctagcaacacagcaagaccctgtctcttaaaaaaaaaaatcctttctattcctagaactctagggtagtgtgaagtaagggttttcacagttacactaggtaagttactacctgtcgggtacttctctaattatgctgtgcttattaacttatcaagtcctcaaatggccctatgaggaacatatcctttatgttctatagatgaggaaactgaagcattggatgttaaacaacttgcccagggccaccgagcttataagggaagaagccgtctgcacaccccaggctccagattccacagcctcaaccaccaaactctcttgtctgtcgtcatatagaaggctgttctgttttctcagtgtagcccccttaaagataagccacagtaaaccacagtgcttttgatattaggcaaattaaacttgagttcaatcgtatgttacactgaatcaaagttatattcgctgtgcattttacgccagtaattctggaaactaaaaagtgccatgccagaaattttctctgatttaatttgcttacaatcattttaaaaatgaggagctgtgatccacgcttttgccccaggttggaatattttagaagtactttcaaatatatatttctgctgctgggatataaaaccataaattcgagcagatagaacaaaagaccaaagaggatgatgtatttactgtttttgagttaaagttacaacagtttacagaatcacagcaaccgagaataggagttctcagagacatactcctcatccacagaagcctcacatgaccaacacaagtttcagtccagtgcaactttttgcaaatgaaaacttaccctggggttgtttggtgactcctagtcacatgtgctttctaaagttctcaaaacaagcatggggtgacagtccagttttatgaaatataattttagttcagaagagatgggattttagaatagttaatcttcattatatttgacataattactctgcaccctgtggatggggtggcttttcaaaacccacttctggtgaggcagaccagggctccaggccagcacccctctggagattggaatgtgaatttccgtgctgggacacagagccagcttcctatttatttagagccattgggcacctaaggagccaaacagaagttgtgatgcaagttttggctgcagagcatgttagggttgcctgacgtgtctaactaaaacatgatctgagagatttctcaaagccctggttgatttaagcaccatagtattcaatagggtttttttttagtccttttaactcagtcctaagtaaacaggaggcggtgcaaacaatgaggaagttccctctgcattccgatggtgaagtggggttggagtctgtaggcaagtgaagagcgtgtgggagagctgtttccttttgctcatggcagcagtctagaacatggtgacagtgaaagtcattggaagccatgggggcccattttctttatgtgaccaaatgtcttgcaaagtcccaggtgtgtgtgtaggtgcatgagtgtgtatgtttgttttctaaacgaagcacacgtgcaaaataatgtaaaagggcagagtgaagtttgtccatgtccctgtatgaaagtgcatgggaagtgcctggggcagaagtgaaagagacacggccccaggtcgtgagagaagacattgaggtgcactcccggcctgctgtgggaacagtgggttagcatgtcaccggtgcactcccaggctgctgtggcaacagtgggttagcatgtcacccggctttaggatttgggggagtttgctcaggctctgaggcaggtaggttaaggctaatttaactcttaatggttggaaggaaagagggaagggccgtttaggaaggtgaaaaggcaggagtgaaggtggcaagaaatgattggcatgcagttttttcctaaatcctcctctggttataaggaatcaactggaaaattgcagtggcaatagctgttaagaaaaaaaataggattcagttgatgaaatattaaacatgcaagtgggctggtcttttaaccaatctttgtagtattaagggattaaaaagttaattcttggtaattagatccccagggagaacttaatttgcatctatacatgataagtgtttactattaataattcaagacaagttttgctttggccggtattgagctgggtctcaggctggtgataacagaggctggatagagagtgataccattagcctaattttgtcatctgcaagcaaaggaatgttaaaatctgttcacttcgtggtttctaaatgacttctagaagtatcatgagtggaagagggcagtgtagtgtagtaacttttgttcttccgcagtccttagaacctgtcaggattattggttatgacactgttcccacagggtggacaacaggggcatttttatcttcttgagacatatgggaaacttaagaaggaaagtaactaggctgtttgccaaagattacacctacctccaaacaaaaactgaggcaggtataattttaactgtgctggaatctctgaagatgttggtgtcttggccaaattcatttggactctttctgcatttcactctttgagatctattgtgtagactctaatttctttgacaggtattgtcacattggtctccacaaaaattattattgaaagccaggcatggtggctcacgcctgtaatcccagcactttgggaggctgaggcgggtggatcacaaggtcaagagatcaagaccatcctggccaacatggtgaaaccctgtctctactaaaaatacgaaaattagctgggcttggtggtgtgcacctgtagtcccagctgcttgggaggctgaggcaggagaatagcttgaacctgggaggtggaggttgcaatgagctgagaacacgccactgcactccagcctggtgacagagttaaactctatccaaaaataaaaataaaaaataaaaaattattattgaaataactacattttttttcttttttttttggagagaaagtcttgctctgttgcccagctgaagtgcagaggtgcaatcatggctcattatagcctcaacctcctgggctcaagtgatcctccctagtagctgagaccacaggtgcacacttggctttttttaaaattttttttggtagagaaggagtttcattatgttgccagactggtctccaattcctaggctcaagtgatctcccacctcagcctcccaaatttctagaattaaagatgtgagccactgcacttgccctaaataactacatttttttgaatgctgcgatgtgcctagctttgtgctaagctctttgaatgtgttacctgattcagtccttgggaaaaccctaggaagaaggggccacctgatttctagatgggaaccctgaggcttagcaagaaaaagagagccggtgtggtagggtcaggactggagcccggtttatactcctactgacaggatggggatgcctgtttcacctcacccttgttaaaaaggacactttagcaatccttttaagtatttgccagcttaagaggtaaaaatgtgatttagcttctggttcttatgcgtccgtcttgggtagcattggacatcttggcatggttattggctgtttgcacttacagttttaggaattgcctcttcacatcctctgccccatttttactggattgttcatacttttaaaaattgatttctgtgtattataaatagtaaccctttgtcatgtgttacaagtcctcttctccctcagtttctttctttcaattttctgctttgtatttttttttttttttttgccaaatagaactttaaatttcttaaattgcaaatctgtgaactttggatgcctttagagtttattatccctttaaaaaaatttttttaagagatggggcctcagtatattgtccaggtggtcttgaactcctggactcaagcagtcctcctgcctcagcctcccaaagtgttggtattacagacatgagctactgtacccggccaagttttattatccttatcttatcctaggagtataatatttttctgtgttttcttattgttctataatttcctttgtaacaggtatctgagattatctttgaaatcttctgtctcttccagggtttaaaattttttagcaaattattatttcatggtttcttaaatttcctttgtttcaatgattaaagcattattgaggaaataagctatattttattaatcacaagtctctgcatacactagaaaaattctagtataattatttggaagacataatgatgtagttttcagagtcctcagattagaagccactgttttaaaagcgtgaggttagaaaaggaattttgcacctattccaggttaatttctacctattccaggttaacagaggtgatcctgtaccaatgggttttggacagagctctcatagtctgtgctgtgggcgattccctcatttagtttgcgaggataccagaattaaaggaaaataatgagaaatgcttatagctcatagatagacgcgaggtcacagacagccagactggagctaggagaccatgctgatgtcacatactgccctatcagaaccctgggaaacccttggtctgtgctacaagagattggcccatgatagccagttataaccaggcagtgggcatctcaggggtttgcataggtctaaccttaaaaagccacatgactgggtgcggtgacacacacttgtaatcccagcactttgggaggccaagacacaaggatcacctgaacctgggagttggagaccagctctggcatcacagtgagacctccatctctattaaaaaaaaattatttttaattagctgggtatggtggtgcatgcctgtagtcccagcaccttgggttgctgaggtaggagcatcacttgggcctgagagttcaaggctgcagtaagccatgattgagccactgcacttcagcttgggtgacagagtgaggtcctgtctcaaagtaaagagtcctgttaggaagccataatgattttaggggggatggtttagatcttgaagaaagaaaaaataatttgaggagtgagcacttgaactatcaaactttctcatctattaggtgcgttaggttccttacatcttattctttttttccttccttttaatatatagctactctccagagagaccggatcttcaaacattttaccaggaagcgccaaagggctatgcgaaggcgagtccaccagatcaatggacacaagttcatggccacgtatctgaggcagcccacctactgctctcactgcagggagtttatctggtaaggggttcccttacttctgtcctcctcagagcttccatctaataggcttcctctggttatgtatgacttcagcagaatgcatgattatttaagaattctttcaggatctgatttttgcctcttactctagtatgttgacccagtaatttaaatctccattgcaaaaacatctaaataatttacagatccaagttttagataccatttctttttaaaatcatcttggtaaagatgctaatgaatcctaaactggtcaacaagcataaatcagagaaaaaggctaataagtcaataaacaatcagtaaattggataatcagcccctaaggaccaaagaataatcaacagtattgctttaagaaggcatgaatcgcataatgacttatggaaattaatggttgcgagaaaactaaacacaaagtagtcttcggcctcttggtatgtaacagaagataatagccttcagtgatcatatactgtaatctaatccctaggaattagtaggaactaagataattcaacattgagaaattctagagatttggggcaatatcttactagacatacaactgaagcttaagtctcagtctcagtggcaaatgtaaaataaatttaagcagtagttatctttagtgataaattaagcatacttatttggaaagggaagaaagaaagatgccctcacacacccatctcagaaggagaaaacacagtttggtagcgtgaaaggagatctatatttttgttgtcaactttaattattttgtttagtgaaggcagaagcccttggatcagagcagtttctgaatgttgatcaattactttgtattttgttttctgtgattattttggattttatatcttcaacagtcagaacctagggctagttagtatttctgacatttttaatcaagaaacaacgattttgagatgctaaaccagctgtagatatgaagccaacaaatgtgtcataacatttattgtatttagggaaaaaattgtattacttttttttgggaaaaaattagcagccctggcgtctttgagttcacgtttcctctttgcatgaggctgcactcgacttagccacagccccacctctctgtggtttgctcacttgtgacctaagggtgcttgcctcttgcagtgtatttcatgtcacacttttctgtttcttttacatgacctgccaggcccctgtaggcattagtggtgatggcccctgacctgaactgacattcataatggaaacttatttgatcatttcactgacttttttccaccagagaaacattaactgtacccaaccagcctttaacgctccccccctccacacccatacactgtcaccctcatactctctctctcacacacacttaaaatattggtgtatatattaatatatatggctaagagtatggactctgacatccagtctcatcaccaactgggtgtgtgacttagtcaagttgcgtagcctgtcaatgtctcttcatttgcaaaatagacacaacaatcttattttacttgtataataaactttcatatagtacttaaagggccaggcactattgtgagcattttatattacaacttttaatcttcattagagccctgtgcagtaggaacggttatcattagtcccttttatggatgaggaaactgtggctcaaagcatcaggtcatctggcttcagagtctgtgctcttaaccatgttattttgtgtgctgcctcccgtggctttttgtgaggattaaatgaaatggtatatatcagctgcttggttcagtgcctggcacatcctatgggcttagttactgtggtctttgttaatgagaatgagaatactcctaatgttaccatcattatcatcacccatagaatatatttgggagaggcaaagatggaagtggtgggcctgaagggcatattgtggcagcaactctgcccacctgtggactccaggggtgatatggacacagggacaagggcaggtcccctgggacaggcagctgcggtagactcatctgtgcacttccacagtgtatctgtgtccgtttacttcagcatctgaacatctttatgtgagagagaataaggtgggaactcttcaggccaaggcttaatcacacgtacagatgaggatttattgccactgaggacttaggaaattgccatggaggtagatggaatgggaatggtttttacccacccatttgtatcatacagcacattctaatccagcacatggttttttctggtgtctcatagtaacaaacaatggctcagaaagcacatgatctttgcttcttccctgaaattgtgtttttcataaaggaggagaggatgaaatttgttttccttaaggactataagagggttattgctgaaatacttgactgatggtagttttcttctcttcaacaggggagtgtttgggaaacagggttatcagtgccaaggtaaggaaacatttttaaaaccatgtttcattttgttcctatgttaaaagaaatgattataccaagagaaaacagggtatcttcccttaatattgtgataaataactctctgtaggtcaaaggaaacccctgtgtagatacaactctttagtttggtgagatcttggccatattttagacaatgtaaaggggacgtttttatttctaaagccaggatacctaataaattttcattgtttaaagtcttgtctctgcagtaacatgagagtactaaaaggtaatgtgattttgtgagcatactcttaaattttgaagataaacttttgttttttacaatcctattgataatagatagggatgaaaagtagcacactgctgttttctctttttccccgtccagggaacataagctattatccaagttgttttttgaaatgttatgatttcaaaaaaaaaaaaaaaaagtgagaaatgttcaaagttaagctgtcagtgatcttgtaagttactacatgttatatttagttttcacaatctaagatgaaaccaatttactagtgtttctagcataattggaaagaaatacaatggcaggaatggaagaagagccctcagtcaggtggtttagccaggcccatcaggcttgcctgtcatttgggttcccccttaacctttgacatgagtatcatcacatagtttatacacatggtacctgtttcactatgtggatgattgataaaatagcaccacatatcctagagcagtagcctatgtgtggataagaaaatctcaccttctcttctggaagatgtgaggtaaaacattacttcccttggatggactgaataagacatactcttggatctaattttgactttactatgtatgaacaattccattgaactttcaaagttaggaaaaaacaaatatataatcaatatgacagcaataattgacctgtatgctgttaatctcagtcccaagtgagaagacagttcacaagccagaatcgctgtcactttgtggcatgggcctgtgagcacaggaatatgccctgcagtccatggtagcccatcttatgcacaccaagataagttgagaagctctggataaacaagattatggttttgagtttaaaacatgggatttaagatacatctctattgttattttatttctttttctctttgtcctatagtgcctggatatttgatggcctgattttcagtgggtcacctgctatgtaaagagcagggaagactattagttaggagacatgcagacaccactttggtgatgtctccctaaggcatataaaaccaaatgcctggttggagagaggtatgccattctaacactgatcaaaagcaaactggcataggtatttcagacagagcagacttcagaaaaaggaaaattatcaggaataaagaggggacaacaataaaggggtcagttttccaagaagacttaacatttttatttgttttgttttatttaaagaccagtgtagtagtacataacaatttttaacatgtatgtatgtacctagcaacaggaatcaaaatacatgggacaaactgatagaatcacaaggaaaaatgaacaaatccacttctatagttggagacttcaatatctcagtaattgatagatccagcaggcagggaatcagtagggatataggtgatctaaacagcattatcacaactaggtgaaattgacgtttatagaatacttcatccaacaacagcagttttcacattcttctcgggctcacaggggacatttaccaacatagaccacattctgggccataaaacataccttaccaaatttaaaagaagagaaaccataaacggtatcttcttagaccacaatggaattaaactagaaatcaattactgtaagatagctggaaaatccccaaatattggaaggttaaatgtcacattctaagtaacacatgggtcaaagaagaagactcaagagaacataaaaaatatttagagtcaagtgaaaatgaaaatataacttataaaaatatgtgtgatccagcaaaagcagtgctcagatgggaatgtatatatcattaaatgcatacagtaggaaagtagaaagatctaaaaccaagattcgaaatttccaccttaggaaactagagaaggaagataaatttaagcctcaagcgagcataagaaaagaaataatacaattagaacagaaatcagtgaagttgaaaataggaaaacaacagagaaaatccatgaaatcaaatgctgattctttgaaaggattaattgataagcctttaccaagctaaccaggaaaaaaccaaatacctcaaaaaataaagtatttctgtgtgaaggatggttttgagatcccctcatataaaaagaccagttctctgggcactttcaatttggttctcctgagaattgaatctgatgaaagctagatttgttttaaggtatgatgctatttactgacatgtcacctctctttatgtagttaatcctaaaaccttccacatgtcttgaaagatcttaagatgatatacatttttatactgcttcattgcatgtgtttatcctttgatgacaagctcaactatctgcagtgtatcacttatctagatgagaatgaaaaaaatgttattccgaaagttctaaatatttcaacagttgattaagccattcagcaaacatttattgaatgcctcctctgttcaaggcatcatgcaaggaattctgagggcattacaaggctgggtggaaggtttgaaatgaaggggcaggctaagggttgtgggagatcagaggagggcaggtggtttcagtctagaagtggggatggggtagagtattttcatggaagagacattttctgagttacatcttgtcctaaacttaagatttggttagttgataggcaaaaaggatatcccagggagagaaaagggcatcgatagtttgttggaagggtccaggaagagcaacccatgtagtttttactggaacaagtagatcccatagaagaaaggtgacaggtagcttggagcagcctctggagggcctggaacctgggtgggaaatttgaactttgttgatcggcagtgaattaccatggaatgttttcgattatgggggcaggactagagtgttagaagagtcctctggtggtgggtgcaggatggaataaagtcaggaaggaagaaataggcccaggacttgataagggatagtttgagcctgagcaaaggtctgtgttaggatggtggcgaaggcaataggaaggatgggcgcaccagctgctgtcaagggggccagacgagtccagtcttgttggcacggtgcagccctggttgactctgctgtaactggctggactgtgagcttctgataaatgtataattgctggatttaatttcctagtgtgcacctgtgtcgtccataaacgctgccatcatctaattgttacagcctgtacttgccaaaacaatattaacaaagtggattcaaaggtaagaggatagcagtttgctgattaaatgtgcgtgtgtattgtgtatgctgtgtaccgccgtctctctccctccctccctcctttcctccccctcttttccttctccccgtccccaaacctctgctttcctccccctgccacctcccttccacattctttgaagccaagggttgtattagaatagaaatgtctctctccctttttttaaattatggcatttatatttctgtatttatgtggcatcatccctcctttgtgaggaccccattagtggttggctgggtataagctatatggattggttctacttatttggagagacttttggcagagtgaaaggagccctgaacttggcatctgacagcctggatttgaatgctgaatccagcctctgttagccatcttctctatgagctgcggcaaggcctacaatctctcttttcctcagtcttaaaacaggatcaatgtttccctcacacagtttttgtaagttaaacaacatagaattgatgtgatacatatgttaataactgtaaattatgtttcctaagtaaaaagattgctggctttctccagcctcttaagaaatttcagggaagatgtctctctctctctctctctctctctctctctctctctctctctctgtgtgtgtgtgtgtgtgtgtgtatgtgtataagcttcaacatcattcttgccactcatattgcattcatctgcaataggcatacattttaaattctagaggtaaaagcagatggagtgttgctgacatttagcagtagatttgcagaggcattggaagaatgactctggaacacaatggttctttatagtacacatataggattgctaaagagtatacctagaggtataaaccacagcttttccaagaaagaggccataaaagtttcaagaggagtaatgattgccctactccttgtcatgcatggatctgttgttatagcatcaaattgtggtatggactgcagagtacatgcctagtggaattatttgctggaaactgagatttaactcagattgtcagattgcaaatgccaggcaaagaaaggctggaagagctgaataagtagttactttaatgtcactttggaataaattccttctgtggttccatggcctctgagtctcttctttttatttttcttcccgtgacacaatgtctggaagaacttacagtgatagcaagtatatatagtgtataaaagacccatttaatcctgaagttaaaaggttctgggaaatagatgggggtgttaggggattggcaaggagagaaatatggcctgaatatgaaagatgaagtgaaaatcttaatttttatttctcaaaatggcaaatgatctaatgtgtttcccacatttctgtcttgtcctgttcattagaaaatgtgtttagtctggttcgtaagacctgagtaattaatcagggctgagtacagtaaaataatatacctagctcaggtgtcatagtgacactttgcatttgatgggctcctattacagtttttacaaaggacattggtatgacattttagctcttgtccctttatttccttttttacagattgcagaacagaggttcgggatcaacatcccacacaagttcagcatccacaactacaaagtgccaacattctgcgatcactgtggctcactgctctggggaataatgcgacaaggacttcagtgtaaaagtgagatgctgaggtgctgggtacccacctcttcatgggaacactatgccctaagctttcagaattctgtggactcagaatctgtcctagaactgatggttttagatatgttgtaaatcaacatcttagtcattttaaacttacatgtttcttgtcaggcatgtaaagagaacttcatctgatgccaacattttctaatcataggacattaagtcaaatggtatattcagtgatctagctcgctagctgacaaatacagcctagacactgtattttaataggtgtttggaagagaaaaagatgggatcttagtcagaaatggaagatggttgagtcaggtgagacactaaaaagaaaaaaataaataaaaatttcaaagaaatggaagttaggaggaggtgaggaggtgagatggccaaatgagaaggttgggttaagagtaagaaatggcagaatagatctgatgatctcaccagaaatcagcaggaatggagttgtcacagcataaaaagagctgccctgggtcttgtgaaagagattggagacaggggtagaatgaaggaagataaagccttgattgtaagcttgcatctcaccagctgtgcccagtggagtgagagtttggagctttggccctagcaaaggctctgagtgggtgagagctgatccctgtcctgttaggagttagggagctgttggccttgtgccatcttgtatggaaatgtaatgatctgactgccgtggggtgcacctgaagcctttcttatcagacacaccccaagtcgccagttgaggagaacaatggtgaggtagaattggcatgagtatagccagacaacttccattgactgcttggacttacagagcctgcttctgtcaacaaaaaggggccagtcacttgtctttaagaagggcacattcttctatctctgtagaacactaataatttttttctcataaaaccaaaacagtagccagctcatggataacttgtagggcgttggtccaggtgcagcttgatcttagcgtgacggtctcacctgggtatgggttcccagtgggaaatccctttctgccttgcattgttgctgatgcgcagagccatgcatggggctcatctgcattgtcctcttccctagtggcctgagggtagcacacctgcagcaatccggctcttgtgatttttgcctttatggtcacttggtggttttgaaaggcttctgtaggctcgtgtgtcttacacctgtcttcctgagaggggtgggtttcccatgaagcttaagtctcagggctcctctctctcaagggcaccttccaaagccctctacttgatttggtgttctttttcttaaagaaggcctcctaaattatgtaaattcaggccccacaaaacctggatctgtgtgtgcttccaagatggactgactccataaaacaggaatgtgttgcttgtcgcttcagtttcacctcccatcagcagggcccatgtcaaaaaactgtctcagaatttattccagctgataacgcctcagatccttcattgtccccaggcagcttccggtgcctcaggagcttagctttctttgctcgcctcttcaactgccatttgtactctgaccttcagaaagttttaaaagttgcctttccccactatgaagcagttagaaccacaggctgcaaatgctgagaaccacaggctcacaggatgcccatctctgtgctgtgaggcctgcccaaccacaacaatactcagaaagaaagctgcagatagaggtttttcttgtagaaacaccatttccatcctgtttgaacagtgatctacatgtggcatttaaactgctaccttttatttcactgttgagagacagaaaaaaatacagttgacatgattctttgttatttaattgcctgtgaattgccgctacgataaaggttttaatcttagatcatactaaggcagcaatgcctgttacatgtgatttagatgaatgggtttcatcaaatcatggtggaaaaaatgtatttgaaatatattattctttagtatgcttgcctttctgcttctgcagaaaacagaaatagataaaatgtcaggaactattactagtgtgagcttaattttatgagaaaatgatactgttcagccggtataattcctctgttataatcttttaggctattaaagttctctgttgcagcacatgttgaattggttcctttctgaacatggattctgttttccttttccctctagtatgtaaaatgaatgtgcatattcgatgtcaagcgaacgtggcccctaactgtggggtaaatgcggtggaacttgccaagaccctggcagggatgggtctccaacccggaaatatttctccaacctcggtgagactttgctttttttccatgtctcgtaatttagaagttgctcagatgtgatgagcccaaatgagagcatgtggcctcatcaaagttcctaatcttagcaaatacaataaacagacttattgcctttctttctttctttctctttctttctttcttttttcttttctttctttctctttctttctttcttcctttctttctttctctctttctcccttttttttctctctctctcctctcctttcctctcctttcctttttccttccttcctcccttccccttccccttccccttccctgtcttcattcctttttgagatggggtcttcctctgtcacccaggctggagtgcagtggcacaattatggttctctgcagactcgactgcctaggctcaagtgatcctcctacctcagtctcccaagtaggtgggactgcaggtgtgcaccactatgtcagggtaattttttatttttttttttgtagagatggagtctcactttgttgcgcaggctggtctcaaactcctgggctcaagcgatcctctcgctttggcctcccaaagtgttgggattgcacaggtgtgagccactgtgtctggctgaaatagcatttttaatagcaatttgtttcacggataagattgtatatacagttatatgacaagaaataatgagcatgagcaacaagtaataaacagaaagcaaaagaaggacttttttcctttctttccttttttttttcttttttcttttttctatttgttttttgagacagagtctcgctttgtcacccagcctggagtgcagtgatattcgctcactgcaacctccacctcccaggttcaagcaattctcctgcctcagcctcccgagcagctggaattacaggtgcccactaccgcgcctggctgatttttgtatttttagtaagacggagtttctccatgttggccaggctggtctcaaacttctgatctcaagtgatctgcccaccttggcttcccaaagtgctggaattacaggcatgagctgccacgcccagcctttcttttctgttttaaaatcagcttcctgtcactgtggtctggtgaaagcctaaaacccaggatcctgggttatgcttttgtctggggaccaggcaggacaggtgaccagtaactatgggcgtcagcgtcctcacctctaaagcggttcaacttgaagatctcagaggctctgcacagccctggagtccagcagttctgaagttttggtttatggattgtgaatttatcattcacattcagcaggagacaggagtctctccctctggactctcaggagtgagtggagttgtgtcagttgcagtgcacatgtttttgtcagcactctccctgaatgacctccacctgctgtcatccagttgagccttggctgcttcccaagcccatgtcttactgttgccttcctggtcagcgtctagagatgggaaatagccatgtaagatctgaacggtgtagcttggtgtccagttcaggaaaattatcgactcaactaattaatctctgggtgctgaggaagggaagtgcaattactgtgagattcttgataatcctgaaaatgtcagcaccaaccacctcatttcctttttactgaaggactcctgcctagtagatcagggactttcattgacaatttttttttttttttgagacggagtctggctctgtcgcccaggctggagtgcagtggcacaatctcagctcactgcaagctccgcctccctggttcacgccattctcctgcctcagccttccgagtagctgggactataggcacccgccaccacgcccagctaattttttgtattttttttttttttagtagagatggggggtttcaacgtgttacccaggatggtctcgatctcctgaccttgtcatcctcccgtctcggcctcccaacgtgctgggattacaggcttgagccaccgcgcctggcctattgacaatttattgaattgccactacgataaatgttttaatccttatattagatcatactaaatcagcaatgactgttacatgtgatttagatgaatgggtttcatcaaatcatggtgaaaaaatgtatttgaaacctattatgtaaaaaaatgtatttgaaatccggtctgtctgtcttgtgggtaggcgggcaggatgccaatattgtgcggggattgctaatgcatgggacagttatccctgaagagcagagattaaagatatcagcctgaactagggcttctgagatacaatgggaataagataagaataggaataaagatcatgcagcacgatctttaggaatggacagtgcacttgtcatttgaatcaagtatccttaatccatgacatccggtgcctggctggatgttagacttttgatctgttgtctagtggtagcttatcttataaatgtctcaaggtgggccagctgcaaaagtcaccttgcctttaggtagcaacatcctcaggtactcagtaggatggaactggaaagccaactgaggcaggcacacttaccttccattcattgtgttgaaactagaactctcatcatgctggtgagagtgtagattggtcagtcttattgtagacggtaagttggctgtgtatcagaagtcttcaaaattagcactttggcccaaggaattccatttgcaggaagttatcttaagaaactgaataatgataatgacaatacagcttaagtttattgaatgtgccaggcaccaatctaagtgctttacatgcatttgttcatttaggcctcctaatgactcatgtggcagatgctttaaccttctctttgtcagaagaggaaactgaggtagggagaggctgggtaggtaacttgctcagggtcttaggttagcttgcagagctgttattgaatccaggcagcttgcttgagagctagacccttaattactctgttttgaagatttgcatgaagtgtattcactccagtgttattcactgtggtgaaaaaggggagatgcctcatccttctaatggcaggggaattaataccttgtgagatatccatgaaatggatattgaatagccgttagaactcatattcttgaaagaaatttaaaggcatgaaaaatacccaggacaaatttttgaatacaaatgtatgttatgaaaccataatttgattatgtttttaaaaattaaccaagtataaaaacgtgtgcgtgtgtgttatttatacatggatatagatatctttggcagagggctggtgagattttaggtatttagatttttattcttcatgcttttgatcattgttctaatattcacattggacttttatttctcctatataatttaaaatattgattaaaaaacgttgcttcattcgtgtcctggtgctgaatgatgcttgaatctctgagtagacatgagaactgctctctgtaaaaagtggacactaggtggcgctcgtggaatgggaccttcccgtggaaagccaccgcagaaggcacccaagggaccacacaaggcattggtgtttccatgcacttccacttgagcgctaactgtaactccatggcttagacgtatttttaattgaccttttacacaaagcagtaagcacagattcagaagctgatactgagggagtttcgagtggcagaaccgatcatctgtcaaactgagttgatctttcccccacgttatactgggggtgagactgctcccagccaataaggtcttcttcgtgcatgggtgctccatgcttctgctgcaatttctgacttaatgtgttcttactctttcagaaactcgtttccagatcgaccctaagacgacagggaaaggagagcagcaaagaaggaaatgggattggggttaattcttccaaccgacttggtatcgacaactttgagttcatccgagtgttggggaaggggagttttgggaaggtgagtcttggctttaactgtttgggttgaagtaagtgtgctctgtgtatggggggtgtgtgtgtgtgtgcacgcatgcgcacatactcacatttctcatgtgccattctttcttcctgttgtgtgcacacaccctaagacccccaagaggactccctcatgctccctccttttgctttgccataggtgatgcttgcaagagtaaaagaaacaggagacctctatgctgtgaaggtgctgaagaaggacgtgattctgcaggatgatgatgtggaatgcaccatgaccgagaaaaggatcctgtctctggcccgcaatcaccccttcctcactcagttgttctgctgctttcagacccccgtaagtatgaatcacattcactgcaccaacagcctcttttcttacagagctgagacagtaagatactggagatttcataaagttgagtatcagaaattttgggggatgggctcccaaggcagggtcatatggaggtattggtgacttctgccaacctctggaggaaaaatggaagcttatgaattcaccccttccccttgtgctgtcctggggaaggagcaccgtgagggttgtgtgtcccaggattgaaaaggtcatcatacataaatcttctgtaggtgaagtgaaggtgaatgaaagttacagcagtctaagaacagagaaaatgccatgggctcattgtcttgatgaatttggctgtgactctgctcctaaatgctgggctggttctgacctgggcacaggagtttagaagaggggtctgagaggacccagagaggtaccttgatttggaacatcccagggcattgcttctggccttagcaacgaccctttgcctgaaaccatggactggtcttaagaattgaatctgtctgccctgtaatggcgtgcgtttaggaatgcttctggctgcagttaatggaacacttgaccagcggtggattaaacaataaatagaaaggatgagtttggttcattagtacaaactttttacttgttgtttcacataatgagaagtctggtggtaacagtgctacggttggatttgttgctcagtgacattggacatgtctttcccttggggtcccaaggtatttgctgcagccctagatgccacaccttggcatgatagcatccaaagcagaaagcataagggcaggggctgaagggcttcatggccagtccccttttctcagggagggaagatctttcctagacttgggtcaactgccctgtatgtctgttctcacattgctacaaagaactacctgagacggggtaatttatgaagaaaaaatgtttaattgactcacagttccacaggccgtacaggaggcatggctggggaggcctcaagaaacttacagtcatagcggaagggtgaaggagaagcaagcagggtttcacgtgacagcaggagagagagagagtgaagggggaaaagctacacactttcaaacagccagatctcatgagagctcactatcatgagaagatcaaggggggaaatctgcctcatgatccaatcacctcccaccaggcccttccccaacattagagattccaattcaacatgagatctgggtggggacacacagccaaaccatatcatgcccttagcaagggaggctggaagagcaaatatcaggccaagataagctggcagaccatgattggttcacaccaaccttgattcagcccctggagcagggcattctgcttttatttagaatcaggctcaaaattgggcttttggtatcaatgaagagggaaaatggccctggagaaggcaccaagagggagggtctgccacagatgtgtcagaatcttgctgtcaaaaggcattctgggagagtgaattctgggcatgttcctggcctgtgccaccatcaaggaagtaggggattccacgagagcgggataggggcatctgactggtcagggaggctggcaatacacctctagggaaggtaaagccatgctgggaccaaacgagtgaattagaattagttaggcagagaatgaaggtgaatatgtcatacagggtcaacagcacactatgggtctgctggtgagacagagcatcaggtgtgaaggaggctcagcacacacagcatatcgaggttgaacaggggccttgagaactgaggcagccgaggtgggccagggccaggccatgaagagccttgtaggctgtgttaaggggtttgggtttagtcctgagagcaatggaaagtcatggaagaagtggaagcagaggaatgacgtatcaggttgtatgttttaattatgaaaatctaatttcttgcgataggtaatataagtatcctccaaatattcatatcctttctccgaaagaaacaagtattgctcgttttatttatagcctttgagagaattttctgtacataaaagcatatatatacagcacatatatgcatacatgtttatcttttaaaaacacaaataatagtatactttgcccatgattctgtatttttaaaatttaattaatctattttttgagacagggtctcactttgtcaccaggctggagtgcagtgacggttatggctcactgcagcctcaagctcccaggctaaagctatcctcccacctcagccccctgagaaactgggacttacaggcacatgccaccacacctggctaatttttgttatttttttgtagagatggggttttgccatgtttcccaggctggtctcaaactcctgggctaaagcaatccacccacctcagtcactcaaagttctgggattacaggcgtgagccactgtacctggccactttatttttttaagacataatattaatagtatatattggaaattgttttgtatttctatataccaagctgcctcatttttaatggctgcatagtactccattttagaacatgacataattaatttaacttttcctcctctgttgctatgtattgtgttcctagtcttttatttcagtcattgttgcagtgagtccccttgtacttttgtctttgtgtgcttatgctggtgtttctgtatgacacattattagtagtagtattgcttggtcaaagggtatatgcatttcacattttgattgagttcaattgccccctcccccattgtggttaaagatagtgaacgttttattgtccatgtaccacacattgttctaagtgctttatgtctgttatttaatccttatagtaaccctctgaaataagttctgttattatcaccccatttcacagaggagaaaagttaggtacaaagaagcttagttcctaagtggcagagagcgtttgaagccaggtggtctgacggcagagtccaggcaggctcttcctatttgctgggctgcgtctctaaattcacactcccaaagcttgagtgagaaggtgcatttccccgccttcccatcatggcatgctctctgtcatttggatcatctcagagttagaaaaatggtatatttgaagttccaacttgcattcctctaactgtgagtgaagctgggcgttttcatacatttcagggtcactagtattcaaatctgtgttgggagggccacatgcagcctggagaatgggtggagcagagaagtctgggagcttggtgacaggacgcactgaaggagatacatggcttggactcccacgccaccccagcgttatcaagagaaaaaaaaatggggaggcagctaatggcttcgtgggcctcggctcccctgcgcgcctctcccttcccctctgctcctcattggtcctcagtggctcttgatggccctggagcccatgctgctcctgcccccatcctctgctttccctctgctggattggtccttggttcccctggagctccagttctccctgccccacactgctccctggagtagccttgaaacgacttccttggctgggcactttgccaacgtaaagcccctcccctgccctcacccccttgttgggctcttttcttggaatagaggagtggagttacagcttgaggcttgagagggatagctggtagctgatactggttgcccgccggggtttcaagcgccagcctcctgaacaccaccatgaacaccatgagtcaagccgcagagccaggtgacctctcagatcttcttcctagggcctgagccaaacatcacatggtttcctatgacatgaggttagatcatcttcaccaggtggtaacctttgagtcaagcagtcaactgatatttagtgagcttacctggtcttgcagcagcaatggttccaagttactactgctgaagcaaagaaagaagtatctcatacctaacaggggaatttgatctgtaaaaggaaattctggtgattataagcaaagatctcatcaacagatcatgttatggtagagtaaaatgaggaagtaacctggaacagattgggaacccaatcaatatagcatatgcaatcaaaatgttccaggaaaatgtataaattctacagtataccaaaattttagcggccacatgagattcccagtgtttagtgggtgaagcctttactagcattgaagtctatttttcctagtggaagttttatgtttgaccacaaggtggcagtcattaccgcaaagttacttttatttctccaccagagaaaccaaaggcatggaactgccattgcggtttaagatgtgtgtgttgtagtagatgtctccaaagcaaaggataaagggaatgtacccctgctttaggctaaatgataaagaagtagtgggaacccacttcaaagaagcaagtgaggctgggcgcaggcagcactttgggaggccgaggtggggcaatcacttgagcctaagtgtttgagaccagcctggccaacgtggtgaaaccccgtctactaaaaatacaaaaagtagcttggtgtggtggtgcatgcctgcaattccacctactccagaggctgagacaggaggatcgctggaacccgggaggcagaggttgcagtgagccaagatcgtgccattgcactccaacctgggtgacagagcacgactttttctcaaaaaagaaaagaaaaaaaagcagcaaaggagattttctaatgctgagatagaggtatacaattttagttttgctgtcgttgttgccttctttgaggtttgcaaggtatcggactccacagtacacatagcatttgctcgctgtgcattcgtctgttggaagtccttatttactgttgtaaaactatccccatttactgttggaaaactaactataaagaacagaaagtgttacttgctatgagaagttacagcagaaagatgcttactttttagctgcccagtgttgcaggccctggcttctcaagtaagatgctaatcagtgtgtaatgctgaactgtgacagtctcccctggagaatttaggagtgagagggggtgttggagccactctacctgcaaagcatttcattgtgagggcctttgtaaaaacagcactctcctcatgcagccctgtggaatcagtctctctgaagcccagagcagggcagtaactagccgaggatcccttagattgtaagtggcagagacaaagttcaagtttaggtcaggctgactctgactccatatgttgtcttattccgcatttagttggttgattcagcctcggcttaagcacctcctatctgtcttggctcccctccaacctgacaatatggaaatggcattgcccttgggaacagaaaacctgaactgtgttttagctttgttttccaccatctaaatggcttgagtctgtcctaaaattcctttgacccttaaagttcttatcattaaaatgaaaacaggatcgctgtgagggtcaaatgagagaatgcagaatattttgtacagtgcgaagtgctgttcaaaagtgagtcagttcaactgtggtgatgaccccctccatcctcacaccaaaggaaaaatgtcccagggcttcccaatggccagcccagacacccacatggaggggacagcaaacattgagaaggtaagtattttataggtccttttgttcttggcaaaaaggaaatagtaagcaaatttcaaatatttgataatttatcaagattgctacaaaggtttatgaacccatagattatttcccctttttttttataatcatatacactgcttacaagtatataaatgggcatccttatctgtttctgatagcactgcaaatcctaatagtttgtgactaatttgataacctgtactaaaactcacaaaatgtatactcctggatctgtttttctgataatctggactacaaaaataatataaagaataaaatgttattcataaagatgtttaattttcagtgctttgtttatatatatttttttggtcaacatctctctaatcctccagcctctggtaaccactattctattctgtttctatgagtttggctttatttgattacacatatcagtgagattaagctgcatttgtctttctgtgactggcttatttcaaataatacaatgtcctccaggttgatccatgttgcaaatgacaggatgtctttctttttaaaagctgaacagtattctattgtgtatatattccgttgtttctttgtccattcatccactggtgaacacttaggttgattccatatcttggctattgtgagtaatgctgcagtgaacatgagagtgcaggcatcttttcgacatgctgatttcattttctttggatgtatatccagtattggaattgctggagcatatggtagttctattttaattttttgaggagcctccataccgttttccaaatgagtatactaatttacattcccaccaacagtgtacaagggttcccttttctccacatcctcttcaacacctgttatttttcatcttttcaataatagctgttctgacaggtatgacataatatctcattgtggttttaatctgcatatccccaatgattagtgatattgagcattttttctatacctgttggccatttgtgtgtgtggttttgttttgtttttttttttacttttcatttatttttactttaagttctgggatacatgtgctgaacttgcaggtttgttacataggtgtacatgtgccatggtggtctgctgcacctatcaactggtcatccaggttttaagccccgaatgcattaggtatttgtcctaatgctctccttgcccttgccctcccacccaacaggctctggcatgtgatgttcccctccctgtgttctcattgttcaacttatgagtgagaacatgtggtgtttgattttctgttcctgtgttagtttgctgagaatgatggtttccagcttcatccatgtccctgcaaaggacatgagctcattcttttttatggctgcatagtattccatggtgtatatgtgctacattttctttatccagtctgtcattgatgggcatttgtgttggttccaagtctttggtattgtaaatagtgctgcaataaacatacatgtgcatgtgtctttatagtagaatgatttattaatcctttgggtatatacccagtaatgggattgctgggtcaaatggtatttctggttctagatccttgaggagtcgccacatggttttccacaatggttgaactaatttacattcccaccacctgttggccatttgtatgtcttcttttgagaaatgtctattcaggtccattaaccattttaaaattgggttgtttcttactattaagttgtttgagtttcctctgtatttggatattaactccttatccagatatgtgttttacaaatattttctcccattccacaggttgtctcttcactctgttgattgcagaaactttgcagaagctttttagtttgatatagttccatttgtctatttttgcttttgttgcctgtgcttttacggtcatattttaaaaagccattgcctatgcctgtgtcacagatttcttcccctaagtcatcatttggtaattttacagttttaggtcttacatttaagtctttagtccatttttcagtgatttttttatgtgacgtgagatgagggtctgtttttattcttctgcatgtagatatccagttttttcaacaccatttattgaagggacagtcctttctttgttgtgtgtccttgggatctttgttgataattaattgattgtaaaggtgtggatttatttctgagctctgtattctgtcccattggtctatatatctgtttttatgccagtaccataatgttttgattactgtagctttgtagtagattttgaaatcaggtagtataatgcctccagctttgttctttttggtcaagattgctttgatgtcgtgcattatttatagtaggaaaatattagaaacaacttcagcatttagcaatgggggtacacttcaataatatactatttgatgagaattttcagccagtcaagagataattttatgttacgtagttaaattgtcaggtaccgtcgtaagcacctaacatgtattgtttattgcacgtgattcctataacagccttataagataggtgcaattattatcctcattatgtcaaatggaaaagtgagacactgagcagttaagtcatttgcctaaaatctatcacagaaaatggtaaaaataggaggttagaatccaggaaataatacagaggttatgatgatgaacagtctgtatccaagtcaggttctgcccaagatagtgaattggcagacccgttcccctccccagcctcaaaaaagactgccaggaaattatgccagtaagctatcagggactggattaaggtagtggaattatgaaggatttttttcctatttaccaaatttggtaataggattacatttcttcaacaatgggggtaggaggaataagccattattaagtcagggaccagacccctggtctctcagaacctgggatacggcctagtacatgctgtctccctgactcatttatggcgaaattcacatcacactccttttatctgaatcagtgagggttgtgtcagcagctgagtccctggcatggatgtgctggaatccaggcctcccatcccccatccccggctcgcaggggcctccccttcggttctcctcctggagagagaggaacaaagactagggggtgagggatggaggggggctatcacaggaagggggagcagcaaagtaaatattggtctgaggctttgttcggagacccagtttatggaagcaaaggtttccatttggaaaacagaagacacttgtggccagtgcccgaaacagcctctcactagcaggccctgggactgggtgagagggctgagcgaagtactcctcattgttttgggaatgccttaagtttgagtttaggatccaccgctttcaggtgggccacaggacgctccgatgccggtcgcttttgcctcctcccgctcctctgcctgctggggcgtctttacgatgtcagcctgcaaggatggagttcctggcaggaccatagctttccgtaagaaaccacttctcaaatggccaacaaagttgaaatcctggtttttgaaggtcagaatatcttggaatcttgtgaaataaatgccatcgctgcatacatgctggcacaaaatgatctcacgtgtgctcagtgtacctgcagcttgagtgcaaaggaacattctttcctttgtattactttctccattgttgttgtattaaatattagcgaagaagtgggagaggcagagagcagccaggcagcaaggtagtcatgtggccctggaattcatctttcagaattttcccaggcagggaactgcactgtgaccttcagcacaagagctctgagttctaattctggcttagctggcccacttgtctttaagaagttcccctgccttttattttgagataagcctctccacctaaatgtgtgttccttacttctggacctgttggccaacgtacctttagggagtgcccctccagctggcttcaacatgtggggtcgtagcggggctgcagcctgccctgtccagctctgatgcttcccagcgcctccagctcccctttcccttcctgaggcctcactgagcatttggctgagcccctgccagccgctggatgtggggaggagaaggcatgctcagaccctacagtggcattactgcttgtgctctgtgttgctgtgacacccagcgcaaggggaagaggccctgtgacagagggttagacaaggagaaggggaagtatagccgaaaggctgggagactttcccctttacaggcatgggaattctgaagaagcctctgttcatgccttggggtagttggttgattcctggggactgaatggtgcccactttgcaggaggggatgagcgaagaaggaaagggcagttcatgagaccctagcatatgtcctaggtgctcatattcattaccaatgtctatgaaactaaactgcacattggcattccgtaaatatccattgaacaaaatatctcatttaatacccaaagcatccagggaagagtatcatcctcattttaaaggcctagaaactgagatccagagaaattaaacaacttgccccagatcacacagtaagccagagtcagtgcatggattcctgacctgactgtcctgccaaataatatacaagccatttccattatatcacaaatagaagttttgagtctctaatatgtacaactgagaatactgtcattagacgggaatagaggcagttttccacaataggtggtttttggccttttgggaaatacctaaggatatttcctctgatctgtttggaaccaggtttccccctttccctgagcagtggctgctacaaatacaatctggtttgctgcgggtcatttgttgcagtttgcctttggctcagatcaaaatagaaaatgagccagaacatggtgtttcctgtctctgcatgttcctaccttattcatagtgttccatcttttttttaggttattaattgtggatttatttccatagtaagacaggatctgactttggggccaacatatgttggacccgcctccttctctgctgaagattctctgaagacaaaatgtgcataggccttctccaggatctggatttttgggggattatttgggacctttgcttctgtcctctccggctaccaggctttctgaccttctgtagctaaatagggccacaaaaatgaataggaataagagaacctgaagttcaagctgtgtctttggctctgtctctttggacgcgactgccaagatatttggtgtgacaaaaggatttgaaatagttggcctgtttttttcagtttgaggttgttctgttgtaactggtcttgtttttggtagccatcattatcactgacaacctagagactgagtagaccgccacctccatgtctgctaagatagtataatttaaatctttgatgtaaccagaacacaacccaggtcacactttgcccctgtgtctcatgatgactgaaagcttttggggtgatgattgcttggttatggttttcctggacccaacttggaacccttaaagcctgccaagttatagatactctggcttcagtagggccctgtattgaaacaccaagtgccaggactgctcaaaaggtgaaaatgagatgggtgttctgccaggtggtttagtgaaaaatcagtcaatccaggatcccactgactgaatgctaggcaaaagaaacagttcttttatttgttttcattttttgcagagttggaggtcttgctatgttgcccacactggtcttgaactcctgacctcaagcaatcctactgccttggcctcccaaagtattaggattacaggcatgagccaccgtgcctggctagaaacagttttttaaaaactcattctaattaggaagagaagaccaatacacatggaagaaaagtgtacagtagatagcatgtagtaaatatagtccttatgctacaaaaggaaaggtagttgaaaatgaacattgggttctaggggaaactcttaagtatgtgccagtctgtgctcagaagtacaacctgattggctgtgagactaaagccaactgattgctttaagcagcccctcgggtgtgggctgcagatggttccctaggaagctgggttgagtcctgctgtgatgagctgggactgccaggtaggacctgaagcggctgccaaggggctgccaccccaccctgaagacaaaatcatacagtctaaaaacctgactgctttggatcaaaatcataccctgtaatatgttctagtttttaaataacttgggttttccttaattacttaatctctgctgagaacccagctgcatccatctcttctaggtccggaattatccacagcatctcatgagcagaaacagccatgtcaacataaagttagcagactcgtcgtgtagagagttgtgcactggcaggttaggggggaaggtgttcattcattcagcagatatgcactgagtgcttgcaaggcatagggctcgccttcaagccttgaggacgcagcagtgagcaaaacagaaaagagtccctgccctcatgaaactgacattctttgggaagcttataagcctgaagctcatgaacagattgttcatcttatagtctcagctggtgaccctccatggcagctgctccctgtggcaattcctggattttcctttcagacaggctcagagccgtcatctgcttgaagagtctggggggcttgtctgaagctgcatttgcatatcaagtgctccgttatattttttgtaggatgcagtgagattactggggggaggcgtagctcgagtccttggtccttggtactgtctctggttagtggtgggttctgggtcactattataggggttgggaggtttaaagcaagaggcagaatggcaagagtagcagccccagtaggctgcatttgctcccgttgccacttgcacgatctttctcatcccgctggcaagactagtctgttcactggcagcccctgcatcaggctgtgaggacgccctgtctacctcccgtctccatccctgtattaacccatgtgctatcaagagcgactgactctttctttacaaggttctttttccttccttccccgtaagctaatagtttggctcaggctcgccagcagaccctccccttttttgctggagggctttggcatgccctgtcttttctttggggccacccagggagttcctgtttcctttctgtgggaggcttccaattcttagttatagcaaaagagcctgtattttttagctcactcctgcccacttctggtcttgaatgacttatggcttaggtgttacaaatgggagtcctggaactcttcccagaatctcttaattccattcttgtggtatatgacgttctaaacattaaaatgatgtaatatataactcccaaccaaaacaaaagaggagatccctgctagccaaattcttccctcctctccatacacgtttttccgtcgctgtgcagtgaatcctgggatgtgtttgtcagtcagcttccttgttcttctggctcctcactccccagggaccaccgagccacagactccacggttttctctgagggcatgcgaagtggaaactaacctatccctgcagccagcccagaccttctacaatcatatctaccagtggtgaaaggcagttcaagatgagttggacacaatcaagaaaaatagggaacaaatatgtcatagctcctctctgtctgctgtctatagaaggaggctaatagcagcagatctggtgagggccagtggcccatggacctgcctgccccaaggcagcaatcatgggagtggggtcaaggaaacactaaggaggtacacctgataggactttttaaagaggagtggccagggttctggccggtttgaagcctggagagaatggaatggcatgagttcagttttggggacattcagtggtaagactggtttctgttttctcttctggaagctcatagatacaggatctgctcattcacttgatttgtgcctcttatttgggcttcaggacacatctctggccaatcgcaattaaaacaccatgcccagttagccatcatcgccactcagagctgtctgctttaccgggctaaaaaaaatgatctttatcaccagttgtaagtgacttaaaaaaaaaaagtacccttccacattgctcagaactttgccgtcaccttcttgaccctcaccaacaggtcaggttgttttaataatctagtggctggtaagctttcatcctttacaattaaaaaaaaaatcactgatttgcataatgcagtgccatttgcctactttgttgggggtgggggctgtcctgttcattgtggatgtttagcagcatcccaaaataccagcagcacctctccagttataacaaccaaacatatcgccagacattggttcccaggggggaagaatctcccctggctcccttacatgactgtcaggtgattgtctttggtatgaaaagtcaaatgggttagacgatcacttttctttttatagaagccaaagccaaatgtgtcagaccttctttatgaaaatataagcgttattttttttctgagtttgtagaaaggcaaagttcctgttgggggctcattacagctgttggtgcctgcactgacagtggcattgttagggatggagcccctgagctcgggggagacagcggaagcgtgcagcgtctgtttaatgtgagtgagggctggcatgctgctggcagctctcaacagtgaagcctgctgctcgataaggcattattatcagagcctgggggcatccagggagcaaaagattagctgactgagcatatatctaaaatgggttatttttaaaaagcaagcagtacaaatactgcagcttgtcttgttttagcatttaataattacactttcactttaccagcaaggcattgagtcagtggcattttatgaaaagcatcctcccaaacctgaactttgtgagtcagattcccatcctgtgtgtggtacatgtggttggattgtacaaacagataatcagagttttgcaaaatgtttcccaaccagcatgggaaaacgtgctgatagcaatatgattgggctttgagggagagccacttgctggctttttttcttttgtttcccatacatggaaatgccatttcaacttgaaatgtggataccttaccagaggattgcttgagcccgggaggttgaggctgcattagcgaactgggactgcaccactgcattccagcctggatgacaaagtgagactcctgtctcaattttttaaaaacccacacacaaaaaaaacaacaaaacaaaaagtagaaccttaaatgctatcttaaggctgaatagtctctaaatattgaaagtagaccctagccaaaagagacattacctgtttctgtaatataatgaatggtattagtgtacttatcttgcattttaaattcaattctgtaaatgtttatggagcatgcattatgtgccagggatgaagacacaagaacaaaatgtggacctgccttttaattgcttacagtcaaaggtcatgataacaccatgtgatggagagaagaaagtcatgattgatcctcgtggaggttggaaggacttcccagaggaggggctgtgtgagctgtgttttgaagatgaatagggatcttatagtcacaagaggagggcatagactcccagacagaggtaacagcagtgcaaaggcacagaggcttaaaattgcaggatgtgcccaggaaaccccaaatgactagatgaggcagatttgtaagaagggaaatggtggtggttggcggcgggggtaggggggtggtgatgaagaagcaaagtcataatgggtctgatgtcctttgctgaggagcttagactaaactgtttaggtaaaaggagccagcaaaatctttaagtgagggagtaacataagatttgcatgttagaaggctctctctggctgctatgtacagagggaggctaatggcagcagatctggtgaggatgctgggcccgtgatctgggaacttgcctgccccaaggcagcaatcatgggagtggagtcaaggaaacactaaagaagtagacatgataggactttttaagtgggaatggccagggctctggccatttggaagcctaaagagaatggaatagcatgagttcggtttgggggaaattcagtggtaagatgcttgtttgtcagaaacacacttgagatgggagatcagtttggtgtcatccatgtcctcttggtaagtggaaactataatataaaatctttcaggccaggtgcagtggctcacacctgtaatcccagcactttgggaggccaaggtgagtggatcacctgaggtcaggagttcgagaccagcctggccaacatggcaaaaccctgtctctactaaaaatacaaaaattagccgggcatggtggcacgcacctgtaatcccagctactcaggaggttgaggcagggagaatcgcttgcacccgggaggcaaaggttgcagtgaaccaagatcacgccattgcactccagcctgggcaacagagcgagactctgtcttaaaaaaaaaaaaaatcaaaaatcttttagtagatgtttatagagagagaagagaggagacttgaagaaggaattctaagtaagggttaaggttgagtggaaaaaagaagaagaatcagaaggaagtggtttcatagtaggataaatcaagtgctgagatgaagtcagttcactaacagactcagagttctattggatacggcatgaggttcttggtgtcaccatcttaggatctgctcatttttggggttttaagaacctgtctgaactccacttagccaactgaagcttgccttcaaagttaacacaatgtgctttctcccatataaaccttttaagctgtttctgatgactgttccccttcctgttagagctccacctcttttaatttagcctccatacctttagagtaaggtctgcaactttcttccttaattgacagtggagatcaatatgtaacccagattgcaaaaatggtttgggaacactgcatgttctcactcataggtgggagttgaacacatggacacagggtgggaaacatcacacactggggcctggcaggggatggggggctgggggagggatagcattaggagaaatacctaatgtaaatgacgagttgatgggtacagcaaaccaacatggcacatatatacctatgtaacaaacctgcacgttgtgcacatgtaccctagaacttaaagtataattttaaaaaaattttttaatagtttgggaagaaattgtgggcatgtcatttgcttgaacagattttgttccccagccagaggaccagagaagagtttgtcatggctacagtggaggaatcaaactcagaatagcatgtgaaaggcacattccacacagaaacttcggcccgtgcatcagcactgcagacagggggagaggaaatgaattctcagccagtagattcccaggcatcaccttgaggcagatatggcatattcttggccatagtctctacttctctaactgggcaaagtgtctaatcaactataacccaaaatatcttcccacatggcataagtgtcgaattcatacatagatcagagggagaaatgaaattgtggttgtcttaaaagtttacacagtttagggatctccatcatgaaaaatgatctaaataaatgaaatggtatttttactctttatcctacaagccctatacaaactaagtccataaatatcctatttgatgcttaaaccaaaagctttataaagagaatttcactatgtgaaataatgacttgaagaaatcctattgtggatgcttttgttaagttgctaaaccttttttaaaaagtagataatcatccaagatatcttctttgtgactcttaagttttagtgtatttcaaatgtggatagtttttgactaggaggtttgttcaaacgttcttctcgaccactagggggtgctctaaaggttagtgatgtctaaatgattgaccaatcaattaaaacaccgtgcccagttagcaatcatctccactgagagatgcctgctttaccaggctaaaaaaatgatctttatcatggcatagagactataaaagctgtgtccttttattttcattaacctaattagaagtcaagctaattgtaggacttcatagaactggcatcgggaatagcatgcaactgttaaaaaaatcatggtcttgatgactaattatatcaggaaataatatgcaatataaatgaaaagagaagtgtatgttttttactttttcctttctgtttttaaaacatgctataaaatgttaagtataattaggacacaaaggaaaaattaaatctagttaacattaccttgaaaacttcttatttgccctgaaatctccagttctttggaagctaaaagcttgagacttctatatctggttgtcaggattagggtgattttatttgaattttctttattttcttctcaattttctatctatttactttgtaattacatttgaactatggatatgtaattagttttataaatagaaaaatcaaagctttataaaggaaaatatagcatcagcagacctgattgtcctacttaactcttccacaaactgttttaactatgggcaaggtacttcacttctttgccctttgcttctgtaaaatggttgggtgaaacgaatcttggcagtttgttccagctcttctaaagttccattttaaattttaccaggagacaaaaatggttcctattatgttcactcttgaagcatttattaaccctcacaattggccaggcactgtgcttggtgctattaaagatatctcacttagtatctgggctctgccttcaagggtttccggtcccccatggaaaagaagaccaagtgcacagatccatcccagccctacacaatgatactggaaagctgtatgtggaccagaaatgccaaaggaggttccatcaggaagaggggacttgtgctctgactctgctgtacccctgatcatatgttaccacttatttatgctttaaagaacatcctggcctggatgtttcacagtgtgttaaactgcaaggtagatttcctctttgtttccctggtctactgtatatatgccagtaagccttgtcaggtttcattatgagagatggctataatgcatccagattactaggaaaacacttggtctttgaaaagagctgtgtgtccctctaggtttgaaatgcaaagtcctaaggctttgttatattcaggacatatttcaccttcccaaagactagtctcagctcagacaggatgtatcttgcctgtgggcttgacacaggggttgctgggtgattgaattaacctctgacatcttctgggctgtgcaaaatgataagttcaaaaaaaaaatgcagccattagactccttctcattgtttcttccttgaagcctttgtaatctttcttaatgtggttaaattcaagttatttccagttcagacatggtgcaatcagatttcctcatgcgggtgcttttccactgtgacctctttgacgtcagtaactgtttcctgtttatttgaactccctgctcaccctgtagatgactttgtctgagaaaaataataaagcaacggtacttaggagaagttcaacactgctatctgttacggagatttccttctcctttcccccagccgtcaatagcactctgcagcttttcatacagcatgagcttgttattcatgtagaaatactccaaggcagttcttagaacttgggtaagtaagaatagatgtggctcccagcttaacattgccttaaagcaatagctacatttttcataacttttacgtgttatgtctatctttgaattatttccaaaaggtaatctgcatcctcactataattctgagtatggtggctatttcctactgccttggtttctggaatgatacatcttcaaatgcagtctttaaatcatagagacaacagattttttctttaaatggagacaaatctttgcaatctggttctgagattgaatcaactttatagaaaggaagaataactgctataaaaagtctcgcttacagtaatatgtttttagtacataaggagggcatttgttttgcaataataattattataaagcccctaaaatagaaaatatgaattaccagtcagtgttagaaaacttatcagaactgaaacctttgttagtatgttttggttatcaaatctagttttgtaaccccttgcttagcaagcatttcccagaaagaaaagtccttacccggtcaaggccattaccatatagcatcgggaaacatccctgtgtcccaacagctgggctaggactccttccacctccttcgaccctctatacccttgtcccacactgagggttgggggagctgctgcagttgctgtttcggctgctgtttcattcctgtccacttgtgagtgtgtgtgtacctccgccagtcttggaggtctgtgaaggaggcctcgagacccagtgcatgcagctcactgccacgtgtgccacagccacagccaaggggccttcctatgcctcatgcatcaggccctttggagccctgggagcagacggccatggcggctgaagctgcagtggatgcactcatgatgatgaggataataatagttgctaacatttcttgagcatttcacttatggtatgccagacactattcaaagcccttagcttaaatcatttaatcctcacaaacctgtgagttgggttgtcttattatccccattttgcagaagtgagttttgtgagagagaagctaaatacagcacagcaggagttgctcttggacctcaagcatcctggcccagagcccaggtgtcgccactgccctgggcttcctcttagtcataccagggacttgggcactgggcacaaaatctcctctttatataatgtagtggtaccaatagcttctattgattgagattcttttctgggcttggcactgtatgaggcacttggcttctggtttaatctttacatgatcactgtagttatagatgttattatcccagatttataaataaataaggaaacttcttaccccttaaaaatgggtgtgtgtgccatgcatggttgctcacgcctgtaatcccagcactttgggaggccgaggtaggattgcttgagcctaggagttcaagaccagcctgtgcaacacaaagatacccagtctatacaaaaaattagccagatgtggtggcacaaacctgtggtcccagccgcacaggaggctgaggttggaaggatcacttaagcccagaagttcagcgctgcagtgagccatgatcctgccactgccctccagcctgggtgacagagcaagaccctgtctcaaaaagaaaaacaaaaattgtgtgtattttagctgaaattctcctggtagcagaaaatttacttcaggtagtaagaaaactttcttaaggctatgcaaaaaaaagaactaaaaataaagattcagaggtacaacggatgtctcatgcaacccaagggcaggagttggccagctctctcggctgatctgaaaccagaaagacatgaggaaccctggcagttttgctcttggctcactcaccctccctgatctcttgtctctgcctcactctatgtttctgcttcattcttctccttcacccacccacctgtccatccacccacccagtctttctccactctcttatacccaggcatttcccacgtttacactgcaaaagcagtttccgtttcctaactcatgtttcctcagttcctgcacacagcctagactaaattaaaagctttttacctcagtttcagttttctggaaaagagactctgagcaggtgcagcttgatctaactggctgtgcacagatgctgagcgtttacccatgcggccaggctggagcatgggtaaatgctgaggaagggatcaccatgagctgagcagatgcctccaaagatgtttgccccagtgaccttacaggatcttgccctgcctggtccatgctcgctctccagtcactttccttagttagtatcatcttgtcactggtaccatcctggcatagcactttcatccacccggatgttatgtctcttgttcatacaaattgcccatcagctttaactcctatcgaacagcccttaatgagggggccttagggaatgcaccttacttatactgacagccattattcgggggatatttttagccccttgggcctggggaaggaatagttctgaactgatagccagggcagagagtggacccagactgcagcaggtcagtggcatcagagcaagtgacgacaggaattctattatcaccaggcagcagctcctctgcctcccacacctgtaactcacaccaggtgtgggacaaagggatttctgagttgctttcactcccaccggtgttcatcaccccatgttaatgacttgtacttgtggttggctgaatcagggacaaaagagaggagcagggacaaagggcttagccacttggctttagaagtgatgttaaaccggtctcctggccttgagatttcctaccacacaggtcagggcagacttcacctgacagaagccaaaagcctcaggtaaagctgtacagatgtgcaggctcagtttctaggaaaatggactttagaaaaaccaaaatggttctatgcacaggtttaaatacagaaacagtcatctttgccatctctgtctagagtgggatttgggaaacccctctctgccataggagtgactcactacaaccataatccatcttccagtacttccctaaatgcaggatttccaaaaaatgcttcacctagttgcttcacaattgaatttgtgaagcatgatttggtgtttgttgagtcatcagtgatactaattcttaaatagcacagactgagagtagagctgtaggtgagaggttatcttttgcctccttttagagcttcaaatacaggtctttgctttgtaaagggcattcactaaatatgagaagttttactcctttggaattaattttgctggagtgatttgcttttgtagctgatgttgttttattctatgtggcaagttccaacattactggagtctttttcaagccaagcaccatagctgcacctgttttaccccaggcactgggcttataattctagtagagactggtagtgagtgatcatgtttattaatggcagcagagaccctgcacttctcatttgtgggtgacctgtgaaagcacccctaagtagctttttgctttttctgcatttcattttgaaaacagcagtacagttacagcgaagcctcacactcacccactccagcgcttgacaacctgcctgccttcgcagtccctcccgtctgcctgacatcttacacttcaactgcacagtcttcctgacacctcccacctcagtccccactccagcctgacttgcataccctcatccttctaggctggggaattgactcctctcagaagcttccccccaaaccccacctgccaaattccacctccacctccaggctgctcagatgccctgctcggtgtccccataacaccttctgtacctctccactgcacttaacacactgtggcgatgtgctgtgtctgcatgtccatgagcttactgagagcagtgtggagtcatattagttttaggagactgggtccttacccaggccctggcgtaccacgtgtgtgtttagtaaacatttgtctttgttcagaaccttaaaggaaccaagaagatctctgcaagctgtagtagatgtcgtaaagcctgcgcaccaggctccaagtggagctgctgggacctgaaccagagccagccgattttcactgtggatgccattccaacaagcctggttacctcaggcagcagaaaggccattatgggacatgggtggttactcgtgtcccttaataatgggcaacaaggatgcaacaatttctttttgtagctgctttctgactcccattgcctaaacaagggctctctcaaacagcctcacaactgtgtctttcccatgtcttatcttccatctttcagatgaaaataagaaaaacatggaggaagcacatgtgactttagtttgcttctaattgcaagagtaatacacactcatcatagaaactttgaaagatactgaaaggtagaaaaaagaaatgtcaccccgatcccacaacaaaaaactgacttctgtcactctatagccatcttttttatcctttctatgcatctgtctgcatttttggctataactaaaatcatcctgcacattcacgtttgtgatctttttttaaattgaaaatacctacatgagagcacaagcattggcagcttcagcagcagctatcacttactgcacacttgcccgaagggacctgaggacatacttaatacaattttacttctgatgatgactcctcaccccaccacccaccacctgatgatgtgtgggtcttctttccttttcctttttttttttttttttttttttgagacagagtccccctctgtctcccaggctggagtgcatggcgcgatcttggctcactgcaacctctgcatcccgggttcaagtgattctcctgcctcagcctcccaagtagctggaattagaggtgcatgccaccatgcccagctaattttcttgtacttttagtagagacggggtttcaccacgttgcccaggctggttttgaacttctgacctcgagtgatctgcccgcctcagcctcccaaagtgctgggatgacaggcatgagccaccacgcctggcctggatcttcttttctaaacactagagattttttgtcgtttatctccttctcttcaaaagtaatcttggagaaattgctgccaaatctttgcctctctgcagcaaacattttaaaatggggtgaacagaagtgcaggtcaacagagggtttcctcacagcaaaaacattttgcttgttgataaacatgtctttgttttttatacctggtgacgttatttgaggtctttgataggatggaccagtactctgcattaagtcgtcgtcgtgtctcagctggcctgtgtctcctgcctgcttcaagagttgctcataacctgagggctgtgaattacactctgtgttccaggtggtgccagacaggaggttagaaatgagactctgaatgaaaagaaacaggtacagcagaacccatctttctggaattctaaagcttatggtccctcactgtgtagcagaggtgaatctgccagagtctggcattatctgagaatctgcctccagggctgtagatggggctgggctaaagcaagactagagggcaggattttctccccccagatctggaatttagcccacagtctggcttttagattttaggctttcgatgcctactgccttaaaactcttgccaagtgcgccacttatagcagcctaaggaatggccacttccccactgacccagttccagtagccaggtgttcagagcaattggaattcatgtgactgccagtcagatccacgaggaagatgaacaggctggttaacgaaaacatgtaagactgacctccttgcccagagatgattcagggtggctttttgtcttagtcttcctcaggccatcagtggccatccctccaaatggacagatacagcattggcataaaaccttactatgcagatgcagctttttgggatgtttccggtgtgtgtatatcctccgcccaacctgttgctaacctgctaattctaccttaatccttcccatttagaaaatacaggacagccattgctcatcaaagcttgtcccacccaattctgcctctccccttgtcagtcaccctcaaatgaaggccaggagcttaggcagatggcttgctgtatttacatagtttgcctgttggcttacattggccaacccgaagagttgttttggtggtggtggtttttgttttgtgaatcttgccattccttcttcactattaaattcttgcttcgcttttagcagaaagaagtgtttaataaattcaggggatttttttttcttctaattaaggcgttagttaaaatagggcataggaggtcataagccgtgcttccttctgataggggtctgcgtggttacaccaggcttgcaatgggagctgagcaggagcacgcaccctgctctgcccattgttcagctgtgaatgtgtggaaacaccctgtgcaaagccggtggcacttacaaccacaaataaagataggttcaaggctgggtgtggtagctcatgcctgtaatcccagcactttgggaggttgaggtgggagtattgcttgagctcaggactcgagaccagcctgggcaatataatgagaccccatctctactaaaaatcaaagccgggtgtggtggcgcacgcctgtagtcccaactactccagaggctgaggtaggaggattgcttgagccctggaggtcaaggctgcagtgagccaagatcgtgccactgcacttcagcttgggtgacagaatgagaccctgtctcacccaaaaataatgataggttctgtgtatctgcatccgttggtaaaataccactttcctcgcaaaataatctgcaatcccacaaaatggtatcacggggtcccaagtcgatggcactcatcctgtgggccttagctcatgtttcccttgctcagagacgtcgcctgacccccaggcaggtgaccagatatcacgcttcctctgcttttccttcacaggatttaccagaatttgtcaatctgcttgtgtcacttttttttttttttttttttttgagtaatgtgtttctcacaccaaactctgtatggggagaggctgtgtctgctctactctctatgggatcccggctccgaactcagcaccagctaatcaggaatttcataaatgtcacaggaaggagtgaggaaacccatttatcttagaggtgcttgaagcaaaacgttttacacttagataaatcttggatcactttttaaatgagacctacacgtttctttcatgaagcagtcatgatttccatagcactttattcacactacttgcatagtatttagtacactgcatagtgacttttaagagtccacttttacctgctaggttgagagtcacttaagggggagatggcatctcgctcatttctacattccgactcttgactcaatcttttgaaggactgagtggtatttccaatgtggatgctactgtgaggctgtcatttggcttcctttttttttttttttttttggaagaaggagtcttactcctgtcgctcaggtgggagtgccgtggcacaatcacagctcattgcagcctttacttcccgggctcaggtgatcctcctgcctaattttttttttatttttttgtatagacaacctcttgctatattgcccaggctggtcttgaacccctgggctcaagggatccacccacataggcctcccaaattggtaggattacaggcatgagccactgcacccggcctccacttctgtttggctgacttgtctaaaggggtgttctttttctgtgattgttctctgcccatttgtgagaactagagcacctgctaggtgtcctttactttgggtaattaaccccacatgttccagattaaaggcatttacctttcgatttacattctctctccaggtacatgacctttaaggtacagagctggaactcgagtcaaaggtttctgatgccttctgtacttttgatttcatgtagcaattcaaggctgtgtgaaatgaactacaggagatccaggtgctgctctgcccaggggatctaatcccaccagaccggttgcactgcaccctgacccatggtcaggatgtttcctggaatacatccacttgacagtgtcctctctatgccacagccttaggcaatatgctgctgatggagctctaggttaattgctacaccacattgggccctctcttgtgtttgtatccaggatcgtctgttttttgtgatggagtttgtgaatgggggtgacttgatgttccacattcagaagtctcgtcgttttgatgaagcacgagctcgcttctatgctgcagaaatcatttcggctctcatgttcctccatgataaaggaatcatctataggtgagttttggttgctgccctgtcttctaattcactgcctcttccctctcctggtatgatccatccttccacttctcatgataatcagttgaaaccttttttggaattaaattcacagaagttttgttttggtttttgtttttgagacagggtctcactccatagcccgggctggagtgcagtggcgcaatcatggctcactgcagccggtccatctggacctcccaagtagatagctgggactacaggcacgcaccactacacatggctaatttttattttttattttttgtagagacaggggtcttgcaatgttgcccaggcttcacaaaggttccaaggatccattaggataaattaataacagtaataaacactgcctgcaatctaaaatttgcctcactttgtattcataaaataggcccgacagtctcagaagagactgtttattcatgaattggttcagccccagtttgctaaggacctgtcatagccaagacctgcagggtgctaaacacactgttgttctctttttttcattttaacatttgaagtgaatcccttaaccatgattctattccattttaagaatctacaccttaactaaagggtgtggctaacctgctctaagttacaagaattacagtcatgtggagcatggctcaccagtcaggagctaggtgagccacttgtgagcagtgtcctgcatgataatatcttccgtgtgtagccccctcccaaatatttgattctccattttgtgacacacaatcttttgatcataatataccatactttgaatggactccgaatctgcttgatgttgttaagtctcagaattcaacagatatcaaatgtaactttagtcagagagaaggttggagacagtgagaagtgtaatagtgaatgttagataatttttattctcacattttcctgtttttttttctgctgttagtgtcctcacctaattgcacatatgctcttttttcttttttattgttttatttcttttctttctttctttctttttttttttttaagacagtgtcttgctattttggctaggtcggtcttgaactcctggcctcaagcaatcctcccaccttggcctcctaaagtgctaggattacaggcatgagtcaccacacccagctcacataaactctttttctcttgagatgcaattgttgctttccttagagaaaaattttcgtatattaggggcatgaatgccaaagtaaaggatttcctgattgaaatttgctatttattaaccttgttaaatgcagttcctatcataaactcatgacagtattgacatcattattaaattataagagctttaaaaacagtgaatattcttaaataccgtgggagtcaaaataggaagagaacaagtagtaactctcttagagagagtgcagtaagactggtgggtggtgctggagataagtgggaacgcaagcactgcatagcaggtgtggcaggtaccacagagacacttctctaattcattctcagtgcagatcccctagacctcaactccatacagtgcatttatcacagcctcacggcactgtgcaggagggaagagggtgcagaactgggaaccagcctggataaggacagtgggagccacctgtttgaaagcagtctaggatctctgctcgttcttaggtcacggggctgcagcaggttgattaggcagcttgttttgagctttcttgaccaggctgtggggattagatcacagcatttttttcccactctccactttctttccagtgtatgctttgtggaggttgctggtatgatctctgatggtgaagggagttaagcgtcgtcctcatgctatcagactccaggcagtaaattccatttttgttctcctctccgcggctaatccagccatctccactccgcttgccccgaagagagacgtttccacatgtagttttaaaaactacatgtaagtaatgactcccctacttgacagggacttctgctgcagatcaaaataatattaacaacaagacctaactgaacacttggactgggtgtggtgactcacacctctaatcccagcacctcggaaggctgagcggggaggatcgcttgagcctggaagtttgaggccagccggggcaacataaggagacccctatctctacaaaaaaaaaaaaacatatacatatatgttaaaaaattagccagccgggcgcggtggctcacgcctgtaatcccagcactctgggaggccgaggcgggcggatcacgaggtcaggagatcgagaccatcctggctaacaccctgaaaccctgtctctactaaaaatacaaaaaattagccgggcaaggtggcgggtgcctgtagtcccagctactcgggaggctgaggcagaagaatagtgtgaaccgcagggggcggagcctgcagtgagccgagatcgcgccaccgcactccagcctgggcgacagcgagactccgtctcaaaaaaaaaaaaaagaaaaaaattcggcaggcatggtggcatgcacctgtggtcctagctacttgggaggctgaggtgggagaattgcttgagcccaggagattgaggctgcagtgagctgtaactgtgccactgtattccagcctgggtgacagagcaagaccctgagtgtcaatcaatcaataaatcaataaaacgagcacttgttacaggaccagcacttcccttgcattcgtctattgattcttctaacaatattattgtataacaataatagtgtccacactgttccgatgaataattaggtcttccaaagacttcatcaccagactgctaactggtagtgaagtcagaattcaaaccatggttctaaccactgggctacactgtcttctcaggagagacttgaggatttagagtaccattacagtgtcagcttcttagtcctttttggtgataggaccacttcaattcctgaaaataaggtagagtgggcaaaagcaattcagtcttatctcaagctttcttgaatcctcagaggctttgagttgggccgagcagcaagcttcctttccttcattggatattaccgcccctcagtctacttgtctcatttgtctcaaaatatggtgggtagacactgtaacttgatgtggtttctgatgaagcagtgccagcccccatcttgacaaattttatttcaattcatggtgtctgtggttcagttctgagaattgattttaatttactcttggacttgaatcccatgttcaggctctaactgatatggttgactttgaagggaacacagttaattaggatagattcaaatgctatttttatcccttggatttatttcacaggataatttaattccattcagtatacaggctgggaacagagtcttaaggataagactttgaaagccaagtccttggaattcacacacagtaaagggcacatttgggtcacagagggtgtggttttgatacaagagcccagtgagaaacttgggagtatcaggcagcctcttttatcatacatgtcccagaacgccctttatcagagctaaaataatcccccagaagatgcctctgacctatccaaacagagctgttgtttgtctgtttggattctttgagggaggggagggagagaggtgtttattttccagcaggttacaaagatgataccatatgcaagtcactgttaaagaaagcttcagaaggtagtaccttaggctcctctgacacaaatttcttctttagctgcctgtgcctgtgcaagaggacatgggccagttacgtttgcacgcattccgtcttgtgttctgaccctgattctcagatgtattcacttgtattttgtggaggaacagaagcccagttcctaggagactcagcaagggaagggcctgcctctctgcctttggttggagggtctggaacctgccatggcccagaaaccaagaagagtaggctgggaaggaggcagtcatcaagtcagttctcccaaggggaaaaaaagaagactattcattcttttgtcctgggcttcttggccgattggaaggccagacagtgctcatgaataatttactcatggtgttgacttttttccggagtcaagccctacagaaaagtaagggaaacaaaggggcatgcatcccattgaccagacatctttcagcatgtttcatcaactgtattaaagggaaactcagctgtcattgacatttcaaccccaaactcctgaagccagccagcacacatttgattggctgtttttgacaaagtgtggaatactgtatctgaaatatgttgggtgaggaatagtttatagaagggcacagtttaaatttcacttcctcctcaccatgttacccctgggcacacagcactttccaacacatgcttttcgactcatgagtctgactgctttgtgccttatgcagctgttggcatgctgggtgcacggtaattagtgtttaccctgaaagctccaaatgcttcccgtggtatttcgccatcccattttgcagatgtggcccacagaggaagcttttgccccacagaggctcactgccaactctgacatgccgccttttactcccatgattacgtggcacatgaacttttcaactttgagctgctgatttctcctcagattgagagaaaaatgtctacttaatttgactcttttaaaaattcagaatttgggaagagtagcaatctcactcgcaagattaagccctgttaagctagtctctgaacatagttgggggatctgtgtgaatataccgatcaccaacatcatctagctcttgtttctcaagaatcatgagggtccacaggtgcctcgctgactccagataactcagctgggcatagccttgcttggcaagtggtctcctctgtgagcaccacttcctggtctaagaattcacaagtgatccgtttccaaatgaatttgtgtgttggggccaggcacagtggcctatgcctgtaatcccagcattttgtgaggccaaggtgggcagatctgttgagtctaggggttcaagaccagcgtaggcaacataaggagaccctgtctctataaaaaatacaaaaattaggtgggcatggtgtagtgcacacctgtgtagtcccagctactcgggaggctgagatgggaggatcacttgagcacgggaggtgtaggttgcagtgagccaaaattgcaccactgtactccaacctgggtgacagagtgagaccctgtctcaaaaaaacaaaaacaaacaaaaaaaaatggtgtcttgggccagtgatggattttacatgcctgagttactgtgcactctctctctctccctgcagttcttcccctctggaaaactgtggcaatctctctctgattcccacctcctaggacctctcttactcctcagtatttcttatcagcagactttgagtccccagatgtctttcatttgagcctggagttttgggctcttactgtcacctcacctctattggaattcagttctgtatttatattcattctactcattctagtgaggaaaatctttttagataaagatgaaagtaaaatttaacagctctcttttccctttgtcatctgctggcattattccttctgctgcaagaagtaggtctcttctctcttgatttgcgtactgcagagactactacaaattgtcatttgttgtttgtatagtccttgtttattcagtacatgccagccatgggaatgctcagtatattagtaactttcacatcagactttggctgtgagccctcacctgggactgatactggctctttgagctttttagtcatgtgcttgtctcttctcttacttagcttgtcatgccttgctgtgccatggtggcctcattcagtgactgctcttcaactctcaccagaaagtgaccaccattcctgacttccaagatccttcttcaaggatatgatggagagctcagagctttccagcttcttagagtagctcagcatttccctcaaatggggtcttcccttttcccgtagtgaaactcatcagccactgttctgcacccttgcatggcctctggagatcttttaacaagtatttgttgagcgtcacccttctgccaaggatatggatgtaatggtatgagcaaaaacaaaaatactcgccagtggagggtatgatccagtgagggagaaagatgtcaatcaaatgattataccaataaaaagtagcaaccatgactagtgctatgaagaggagaaatacaatgcagtgaatgagaacctagaatagggtgattctatccagttagggaaagatggaagatttttataaggaagtgactcttgggctgaggtcacggtaaagagggaaggaaggaacatttgagacagaagaaacagcaaacgcagatagatgcccagtaacaggaaggagtgtggcaaggtcaggggtttttagagcaggccagcctggctggagtctaggaagcgtatcttacttcacttggcattttattatcctacagtgttcagtcagctgatgacttcaagattttattaaacactccttgtaaataatttatttgaaggttaggtaaggccggtcatgttgccaatccctggaggagccatctattcacagtgagttctctgtgtccaggtctgtgcatttatactcaacaatgggtttataaaatattagagccagaggagacctcaaacgttgctaagggccaagttatcttttacagatgagggacttcaggtgtgaaacgtccaaaaattgtttctcatagtggatattctcttcggatgactcatctgctgtttgctttccatctccaggaaaacaaaaatatggctagaaaattttgtttcagtcttcaacttacagctggcatgaagagcaaaccaagacattttgaggcattcaaccctgtttactccattgcagtgagaaaaatccagttgagatcagaacatatttcctgagctgccacctagtgccggatgttgcattaggaggtgtagatacaagatgagtagatgagatgtctgccctttgaggcgctttctgtggggtgagagagatagccattaataagtcatggcagctgggttccaaaattggagttttcccagggtatcttgggagcagacagaatggccacttgccctaagatggatgttcaggcaaacttcctggaggaggtgatgcctgagctgagtgtgaagagttaaaagctgaacaaagataaggagggtgtttaggtaggggagcaagtttgagcaaagcagagaagtgtggtgaatgtgtagttaaagtggaaaatgacaggaactttggtagcactggagcctgaagttggaggcatgggaagagggaaggctagaggaggctgcagaaatgaagtattaagcacttactgttcttgagatgtttgaattctgggtcacttaggactttgctccattgcctatcacaggaaacataaaaatgacagtggcttaagccagatggaaacatagtgctctctcacatgaaaagcctggaggtaggtagtccagccccgccatggaagctccgtggagtcatttgcaacccagatttctgtgctttctgttctgctgtagacagggtcacgtccttgtctaaatggttgctgaagatctaggaatcatctctctattccaattccatgtagtaagaagggctagagggcattcctccaaactgagtcagctccctttaaggggcctcctggaattccacacagtacttaccatggaattggccagaacttgatcatatggctgagtctagctccagtgaaagccaagaaatacagtattacaagtggccatgttccagctaaaaatcagcattccattattaagaagggaaagaatcattatttgatagaaaacttgcagtgtcagacacaaattccatgccagggagtctgggctttatggagcaggtaacctttgaagaattctcagcaggtcttatgacatgagtggatttatattttacttttacgtgcgggtggggggcatggcatgtgtggacatacccatggtaagcagcagccaggttgcaagggagaggttcattttgaggcagttgcagagttccaagtaacaagataatgaggacctgaactaagacagtgatggtagggctgatgagaaaggcataagagataatagcaagtaaagctgataggacttagtatttgggtggattcagggtaaaaaagaaaccggaaatcatttccaggtgtttagctagaaggttgagtggatggcagtgccattagctaggagagatcatgtgcctaggaagaagtctaggcaaaagaggaagaagttttagaaaggttgtatgacaggtgcctgaggtatactccagtggagatgctccatggataggggcataggagtctgaagctcagtaaagaggatgggctgaattaaatatttggaagtcatcaggacatagctattagttgagaccacgagactgaatgagatcacccaataggagtctcttaaatggaacagtgtgagtcaaggacagaaccctggggaaccagactccattagaaatctgcctaaatttggctccagggttatagaaacaattggtatgttcatcatttagagtaagtatccccaaagtgccagtgtattaaaaatataattccataaaagtatagaaaaagatcacttactttagagtatgtgtgtgacgctacatatattcttcctactgaaagaatgctggacatggttttcagaagccctgcatgctagacccagccctggtcctggggatgtgggcaggttgctgaatgcccctagccctttggcccatctgtacagtggaggtgccattgacacagcttcccagcagggtccttgtaaaactcaaatcagatggaagtggaaatgcgaatgctttttggaacatgccgtgtcaatataagaggttatctttgcatatgtgctgtcacctgatttgggttttcttggtatccataggcataggcagcaattattctcaagacactgcctgaataacaggtaattcttcatagaaattggagttttagcttgtaaaaatcaaccttctgaagaccagtctctatagtaaactctggtcatgcttttctttgaaaccaaatcattttctctgtattttcacaatattttggaattgcaagtgattgatatacttaccatgaacttaccataaacccttgagataattttcttaggaagtcctagggcatatgtgacaggttgtacaacctgaagactatactctggcattttgcttcaatttcaacagtttctaatgtttaggggaagcagttgacctcattttgagtttacgccttctggtattaaagcagatgtttgatggttaatttgagaggagattcaagaaccttttcagaccattagtggagtgaacatcctgagggtgtaatcccagtaatgcagtttctcaaaggacctaactttataacagatagacatttaagtcctgggacaccttgatcatttttctgtacttcatatattaaaccagaatgctgatcctggcatacctcctcagggtttggccttttcatcagtgaaggctgtgactatttggaactaattgataaatgtgttagtggctttcaccagctaatgaaaccaggccaccagttttgctcttcttcccaccaaattgaccaagcaaccaattgcttcattataattacagagaatcttggatttatttgctgaacaagaaaaatacagtcatttaatctttatgtattaaatgaacacaaccatttgtaaaaagtaattgaattgtacagttcaacaaatgtttatgaaaagtctacccaatgcaaacctttgtcaggctcttagggagtaaaagaagaataaagacaggtcctgccctcgagcttggggtgtttgttctttccgttaacaaataatttttttgttgttgggcactcactgtgtaccagacgctactgtgagctctggaaaaatacaggaaataaaacagacaaaaccccctcctctcagggagcttaacttctagcacaagtagtaggacaaaatatagaaagaacacaaaagtaggacaaaagacaaaaatatattgaatgttagggtgattcagtatatggataaaaaacttggtaggagcaatataaaattcagtaacaaagatttactgtttgacacagagatttttaaaagcttctctgataagggacatttgagcagatgaacaaagacctaaggatgggaggaggcagctccatgtgaatatctgggagaagagtgttctaggccaagtccttggagggagagtgcgcagtgggatcaaggagcagcagagggaccagtgggctggagcagatgaattcgggcgtcatgggcgtcgagggcccaagcctttttgttttctttctgcaatacagaatgctaaccacatgtgttgagcatttgtcctgtaaggataaactcctctgtttaattgtatcttctgtatgacagttgcacaaggtaagtggcattatccttattttgcagacaaaggtcagtgacattatcctatatttgaggctctgggaagtgaaaggacttgttcaaggtcacacagtatgtggtggaatctacaattccactccatgatatccttttgaatccatgcaggtgctgagttccctcacccatcaggcctttccacacgtttccccctgcttagaatgctcccccatctctttgccaagcttccagctaccaattcttgcagtctcatcttagtcatcacctcctctgataagcctttcctggactcccctaccctccagattccatctaggttaggtgccccctctgttcccatggcatcccgtgaaacccttcccttagtgctttccataggctgtgcccctgtgcatatgggttcatgaaggcagggactgtggctgtccaagcccagcccctaggacaatgacaggagagttaggtgttcttaggtgttcatggaattgaccaaggcctcaaattctacgctttttttattttaagatgacaggtcagggctgagaatatattatgattgctaccatttattgagcatctactacgagccaggctctattctgagctctctgcattaactcacctactcctcatgacagcgctatgatatgacactcagcttgggaagagctgcccattgattgtcttattctggcccaaacccatgattttctcataactcaaagcagtcttttttaaataaatgaaagccttctggaaagtttctctgattgaccgaaaaggatgtttgcacatctgtagtagtgatgcatttatatcctcatacatatttatttggatctgacttcgattctttccttagaacagattcctggaaaggcacacaaattaacgacttttagagctggcattgtggataagagctggggctcctgagtagaatggacctgggtgtttccagtcttggttctgccacttctctgttgtgggatcttgatcaggttactttacctctctaagcctcagtttcttcaatgataaaatggaagtcctggaaatactcacctgagggtggttgttagaattaaatttgtgatgtggaggtgcatgtaaagcctttagcccagagcctggtatgtagtacatgctcagtgatgttcacttttaaacattctgtttgctaccacttttgggaaaagcatcaaacacatgttccagtgacgggtattggtgccatttttctagttcccctcatagatcttaagtgcacaattggataaattttgacatatgtacacattgtgtaatcaatactccaaatactatatggaacatttctgtcatcctagaaagtttttagtgcccctttcagttagtccccaaacacccccataggcacccagtgattctgtgttgatattataggctgtggatatccacattgaaactattgagtgtcttcaaagtagaattgcttctcaggagtgtccttttcagtataagaggatgggctctttaaactgactacatgagtgtaatggcagttatgatcagaagagactacccaaagaaagacttcatcccatcagtcagttttactctctgtagagaaaagtaattacaggaggataaacaccagcacatcaacagttgttgtctgaggtaatataggtgatttttattttctttttgatggttttcaaatgttctgtattgaacaagtgttgtctttttatcattaaaaaaatgccatcctatttatttatttatttagagatggagtctcactctgtcacccaggctggagtgcagtggcttgatctcagctcactgcagcctctcctcccgggctcaagcgattctcctgcctcagcctcccaagtgcctgggattgcagacatgcgccaccacactcggctaatttttgtatttttagtagagacggggtttcaccatgttggccaggctagtctcaaattcctgacctcaagtgatcccctacctgggcttcacaaagtgctgggattacaggcatgagccaccgcacctgggcagaaatgctattttagaagtgatctcatgtgatactatgtttttcaacatgatgtcagaaattggtaacctgctgttttatcagttaagttctgtcaagccccagcctcacgccgtgaccactccttgtctgtgaaacccagttctacagaagtcacaaagccattgtcttagtctgctcagtactgcttagtctgctgccataataaataccacagactggattccttgaacagaaatgtatttctcacagctctggagactgggaattccaagatctgggtgctggccaatttggttcctcatgagggctctcttcctggctttaaggtggctgccatcttgctgtgttctcatgcggtgaggggatggagagagcacaggctttctggtgtctcttgttataaggtcacaaattccatcatgagacctcacctttgtggcctcacctagccccaattatctcccaaaggccctacctccaaatgctatcacattagagcttagggcttcaatatatgaattctggcaggacacaaaacattcagtccattacagccattcattcatacacgtgtttggggttttcagttacattaagcaacatgttttgcagctacttggtttgatagtgccaaatctacccggaaatgatttcagccctaaggaaaacagctcctgctacagtggaacacacagtagacaggcacgagagaataaccaaggattagaccgaggcgttgtcatgcgtttggctcattaagccatgcatgttaggcttggagctctattttgaggtgtgttgagaccaaatccttctcctagatcccagtacttaagcctggcaggaaaaaaagctgagtacactgtggttttagagtgtaccttttgataaatagtttgcagcatgtccctgaaaggggaattttttcctttgtcttgcaaatgtcaaattgtacttttctgtaaactttgtaagtagaaatgtgaagtggtacaagtgctctgttgctttttggtgaaaatgctcacacatgatgaatttctcagttcagttgcaaagagaagttagtgaaacctaacaggcaaactaccccacaccctggagaacagtgtcctgggggtgtctggtttgctaggtgtgtggctggtgcagcaatgggaaggtggcgctttgactgcctggcccctcacatcttgctcctcccttttcactgctcctctggcctccagagtagccatgtaagcctgtgctttcacgtacagaattgctgctctaccctgttcttggcatttgcgtcaaaatttactgtgttccgctgacaaaattctagaatctcaaagctggaatggagttcaaagttatatacccttcttctttcaaagcatgaatatccaacatctgccgagcagtcatttttttccgtacttaaacacctataagcaaagaggaacttatacttcctccactttcagggatgtacggcttttggaaatttcgcctttctgttgactcaaacattgtttcccagtagcttcagttcactggttctggaccacctataaggggtagacttaaaaaaaaaaatacagctctcttacaagaaagctgtggagatatgtgaaggcagtctgggtctcccaatctagtttacctgttaacaaaggaaatactattagcctgatagtcgctcgttctggctgtttcttcaggattactgatttctcagtaatccataaaccatccatgttattaggcattctagatacttggatcaatatccggttgacttgtcacgttcttctcttacgaaatcagaactatctgaactagcagttggctaactgaactgagttatgttattatagctcatgttacttcttttgggtaagacttggtctttttttttgagacacggtctccctctgttgcccaggctggagtgcagcggtgcagctcactgcagcctagagctcctgggctcaaaccatcctcccacctcagcctcccaagtatctgggactacaagtgtgtaccagcacacccagctaatttttgtaatatttttagagatggggtctcgctatgttgcccaggctggtctcaaactcctgggctcaagcaaccctcccactgtggcctcctaaagtgctggaattacagcttgaaccaccatgcccatccttggtctttaactggatattgttgatgctgactatagagtagcaagcacggtggaaagttaattggtgtggtgatctcaaaaaaggatatttaaattttcctgttgtaaggatctcaggaatttaattcctgcatccatttgagagtatagcttcagcctgtatgtgcacatgaaaatagagaaggtagtcataaatcccagaactgaggatctctgtgcacagcccactctgcaaaggtggatattttcctctcaaatcaatctgtgacttgctcaagggtgaattaccaaagatgaaacatgggctgagcacgggggtgggatgggggagacaagaaaatcacctttgggtatgtcaaaatagaggtacctatggaactccttcaaatggtccatctcaaagttggaaataccaggataatgtttaagactggccacagactcaggttgattgcatggaacagcatgaaaatgagacagtattggcttacagttaagaacgaggctttgaagtcaaacttagatttaaaacttacccccacaatgtactgtaattctgtgatattgtaccaactctttaattctctaagcctccgtttcttaatctacatgaggataacagtactatccattccatggagttacagtgaaaattaattcatgtggcttgcttattccagtgtctgacatcagcaaatcctccatatacattatcagttgttaagaagaaaagtgatccagggaaggaaattaaacaatgaatttacttgaaagacagattccataaggaaattgttgaataaattatggttatacccgtactgtggaatattatgcaacaattaaaagaaagaatacattagatctacatatattgacctggatggtttgtccctgatagacaaataaatgaaaaaaagagagatgtgtgctcattttaatcccattaaaaaaaaaagcagtagcgaaagctacaccaagagtctcgtacgtttcctcatttgtcatggctacataagggcttgcatcttgagctcttttttgttcatttcatttgttatccctcaatttctggcacagggcatggcaatatttcttttttcttgtcttcatttctgttttatttctagcaactgagccaacatttgtctgcaggaattcatggtggggagtaagtgatgagaagatgggtggaaacacagtatcatttattgactaaagagcagtgtcactttaatttaattttaaaatgtaaattaatgcatatacataaaaaggacacttttagctgttctaaaatgattacagtgaatgctaaatcctcttcatacccttgtccccagtctctcaattcctcttcctcaagacatgtccttatatgtccttccagaaatggtctatgcatatgcaagctctgcatttgaatgtctcctgttgaaaaacaaatggtggtatattatctacctgaagaacagagattttttcctaagtctttagagagatgaaatctaaatccttaaagaaaggtagtaggtaggcaatcttttcttttcttttcttttcttttctttttttttttttttttccgagatggagtctcactctcactcaggcaggagtgcaatggcatggtcttcactcactgcaacctccacctcccaggttcaagtgattctcctacctcagcctcttgagtagctgggactatagcacatgccaccacacccggctaatttttgtatttttagtagagacgggtgtcactatgttggccaggctggtcgcaaactcctgacctcgtgatccgcacaccccagccttccaaagtgctgggattacagacatgagccaccatgcccattcaatcttttcttttatcagaagggtctatgggtgacagttcaagtcctggaaataattctgctatctcttgttggagaaagtgctggttttttcagatcaggcaacaggcttataaacgtttattgcagttacaagctacaaagaaagatttctttccagcactactgctccaggtagagcagttgcaccagtcattatttataactggattaaagagtagcagcacatacttctaccgtggttatagagtgccttctgttgtacagagtggactgcttattcaccagggagttctcaaacacctttctctatgggcgctgtcccaaataatgtcaagagagaaaaaattaaaaatgagctcctgccctctaagaacagatgggagcagccccaaatcttgcaaatgaagcaagagggggtattcagtctttaatccaagcagctagaagcttgcctttcccaagttcaccgagtgaggattttaacactcctttgacaaagaaatggggccgagcagcagaggaaggcaggtgacactgagtcatggaattcaccctttcgagcccttcctgggggatgtgtggctcttgggttggttcttgaaggaaaggaatgaatgtaagagaggaagggaagcaggctttttttttttttttttttttgactcctacacagaaggtggaattgagaaaaatatactgtggcggtgaaatcaacttacaaaactgaggaggaaaattttgacaaaagcaaacccaaaatctgattactgtggggctgtccattttattgctgcaccaaggagcagggtagatactattttggcctaaagaacactgaaattttgttttctcatttgcaaatagacaggttcaaacccgtcagaggccgtaactgagtttccctgtgactgatttgtatgtgtgttagtggttttttttttttttttcctgtaagaatctggttgagtaattcagaaggttaaaaaacaaccaaacagaaataagtgagaaaagttaactgaggtctgccacatatgccgggaaggtgcccacagactggcagaatctgtgcagtctttgtctgtttctgcctatgcaaatactaagccacgctcaacagagcttgagcgttgtatctgttcaactgccatttaagaaataggactctgttctcaacagcttattccttggggtttcagaatgtaaaatatgaagtgtgtataatcacaggccaggttcccagcatttctcggcatttcagctttggcaggaggaatgggaaaaactgaagtttttatgtccaggaaggctgagtgtaatctttgttctgtggcactgggaaaggaagtgaatctgttacaaagcgctttacctctgaagcatgtctcaggggcagctgtgctttgtgccatgtattctgttttcataaaaagaaagaggtagagtcgagggcttaccatgcagagtattttcacagtatctcacttgatatatcatccagggaaagtgacctgtgttatactttgtgttttaagatataactctagaatcaaaaacttaccagagaagctcaagatactttactttgcaagaattaattctcaagataaaaactcatcagagttcaagataagaagggttcaattaacaacacattttaaatggaagaattatttaaaaaattgttttaactttgaatgagcttagattaacttacctgttgcagaggtaggtcagaccccatgtcatcatttgcccagaaaagtcccagtttgctcccataatcccccttcatgacccattttactctcagaggcccattttgtttattgggtttttttttcttgagagagtctcgctctgttgcccagactggagtgcagtggtgcgatctcggctcactgcaacctccacctcctgggttcaagccattttcctgcttcagcctcctgagtagctgggattacaggtgctcaccaccacccccggctaatttttgttatttttagtagagatggggtctcactatattggccaggcaggtcttgaactcctgaatttaagtcatctactcacctcggcctcccaaagtgctgggattacaggcatgagccaccgcacccagccgtctgaggcccattttgggcggtacactgcatggtcatcatacaaagaggtgtctgcatttctacttttttttctttaagatggtagaaccaaacaaaaaagggtgtttttacaaattgagaggggtccctctgtaggaggggaatttctccagcattttcctttgatggagtattctcctctcgttcagaaataggaaatttagtaactaaagcattaagaacagatttattttttaacatcagtcactaccttagtttcagagacacactgggggaaattgcctttcccttacgcctcttgttttatgtcctttatatgagatgttaatatatttacatgaggtataaatttgtctgtaactttataggtttgtattcatttattaatccatccatccattcatttactcattcaacaaatgttaattgagacctattttttgcctggagatataatagtgaccacaataggcctgctccctgcccacaggaagcaggcattctagtgtaagcacacaaacaagtaaaagtaattaccaattgtgaaagttacatggaaggaaataagtgagcttttatttgtggttttatttcatagagctgaaggaagtgaagagacagatacctctctccccacttctttcattgctgaatgtctgaagtatttcttactccattggactactatgacagaacactatcgattgggtggcttgtaaacaacagaaaattatttctcagtgctctaaaggctggaaagtgcaaggtcaaggtaccagcagatttggtgtcgggtgagggcctgtttcttggttcacggatagctgccttctcactgagacttcacatggtggaagccgtgagagagctctctaggatttgtcttttcttttcttttcttttctttttttttttttttttttttttttttttgaggtggagtcttgctctatcgcccactgcaacctccacctaccggcttcaagcaattctcctgcctcagcctcctgagtagctgggattacaggcatgtgccaccacgcctggccaattttgtatttttagtagagatggggtttctgcatgttggtcaggctaatctcgaactcccgacctcaggtgatccacccgccttggcctgccaaagtgctgggattaggagcatgagccaccacgcccagccggatttcttttctaagggcgctaatcccattcacaagggctttaccttcatgacctagccacctcccaaaggacccacttccaaatacagtcacattgaaggttaagtttcaacataccaattttggggatacataaacattcagtctatagcagtattttatctggggtttcaaactcaaataccttcagagtagaggccaatggggacactcctgtctcatggttctaaccagaggggacttgcatatccattcacctaaagctccgttaagaaaggtgaggagccccgggccagacccacaggaagtgtccccaggttgcatttggctctggtcacatattcactttttccagagtccccaaggtatactttagttccacatcaatgcctaccaggcctggttcagtcttacatttcaataggtccccttgtgggtctcggagaaaaagagagcagcattagaattttactaccacagtgagtttttccacttcactttggaaacattgagctattcctacgcagtttggatgacagaaatactgtgctcagtgcaatctactggaaaatctgagtgcttggaaaaatgtcaggaatactctcttttgtcatggaatttctccatattgcggcggtacttcagtgtgagtcagcaggaggaacttcggtgcaccaagcaggcctcacatcagtggggttgtgagtcccagctctgattgaagtcaggggggtgggtaagtgatgtcctggccagtccagggatgggggctatttctagtgtgcaatgctggccctcctgaaccaaatgtgaacccccctggactctcgcatgagtttctctggaaagctcgtcttctcttctttacccaacccctccccctaccactcttccagaaagttgctcttcagaattccatgaaggatggaagcagccctgaactaactgccctggggctctttattctcaggctaccaagaaaagaaaaaaatgctaagaagcagggacctggctgcctgatcttccctatggtcactggctcttcttgaacaggcatgtaatgaaatagtgtggaacagtaagaaagctcctacaggcagaggccatccatgaagcctcttctcaggcaatggagtcttcaaatggaatgaccacagactgttttctttgaaggtgaatgcacatgtctaagccctaaattgccctgctaaaatcgtcttcccttggacaccaaaagcatagctgacaaaagcaaaaataagtgagagggagtacatcaaactaaaaagctgctgcataggacaggaaacacttgacaaaatggaaaggcaacctatggaaagggagaaaatagttgcagatctgataaggggttagtatccaaagcatataagcaacttatacaacccaatagcaaaaactaataataataacctgattaaaatggacaaaggacctgaatagacatttctccaaagaagatatgcacatggccagtaggtttatgaaaagttgctcaacatcactaaccatctgggaaatgcaaatgaaaaccacaatgaaatatcacctcatacgtgttaggatggttatccaaaaacctgaggacaagtgttggcaagggtgtggagaaaagggaaccctatgcactgttggtggaaatgtaaattggtgcagccactaagcaaaacaatatgtaggttcctcaaaaaaattacaaatagaactatcatatgacccagcaatcccattcctggatctataaccaaaggaattggaatctggatctcagagatgtctgcactctcatgatcattgcagcgttattcacgatagtcaaaatatggaaacaatctaaatgtccttctgcagacaaatagataaagaaaatttgctatggaatattattcagccttaaaaaagaaggaaatcctatcattccggacagtgtggatgggcctggaggagattatgccaaatgaaataaggcagacccagaaagacagatactgcatgatctcactcatatatggaatctaaaatagtcaaaatcatagaagcagggagtagaatggtggttgccaagggtggttgggggacagagaaatgggaagatgttgatcaaagggtacaaaatttcagttatgcaggataaacaagctctggaaatcctactgtacaacataagacctatgattaacaatgctgtactgtatacttaaaattttgctaagagagtacatcttaagtgctcttatcaccaagaaaaaaacacaaaggaggcaggaggaaacctttgaagattatgtacaggtttattgcactgacagtagtgatgattttacaggtatacacctctccaaacacatcaagttgcatacattaagtatctacagctttttgtatgtcagttattccttaataaagcagttatttttaaaaatcctcttccctttggtcccccagcctttaacatggcaattgacatggcaattgacatgataaaagctactgtatttccttgatttaaaaaaaccacagctcacaaaatgcccatgattgctgatttgattaaaacaactgtactagcagctggcaagtgtttttttagccactagttttaaggaacattcctgtttcagaagtatcaaaggggagggagcagcacagatcatagaatcaaagtgatacagagattagagttgtgttcccctctaggtagtgatagaggaattgtttcctctctaggcacagtgatagagggtggcttcgttaacagtattattaaggccatcttactgacagcaaaagggaaacaagacagagtcctgatagttgggtaaaaggatcagttaaatttgaaagcgcttccttttgtatgttctggtcagtcttctgcgggaggaggatgtataaagtccactgtgtcagaaaagcagtcagtctacccctccccagtttccatctgggtatctttgtgctcctggtcatttctttcccagaaattgggggatctggtctcagataagaggagtgggtttggatgtcccaatatcacatatggtaaggatgaaaaacatggataagatgattgagtttatcttgtatatgaggccatgtgttgtaaatggtctttttttgctaactttcttgactctctagatgtatcttgaggagtgaagcatgaggacactgttttactcagtcacaacctagagtcaagtttttttctgttattttctcaagacagtgctaccaattagattgtatgcatcccatttgtcctcatttgattcccatccatgttctcaccttctccaaggtgactgttattctgattaatgttcagattcctgtaatgcattgttagcattgggtgctggatctgagccagtccagggtctggagagctatgcagagatagaagtggactctagaaagaggcccccgaatcctgccattccctctccaaggtgccagagtttgcagtttccaggaattgcatgtgatgcagattgtaaattacgcgtaaatatgtatttgtgtcttaaatgacttttttagtttggagaatgcccttcaccctatgactggcataccgcaacacactcattagccctttgttggctgacactttgaaaacatgcagcctcaaagaccattgttaagtcatccatggggtttgtttgaccatgaaggagacttcttcacgattgagttaccaggttcaacaggtcctgggcatctgctttgtgctgtttacctctgaagatcaaaagataaatcagaatctttgctctcaggatttagtctactgggaattctaaacacacataaattgacgatgtaagatatggtaccataaatgctcagagtgaaatgcaaacagaatacagtgggtgcttagaaaaggcaactatgaatgttggctgggtgtggtggctcacgcctgtaatcccagtactttgggaggccagcgtgggcagatcacttgaggtcaggagttcgaaaccagccctgccaacatggtgagattctgtctctactaaaaatacaaaaataaataaataaaaataaaataaaataaaaactagccatgcatggtggtgggttcctctaatcccagctacttgggaggctgaggcaggaggatcacttgaatctgggaggcagaggttgcagtgagccaagatcgtgtcactgccctccatcctgggtgacaaagtgaggctccatctcaaaaaaacaaaacaaacaaaaacaaactatgaatgctgatggagaggttcagtggaggccttgaggagatgacacttgattctgatatgcaagttttccattaacagtgaaacagggaagtccatgctaggtagacatagcgacagggacagaggcgtggaggcagaaaagcgtcctgtgctaaggaatcatgaggactcggtatgatcagaggaccagagcctgggaaggagcagggcagagctggcagctgaggtagatgggggtgagaacctggaaggttttgaatgttgggctaggaagtgtgggctttattttatttgcctttcaatagaagccaacagaggtttttgaggaagagactaacgggaaataaatgcagtgtgttagagtaagtaacagaggagtaagcctggaagccaggagttcaagtaggaggtcttctcataggtcaggcaagaaacagtcacagcttggggcaagccagtaatggtgggaagagaaaggaaaagaggagggggagcgattcacatcgaagggagtctgatgatgtggttgggggaccaaggagtaggcgttaaagatgactccgagatttccagtgaaggagcttttaactgagtagggatagcaacagagtacagtttagtttttgtttttttgtgtttaaagaaacacttctggtagttttgcccataaagcagttagagatgcggcctggctctccggagagaggtgtcaggatagggatttagactggggagccatctgtctaagggaatacttgaactcacgggactcaactgcaaggtaaagtgtcaagcagggcaactgtgcacaactgggcagattgggccctgaacaaccctagggagtgccaccgtatcctagtcattgtagatttgtgcaatgattgaattttctggcagatggcagtcagatgtcttgagaaaggggcacctttttctaatgtgcacaaaggtaccatatggtgtggcaggaatgctggaagtaaacccaggcaagagccaagaacagaaccttagggaaccagctatcctataagggagggtggaggaggaggagcctccggaggagacacttaggggtggtgagagacttaggtaggatttaagtgtttagttgcctccaatttgcctgaaaatagagtcaccacacagtgaactctcatcttactttggtttaatgactcaagtagagcctctgctcatattatccatcagttcttccttttcacatagccggtgagttttccttggcactagcaagtgggatcattaactgtctccatttggttcggatgtagaattattaaacctgtggttctggtcttgagagccaatgcctggcaggtgactgtggcccagggtgaatacctgctgcaaagcctcctctagaaggcccactgcagagcctgcctggggagctcctaggagggcaaagggcaccctgccaggcaagtcacctgtcacacctggctccagccagctaggagtcagattggggcagccccccacccagaactgccagagcctctcggatggctcaagtcctcacctctgagggcctggcagggtgaagaacgctccttgcctcctgaaccatataagaaagaaaaggcatccccagagctatagcttggaggcttggctcctttatggcataaactacaaaggcgcacagcctccccgatgtgtgccaataagatggcataaatgcttcttgtggaagagaaggcttgtgccctgccttggcacatgatcctctgcccacacatgcttgtcattgctgcttcctggcgcttgtgacctcctttgcatcagtggaaagttacaggaggagagatagcaccacctttctagtcaggaatctgtcacgcaacccagatcaaaaacttcaagttcacttctgtgtcaacgggatcccgactctgtgggtggatagaacattgtgtggaaaggctgtaaaactcagagtgtaactgcagtttttatctgagtggctggaactctagcttgtttattacctagatcagacaggtaaaatgttctactttcaaataattcatgtttttcagatcttgaattttggtaaatttttttcatcagttgattctgtttcttaatttgaggaatagagttccttttctaatgggaaaatatatcacttgtcatgtctgtggtgctttcttgtgttctacaaactctacgtgagcataggctgtctggctctggggatcagaagcactcagggagctctgaggacaggatttcatatactacatcctgaaactgggcagatgatcacatgaccctttttttttttttttttttttttaaagcagggctcagaagcagagagagaaagagaatttttccacagcctcagagagaaaatccaggaaaatccaggagtagaactcatgaggctgaggttctggaactgtgttcccaaactgccttctctggaaaaaatgcagagggaaccagccgattcctagtaaaaaatttttgacttactgactttcaaaaagaaatgagttccatatgatgggaattgcattctttgatttggacttaaaggattttctgagcttttaaatggtttcctatgtaatattccatctcttctggtttgggagttttccatgaaatgcctttttaaaaaatacccaaagcatcaaatgagcttttcagcttgatgaagaacttaagaaatttcatcattccttttcttcctggctgaccttttaattttacacaagatatacaggagtgatttgtcttgtctggtttgtaaggatttttaatcaccagccacacacattagtcactggcttttgtacctacaagcccaattttctttgttttgggggttttttaaataagtttgtttgttcatttatttggagacatggatcctgttctgtcccccaggctggagtgcagtggcatgatcatatcctcaaactcctggattcacgtgatccttccacctcagtctcccaagtagctgggactacaggtacacaccaccacacccagctagttttaaaaaaaattttatagagacagggtctcactgtgttgcccaagctgacacttacagtaacagtaggatcagactgagagctggaaaaggaacagcgcaatgggattggtagcataaaagatttaccaccagatgcagaaagcagttctcaccattgcttcctcagttccttagcatccaccacgcgcagaactttacactttacactcaaggggtgtatgaataaagggaatgcaaccaaagtttaaggtaagaaactcagagcttgttcagttcagttagtacttaattggctacccagccttgtgccaggtaccttgttctggggctagagagctgaaataagcatggagaagatctgcagggaaaccaacagatgcaatcagtgcaagaaatgctgtcattagaagtgtgtaccaaacaccattggagcacaggcggagagacaccaaacttggcctaggaagggatgcagaggctttggagacagagaagcttcagttaagagtgaaaaagtcagcccaggagagaaatgagctcttccatttatctgtggtgataaatcaatgtgttttaatttttcctttttcagtccgtttaggaccaatactttttataaaatgtattaaaagtaaattactagaaaaatgaaatttccaaatacatataaaacagaagaccacatttttattattagattcagcggacttatattgtcatgtagtatgacagtatgatagtttgtcatactgtcaaatagtttcgaaaaactctgtgcctctacttttacctcaccatgggtcagcgccagtttgcagatgagcggcagtttgtggaccacactttgagtagcattgccctgggcagaggaggacatatgtgaggatatagtgattgactgatgtgagaaatgtggagggaatatcatcgtgtcccatcccatcgttttacagatgaggaaactgaggcccagaaaggtgacagagctaagaccagagtccctgctttctaactcgagacagttcttcttcttgtcctttgactaactcacctgaacagtcaccagatagcaccagcattccagcctgcctaccctgcttcacccacgcctactgcctctgaagaaagggaagaatctgtgtccatcagaacatgccggggataccaggacaccagcctgctgcccaacctggctgacccgtctgctcacggaccctgtcttaatgacagaagccactccaagagttcactgtgtcctgcagtagccagttaaattcatgtaaatcctgtttgggcagtcagtggaatttttaatactcttctcctttaaaaaaaaaaaaaaaaaaaggaacaaaggtttttctcatctataagccaaacatgagcaggcagtcaccaagcagggcaaattgttatctcttggaatcagtttggttctagactggtcttgaaggattgacgcctggtctggggtggacttgagagccacagagtatgctgtcctggtcttaggtcatccccaagacaggggacctctgcaggcaatagcagcttcacgttggctgtagaggtcccagatgggtcccagggtcccagcacaaaccagaatccacccagctccccccacatcctccctaatccttcctcactgcggtctcctgggaacctggccaaacccaatggtcagggagggagttgctgttcagattaatagccatttattatgggcctggtatttgcaaagcactgtgttaggcactgaagggaaccccgaaatataaagatatagaaacgaaggcaatgagtctcctcatggatattgcattttaggtggagaaataagtcatataacagcccagacgggattttgaaatttgttctctctgcctgcctcttttggtccccatgaccaaggaaggcaaacaccagtgcagtggcattgatataaattcttaaatgtgaacatggcacttggagttgattgcttatttgtgaaaatacatgataaaaatattcatagattcagacatgtcaaaaagattccttcatttatcacagagttgtttataacagtgaaaaatttaagaagtctgcaggtggccttgcatggtctgggtgttatcacaccactgagtgtcaaaccagcatctgctgttgggtatgggtcctaagcaatagacagggagggggtgaagaacaaggactggctgtacagttgaattttatttgattacgttgtgaagtacagatactgtttcacttcctgggaattttgtgttttatttctggagatttgaaattctccagaatggaaataaagttctccagccactgtggtggtgtggatggcaacagggttcagtgacttcccttatcctcgttcaacttattctacctagcagaaccagtcacctgtggtgaattcagtggcgtttgacagtctaggatgaaccgaatgaacctcaacttaaaccagctttttgtcattgtactgacctgggcacttgacactaaacagagatcttaattcctgtatcttcatgcatcagaatttggtcttagtggagatgtcaatagacgacggtgttgtggctggttgggtttaaccagttctggaggcattttgctcgttgcccaaggtactggtgccagaccatgtcactgtatgacccatctggctttggctcctggctctattacccagagagcagtttataagccagatgtgtcacttaatagtaggcatacctgcccaaaatgcaaaagcttacagtagttatctagaatttacgaagcttgtttttactctttatcagtgttgattcttataaaaatcatgacagtaggccatgtagatattatctttcttgttgatgaataaataatagccaagggctctacagcacttaatgcattccaggcgctatgctaaacctaattcacattaagtaactcatcatttctatgaggcaggaactgttgttatctacatttcttgatgaggaaataagcccagagtggttaagtaacttgcccaagatcacacagctagtaaaactaaaactaaactcggctaatcaggctctaaagtctgtgcccgtagcctcacaatatgctgcccattgaaatcagacagacagatgagatgtggtatgacctccccaagccacttgggtaggggagggaagcagattgagggaggcaactgtaaaagcatggttgggaagttgtccttggctcatctctctatatggcacagggctccaaactgaaatagccactattgggtcaagattagtccagcatttaggcaagaagaatgttagtccagtcatctgctacttttgctagcatgtatggtggtgacactttttaaactaaaagtaacacacataggctaaaaaataaatttttcctggtttttgaattctgtttacttttaagatcttaggaagttataatgactcacacttgcacatttaataatgacttttattaagaatgctatgacacaaaattagaaacattcttcagacagtgtctccacgtgtaagtacttaaagaaaacaactaaatggctatttgggaaaactgggccctttggttgcaaaaccaagtgctggggccggagtgagtgctcaagaagtaccagtgagttctcccaagggaaatttcttaggggaaaatgtgatgtcttttgcacatgttactatgatgtgagtccagtattggtaggaaatcagtaaaattccctgaactttactgtgtgtgttgccgtcttgtgtctagcccgtgattgacattctagagataatatgagaaatattccagacctgaccttagagtttgtaatccagttgggagaaacaaagccttttatgcaaaacataattagagaaccaagcaatatcatctataatctaaaagtaaaatgtgaggtatgtttttaattccaagagcctgtgagtggttctgaagtgcaagtgtcttcttgtgtttttcagaggtttgtgtttagatggctcaggtttaatctctaatggggatagcagggaaccagatgagacctgctgaggtggccacagtactgattctagtgggcaggctgcctcccctctgatactgtgtaaggcattactaatgctggcaacagtttgcatatagccaattgccaaaagcagcctgcacatccctcctgaggctggtcccgtaaattcttctctttcctgtcgtaaagcattcctcatcaccacctcccttttcacactttatgcaaggccgtgcactgggacagcaaatggctgcaactttcactgcttgcttttcccaagtcgaagaaaagttccaacgctggcaaagcaaggacattgctattttctgacaatcgaatgtcttcgaggaactagcttcagtgctgatagggtctgtgttcctctagtaagaatagcactgtttccattagaggggaccaggatgggtagacaggctaagacgtctgattactctttgctctgtgtatttgtatgacagctcgggtgtctggcttaccttcctgaggatgagagccatagcattatccatttaataacagccacagtgacagtgctgataatggctagcatttacctagcactgtgtgccctagaacatttaatagtttcactctatgaactcgtttgttggtcttcatgccatgtgtccaacataaagctagcaggacccatctgtccttgcccatgcttattctgtgccacagccacccctggttgtgattaagatattaatgttaaagagggaattgagttctgatttctcctcattcaaaaccattctgtcatcttcatgcacatgccctgcaggcagccagccagtaaggggtccttcatacctatcctgttcctggctggtggctctcagaatctgccatggctctttgatcctgtttgtcctcctgcccttgagtgactggctatcagaaaaccttcatttccttgttggattctgcctccaggaagcaaagccgacccagtggtttctgtgggtcagctgcacttggctgtctgcactggggaagagacttggcttgttggctgttttatgccctttggactgtcaggtccaagtgtactgttggccgcagcatccagtctgtgctatcagagcaaggcgctatggtcaggagacccttagccaccaaaggtctgttgtctcctggtgtctttgcctgaagacttctggccttcttgtgtttcatcactaagtgcatctataagctgacccgctgccaggtatcatgtctgagcattttggcaaggagagtcggtgagagaagttttcttggcaaccataaaataaaagtactatcaggagctgctaaataaatttgcaccgcttcagccagggaatttcagctctcctgggtgggatagtgataggggatgtggaatgcaaaaaaaaaaaagaaaaagaaaaagaaaaaaaattatgaggctcagctgtcagtttgatggctcatttatttgatggtcctaaggagatgtatgattggtacactgaggatgtttatcaaactcatttcctcttgtatttgtccagagagtcagcgaatggggttttttgggtatttttttctaccgtgagacaaagtgaggggaaatctctgagtccctttgctcaacttaagttggtcctgtgtatctgcagtggtgatggtgggaacacactgcctacatgtcaagggcatcaaacacccagaacaggatgaagaccaacacctagtctatgggaattagtttgtgagtctgtgccctgtttgtttgtttctttgtttcattattgttttttgagacaggatcttgctctgttgcccatgctggagtgcagtagcacaatcatagctcagtgtagcctccaacccctgggctcaagcaatcctctcaccccagcctcccaagtagctggacctacaggagtgtgccaccatacctggctaagttttttaaaaaattttgtatagctggacacaatggctcacacctgcaatcccagctctttggaaggctgaggagggaggatcacttgagcctaagagtttgggaccagcctgggcaatatagcaataccctatctctacaaaaaatttaaagattagccgggtgtggtgatgtgtgcctggagtgccaactacttggaggccgaggtgagaggatcgcttgggcccagacggtcgtggctgcagtgagctatgatcacgctgctgcactccagcctgggctacagaatgagattatgaatgaatgaatgaatgaatgaatgaatgaatgaatgaatgaataaataaaatttttgtagagacagggtctcactatgttgcctgggatggtcccaatctcctaggctcaagcaatcctcccaccctggccctgttttaaagagggtgaagtaaccagattcaaataggagtcatttttgtcatttctcatcccaggtagctgctgggaggaggtatgagggggtagtggggaagagcctcagaagagccttggcaacactttctgggctggaaattgttttactgactttcttcattataaaatgaagtattttacattcagcctcataatgatgaatgttcacatcttgtatacgtggtcttcagcaagatattccaataggtcagcctcaggaacaccagattaagtgtctgtgaggagaaatggcatagggacctcatttaataattaggaatgctgctgcttttagtaggaaattcattttcatacttaagttcattcagacttcagggacacattgtggggctattgaaaatataaatgccatccacgacaatcatagacacttagtagacattaagtaatttctgtggtaaaaaaaaaaaaaaatgagctgatggcaacaagttcaattctaagtctacaaatgtgcaggttctctaagcaaacaggatgtttttttccaacattcccttggagcctgggttccaaaagaaatcctttgcactctgaccaatgggtccttttccctgcacatcttccttgggaattatggccttaaatactacagaaaccaaaaaaaaaaaaaaaagaaagaaagattaaagctagaatatgtaaacacattttaatgactttttcctggttaacaaagtaatacatgattcctgtaggaaatttagaaaatccaaaacagaaaataaaaatcacccataaacatatcacctggaaatagacttttatgtttttcctcatctccttttttcctcctgtctttcctcctttttcctcctgtctttcctccttttctttatccctctctgtcacaattgtaacaaattaagagaatattgaaaatataattttgtatcctgttctttcacttagaattgtatgagcctataagtaagtcatgaaacccagaagctgtgaaggaaagattgataactggactatatcaaaacaaaacttcaaccaggcgataatatttacaacccatagaaccaatataaaaaattattactatcccataatatgagcttcttaaaaaaatcaaaaagataaacaactcaagtttttaaatggttaaaccatgtgaataggcaagaaaaaattcaaatggccattaaacatatattcttcttaaagcttaatctcattaatagtcaagaaatgaagttgaaacaatgagctcatttttcactggcggtttggcaagaattagaaggatgattccatctagcctgaacaaggaagccaaaacattgacactttcatgtgctactggtgggaatataaattgatgcaacccttttggaaaacagtttctctacatctgtttaaatttaaaatatttatgccctttgatatggcatttctacttctaaaaaaatgtatcctaaataaacactcccacaagtgtgcaaatcatgttcattactccattgtttgaagttgcaaaaaatttaaaacaacccaaatgtttatgtagaggaactggttaaattgtggtagatttttacagtggaattgtatgcaaccattatagagaatgagccagaggcataggagatataaatatgtccaagacaattgttgagaaaagtattttactgtataatattgtgttagtgtagcattgagaagaaaagtttgaaagactgaacccatcatcattttctctatacctttttcaggaatgatcaattttatataatgaaaatattacttttataatcaaaaaaacattttcagataacatttaaaaattctattataaacatttccttacatttttagtccttcataaaaatttggcagctttcataagattctgtcatagaaataccattatttatttagccattccacggttgatacataatttagctttttttcaaattatatatgatgcagcaaccaatatctttgtaaaataagattcttaattttacactcacaagagtatcatatcacatagcagagattgagaatttaacctgaaaataatccattgggtgattctgaatgtacaagattgatgtttttctaatctttttattttattttattaattttttttttttaagatagagtttcactctgttgcccaggctggagtgcaatggtgtgatcatggctcactgcagccttgacctcccaggctcaagtgatcttcccgcttcggcctcccaaagggctgggattcaggcgtaagccactgtgcccggccttaatctttttaaagcttacctggactataggtggcccatatggaggcaaaagatttgggccccactctctaggcacacagctctgctaccctactctaagtataatttgtcactagtttttgtagtctcagtgtaaaaaagagcagagatcttggcctcaggagatcctcttcccaaggctcagtcccaggctctctccttatttcattccttctcctgaggtgaactcatccacacccaggtaatgactctcaaatttatagctccgaaccagccttccctttgacatctagccatgtgtattcagctgcttaaatatctccacctgtatgtctaaaaaaagtagctcaatctgtccaaaataaattctgtgatccagaacctgctgatgcctccttccctttatcctttacatccttccattgctaaatcccattgctttcccccagtagttcttgacacatctagttctctttaccttaccaccctccctataccaggccaccatcatttatctcctggatactctagtagcttcccaaatgatctcctcatgttcattctcaactcctctgatatggagtcctgtaaaatcgaaaatctaatgccatccctctcctgagtcagagttttccatggtttattgggctaaagactgaaatcctcactggcccctgcctcatctggtccctgctctctcctgtctccatgctctcttctctcgccacccaggactccaaccacactagtcttcatttcttgactgaaccccctcacctctgttccttccttctgaaattctccttaccctcactttcccttctttctgtctcttcacttggttaataatcttcacagctcagttcaaatgtcactttcctgggaaatcttcccccagtgctaggtcaggccatcccttgatctattcccatgttttctcctcattgcactcatcacagttgataattgtaaatttagttgtgtggtgatctgtctgcttctcccaccagacattaacccccttgtgggtagagatggtgccccctttgcttactattgtatcccaacatcctggcatatggccaggctcatggacaatactaaagaatggttgggtgggtgaagggatggatatctcgtgtcaggtgatgcatgaatggcactactgtctaactcacgatgaaaccaaatgttatgcttttgctaattcagtgacttttcaaaagtcttttgcccatttaatacaatccatcttgctttgaaaaaactttaagtataaacccaggcactcaaaacacaagccagtcctaagtagttttattctaaaattaagaccataacccacattcactcacttggcagatgcccccttttcacacttacctacatgctagttcctcctcctcagtggaaggcagcaaatgatctgcacatttgaccacttgagagatttgctgtgcactcccctatgcctgtatcctcaaggactctgtaaaatccattgaactctatgcacaagctaagaaaaaaaccttgctttgcagtatttcgattatgcatttcatagtaatatgcataaaacatccctctatcatagtgccatcttagaatatttattgattccctcaggtggttcttgtttcaattaaagtccttttgggaaacaatctatccgggggattggccggtgacactgctacatagaagggattgggcctggtgtagtaagtcacaagcccaggccttggaggtgagcagaagtaaatctgaatcctgattttacccctgtctagctatataatcttggggtagagcctacttcatagagttattttgaggataaaataagaatatagataaagcacttagcatttgatgaacattcagtatatgttaaccactgaagacactgttattcttgttattcacaaaagcttttttccaggttttctagacagacccacagactcaccacccccaaatgagcaacagacaaatggcagtatgctgacaatcataaattgactgtgtattttatgataatgggtatcaaagttgtactctattaaagaattattatctttgagattcagatattaaaatgtgtatagatgaaatagctcatatcctggatttgtttcaaaataatctgataaaagatggatcagggagggagggagtcgatgtagcgagggagcatgtttggacgtgcattggcaggtgccgaggctgtgtgatcagtatgggagttgtgtcattctccctacttttgtctgttttgaaatttcccataataaaagttgaaaaatatgttaaaaatagttcatataaatagcctcctagattcattcttgttcaaggagccagctctcaactcgctttcctttatttcttttggaagagtaactgactctagtgatctaagcagtaagactcatgtcaatctgttttattactctcaggatagcttatggtggaaacaaaataaatccaatttctgaatctcctttgtcttcaatcacttgggaattctctctgaaactactgtgggcattttaagtaaccctgattacccagcaagaacaatgtagctttcagacaagcacagaggatagaataactctttctacccttctatgcttgcatgacaaaagctgtagctattaaataccggtgctcaatgagctaatgaatggcaagccggtaactgtggttttggcattttagtatttgagcctctgccctgtatgaacttgtaatcttcattgtgtagccttgttaagttcagctgctgagttacatgttggcataggaagctgaggtactcctaagccaaaaactgacctctgcatatttcaaactaaagtcaggaggcttagggtgacttcttttgctttaaaaaaaataaaggcatgatttccctttagagtggaagctgaccatgactgtaaatggctctataatctttggctttgtttgagtcaccctctccatgttctgctcttccgtttggatgcaagccaacatgaggataagtgttctgcttggtcctcgttgtttaataattgacccttcaaaaccactttctttctccagcttcatcaaagagaagaatttaaattttgatttcaggtttcttcttttccctcttgagtctatctttaaggggtaaaacatgtggctttttataagtttaagtactttggagcaaagtttatggagtgtccttccatcccctaaaaataagataggctctgagttggccagggcagtcccattggggtccatctgaaatgcttctgtttatccctttggtcagcacctcctgccaggaccatgctggagctgctaagaaggaagacaggtgcacagacagagccttctggaatacagtgcggggtatgctatcatagaagtataaactgggcaccctaggagcagagttgatattgctatgactgtctggggacatcaggacagacttcatagagcaggtatgagatacttgggctgagggcagcactggtagcctggaattacattatgctcttaattgaaccctcttgggatcccagtttgagcgatctgtcttattaaatagcacttggtatgagaacagccatggcgtttcctttacagctcatacagttctgagaatgcctaaaattagattgaaatcaggattaaggtgtctaacctgcctttgtggcctcgggcatcctgtgaccaggatgagtcacatccctgtcttgcccacttgcgtcttctgagagctgcgtcccaagacttccccatgcagagctgattgtaatagttgactgacaaaactgatggcccagcactttctctccctgcgcgattcctgctgcccatgacagcagctgagtaataagcagtcagacctcttacctgggacattagtcacaagctcttaagcaactgcgggtcaacgcttgagaccgttttggatttctgttagcacttgtttctgttgcccaagaagatcctttccaagacttcagcaggcatactggcttcgggaaaattcagaaactcagtgaccttgtttggaaatgtgagtgatagtgttctgggctcaggtccacacaggcctggcttgtcaggctaggacacagtgtcgataaagctgggctcatgggctttgtccccccggccgtgctctctcctggggctgcagactagtgtgtctaacctcagccaggcgcctctctactgtgtgcccgcagtcccagaggagccaggcacccaggccttatagtgcctcccaagtcagaaaacacttgtggaagaactgagagtggtggcctccttcactgggcaggaccacgatcatcctcacccctgctcccgtcctgcgctgctacgattgcaaccttttgtaggttaaactggctgtgctcatattgtatttatgtggtggggccaggggaggaagcagcttccacaaatcagcccactgaaaacagtcacttatatgggacatgggattctgcgtggagaagggctgatttggagccaggactgggtttgggttagagacacagaaagcttgcttcgctgaagtgggtgcacaggtactcagcatgcctttgccttatgcccctgacacccggggaggctgctactaagagcagagaagtctgttctatgttccattgatctgtgccatgaaagctttgctgctttaaccacacttattggggattcctggaataccagacttggtttccattcctgggcattttctagtggccattttctgtaagacctgtatggccaggctgtatcaactcacaggacagcgtgtggaaaccagtcatgccagttctgtcatcacctacctcctccaagccagcaacgtgatccaggctggacagagaccaaccttttgccttgggccatgcaggccaacagaccttgattctcacactgaggcaagaaaatagaacctcgagtgccctgacacaacccacagtgaatatggcactccagaaagagcagtcagctgcagccactgaggagacgccacagcgaggggggctccaggcggcccaaggccatggcagcctcccacaatggcagttaaccacaaagctccaggccacctagcatcccccccgtgacctgcagcctccttgtcactgatcagcctatgtgggttgcctctgagcatattgttcctttaaaaaccaaagtgtaaatgtctcacccaaaaggccaagctgttgctctgtccagtctagactgtgcctgtgaggctagcaatgccaccctccctctgtaacagtgccctggggtatgggtggcaacaggacaaccaggtgcttgtgctgggaagcgggtttttttaagagagcactgccttttatttacagacagctttatcagtacatggccatgttcctgccgaccttgaggactctttaccaaacaatcctgctgctgaatattcacttccttccacatgaatttgctcttagggattggaggaggggtggaaatgctttcaaccagtctccataatctaggcttcttgtgcacctggggtacccacaaacaaaccctgttctcactctggttttccttttcctgattaacatccccacaaacctactggatttaagacaaacccagaagtcatcatttctgctgcttctctctatccgtctatctctaagtgattatcaagccttattactgattttgctttcaccgaagccctgcttcctttcccctgactaactccttattttccattccattcatcactgtcctggttcaggtcttaacatctcttccctggacggtttcagcctcccccaactgatcttttcttgtccagccaggaatctgttactcccttaatgagggagcatcaatgagttccttttgcctaatatgtaaaaatcaaaattccttcgtgtgacattcaggacccttcatggtttgaaggacttaactttcctctgtagccctgagatttttcatggccccagcactcctctgtcctgtgctgcccgcccctcagcctcctccaccatacccagggttctctgagtccacctgcacagccatactgctgggcttgctgccgtgtccctgccccatccgcctgtccatggcggccttctcactccccttctctgcctgggagactctgactcatgctatcagacccagctcaatttctgcttctgctgtgaggctgtctctctctcctcccactagaaggaattgttctctcttatgtttctctcgtagcacttggttcataccttcatcgtgccactaggatgatacagcaattggtgtgttccccctccccacccctcctggtctatcctgtccatgtgtgtgtgtgtgtctgtctgtatatgaaatatatatctatttgttttacacacacacacacacacacacacacacacaaagtatttctttcttctcttttcattttagagacagggtctcaccctgtcgcccaggctggagttcagtgatgcactctcagctcactgcagcctcaacctcctgggctcaagtaatcctcccacctcagcctcccaagtatgtgggactacaggtgcatgccaccatgcccaactaatttttgtatttttcgtaggttgggatgttgcccatgttgtccaggctagtttcaaactcctgaactcaagcaatctgcctgcctcagcctcccaaagtgttgggattacaggcacccagccgacaagtatttcttaagtacattatgccaggcataatggcgccaggcataatggtgaaccgcataaacacaatccccgccgtcatggagcttctagcctagcaaatatttgtctcccattacactgtgagttccttgcagatgaagatcagctgtactcctagtgcctgtcaccaccccgggcacacagtggccacctcccctatgggtgttcattctgactccgatgggtagagatgggtgctagagtggaggatggggtataggctgagtatgaggtaagtggaaagcctagaaaagccacattctgccctccgtttttacaggacagcctacattttcctgtggtcagcccattcttaatgggcgcatcatcttggagccatgaggcaagttctgagacttgatctaaatgtgtcatccagatagcacagagaagtttgttccttttgacgtgtgtacaggaagctcatgcggccgcatgtggccgcacgtgtgtgtgtgtgtgtgtgtgtgtgtgtgtgtgcccattctgagaggtggatggtttggggtctggctgccctatctcgtgctgctctttgtatctttcagagatctgaaactggacaatgtcctgttggaccacgagggtcactgtaaactggcagacttcggaatgtgcaaggaggggatttgcaatggtgtcaccacggccacattctgtggcacgccagactatatcgctccagaggtgagtgcagctgcttgatgcagctctgaaatctgagctctccagtaactctgaccagaaatgccactggctgcttttatgcactgcagctttggaggcagcattgaaaggtgtctagagccgacacctctagactcatttatggctcattgggtgaatgatggctgaaaatggcctaagtccctctaataagaatttgagttaaaaaagaaaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccatgaaaaatggtgagttcatgtcctttgtagggacatggatgaaattggaaatcatcattctcagtaaactatcgcaagaacaaaaaaccaaacaccgcatattctcactcataggtgggaattgaacgatgagatcacatggacacaggaaggggaatatcacactctggggactgtggtggggtggggggaggggggagggatagcattgggagatatacctaatgctagatgacgagttagtgggtgcagcgcaccagcatggcacatgtatacatatgtaactaacctgcacaatgtgcgcatgtaccctaaaacttaaagtataataaaaaaaaatatatatatatatgtaaactttgcagttgctttgggctttagccctaaatgaagacaaagtgtacgccattcatggctatttattttcctttttgtctctacttagtgatttaatttcagcgtcatttagcagaactaaagaaaggctcttgaatccttgaatccttcccgtatgagtgagtgaacccagtccccttttttttccagactgatatatttccagaaccctttctgtttgggatctgcacgagcccatcacagtggcccaatcaggccataaatatttgctcacctagatgagaaggcacctctgagttgaccacagggaaaacagaccactctgtagaaatggaatgaaatacgcttgctagcacaggagacttttttaaaaaaactttgatatttcctaatgcatcaatttccctagttatgaagaacacatttgttaatctgatgtatgaaccaccttctcacgctgccccctttgcacagatcctccaggaaatgctgtacgggcctgcagtagactggtgggcaatgggcgtgttgctctatgagatgctctgtggtcacgcgccttttgaggcagagaacgaagatgacctctttgaggccatactgaatgatgaggtggtctaccctacctggctccatgaagatgccacagggatcctaaaatctgtaagtttggcttacccagctagcttctgatgtattgcaaaccagcttgtttcatgtgctgcttgagtcttttcagtacttcccaccagtaaaccactagctctaactaaaatttgtattgttctaatctaaagaatcaaagaaccagagttctgtcaggctgttaccctctcttatgcaatagaccctctcttatgcagtagttattttggggtcaatttcaatagcccttgataactttgtttgccaaatagcaagtatttctagcacttcgtaactttagttgagggcaggtgatgtttccccttcatacagtcaggccacaccagagttttgggtcaagtaaatgccattcccagcctgttattatatcaattgtgtttctgttggcatcttcaagttgcaggatgaagcggtcgggtctttctcttagggctgggagaggagaaggaaggttttccaaacctctgcagatctattttgcctccatgttattcttatgaaagccgggtgccacgcccaggctgcaggtgcaatgttgtaatggatcatgttgagaaagtcttttctgtgtgtgcatttaaggcactgtgctggatgcctttgaattgaggataaacatgtactggacgcctttatgttgaaaataaagtacatgtaatttgggtcagttctgtaaccacattagttgagctccaaaatcatgtattttcacctactatatgcagaggggttgtaaaggcaaataaaagatcagtttttcaagaagggataaatcagaacaatctatattctgttggatagtatctatggcataagaattactatccttaagttatatcctttcagtaatttgagacaaaagcaaaatgtgggaaatatttgctatcttgttgaaagacttgtttctctttagaaacttctagccctataatcagtgccatttcagggacattttttatgtgggtcactgtgtactggggctgaaggcttgattgtccctgagaattctctacatcgctaaaagagaaataatcacagaaatccttctgaggcaaatattaccaaagtgaatcataacacatagctcaatcctcaagctgaggtgtcagtaccctcctgaaactgagaaagcactaatttcacagaaataaaagcacagtactttgggattctaccaaatatctcctatctaacatgtttttgtaagaacagttcatttgttatattagtagaaattttagaggaaaccataaatatggcttttataattttatggaaaaaaaaagtcacagagaagggcctgtcttcgtggatttgtgccatgaagtttcttaacttcctgaagggaaatgtactcacctaggttggctgcagccaattttgataacataaaccatgataacacagcctcatcgtgctgcagacggaggcgtactttgcatgatcactttcctacttccatggcccagcacctggctttttgtaaaaaagcatgccagccttctgtggcctgcaacagccaccttcatcatactaatggttttccatgctccacatatttagtccaattactgtagctgatttagtagttttaatatttagatgaaggaccccacagttcataattcaaattaaaatactggttcaagccataaaaaaaatgcctgttatcagcattggtgtataaaggtcactaggcttggtaccatgaagggtaggaaataaaagtcagtctatgcctcaataaatttttatattctctaatataaacactggattagcaatccagatcagtgtttctctgatagataccctatgccttttgaatctaggtctagtagaaatcttaagaggccacatcaccatttgagttggacattcctaattttttgtctttacatttttagaagtcctcaacctcattctcgtgtttcagagtcctcttgagagaatgctttccaactaaatctgaaactaggtatcatccccttagcctagaacctaggacaagtactaagcaaggttaagattcctatggaatttttaagacttgtttctttttaaccgggtgagctcagttacttcaagctatatcttttatgtaaatatggatatttttggtaacgagcagatacactgtccagtaatagcctcatggtctttcctccaagaggaaacagcctctggtgcctaaggagaatcgcatccagtggagactgagttgttctctctccttgcaggttcacttttgggaagctacaagtcccttcacttctctttatttcagctcctttctcatgccagctgctccactgatggaggcagcagctgcgattgttacatatcatgcgtctagcactcattttcctaaataacactcgacgctctctctgggtatcttccacataggaaggagcaggggctctgggctcacagtgccgggcctgcctcccagtcctgttaccttctggctgagtggccttggtgagcctctgtgcctctctgaatctcagtgtccttgcttgtaaaatagaggtaataaaatccataccatagggtgattgtccagattatatgaaataatataggtaaacttcccgggcacataataagcattctgttttttcctccttcaaggcatgtaccttcaatgtaattttcttaaaaacacttaaatgttgtcagataaaattactaaaaaaaaaaaaatcactaagaggatttctgggattttttttttttttttgtgcattttactctccatgcctaaaaacaagaagcttaaatggtatagatgaaaacattcagctagtctttgcaggggactgagacatttaaatagaaatgtgatcaaagagaaaaaagaaatgttcagagcactcaagacttgaggagacacactgaggagggaaaggcatcagaattgggttggttaagaacctgcctccagagcagagctgcctgggggcagatcttggctctttgactaataggctgtgtgaccttgggcaaatggcataattcttgcatgccttagtttcctctccatttccttgggcaaatggcctaattcttccatgcctcagcaggtggggtgtacaacccacagggctactgcgtggttggcatgagataacatgtgtgggtgcctgaagcagtgcttggcacagggtacgtgcccaggaagtgtcctgcactattactgctgagagctgcatgcatgaaatgatttttttacactctgcccttatctctgaaaaagtatttgtcatattaggaggagggttcgagatagcaaggtgtgctatgccaaccactcaggctgctttctggctctaattgcaacttgatttaattaggccaatatagttattttactaccagaagaaaacttagagattgtcccttccaaccccctcgttttatagatgaggaaaccatgaggtactgagaaattgtgactcatcaaaggccatttaacacattacttaaatcaattggggcctttgtgcactgctgatgaggatgtaaaatggtgtggataatggtatggtgggaggttcttcagaaaattaagcagaattaccatatgatctagcacttctacttctggatatttacccaaaagaattgaaagtgggaactctaatagatatttgtacacccatgtccatagcagcattacgtacaatagcccgaaggtggaagcaacccatgtgtccatcaacagatgaatagataagtaagatgtggtacgtgcactctgaacaagcattcatttggctgcacagggccagatcaaggtatactgtgttctttaccaatattgacttgacgcctttttccagaattttgtgtccacctaagatcaggctttctgggagcttggtgacttcaagagttcctcatgtgaatagttgaatccattggatggtgttttgcatagttctaaaaacagtagggaaatcatgagtgctaagttttgaactgtaattatttgtctttgcccttaattttatagagctttgtgatcattagaggcataaacacagaattgtagagctggaaatagtttaaaaatattttgtccacatttcctcatctgtagatgaggaaacgggcccagagagatgaagggactttacatgttagaatggaaagaacacaccctagacctcatgtgacttctgccactgattttcagtctataaaggtgtgataataacacctatagtgcccgcttcaaataaggcagtatacatgaaagtgttttccaagtggaatgcacgatacaagagtaagtgattagtattgctaacttgtgagtagtaatttcacaacacacttagagatgtcattatcctcatcttctccttgaacagttcagcaacatcatcaaggttattaagtgcttaattttacacaaggctgtggtaggcttttattcctaaggaaattgtatttttgtttttccaggagcttttaaatcttgaccaaagacatataggtggggtgtaaatagccaaatagatattgatctgtttatttatataataggcttatatcaatgcatatgtgcatagcaggcatgggttctgcaatactcaggttctgtgcgaggtgccaggaattcagtgatgagtgaggcaaacatgatcctgctcttgtggaatttacagtccagttggggtggggagggagaaagaaattttaaagagaaattaaacattaactatatacttacaatttaatgagaaaaaaataaaatccaaggttctttgaaagcatttatttaacaggcagatctaacatgacctgggccaccaaaggaggccatctggaggagatgacatttaataaaggctgaagagaaatgaggcttgaaagtgtgcagaggtcttgagaaaggagcagtccatttgagtagctcaatggcaggcgggttggagtgtgatgagcaaaggggtggggcagtgagagcttcaggtgaggaggctgagggaacagtgagagcccaaaggacatcctaggtcacgcgaaggagtctacactttatctgaagtgccaacgtaagtctttgaagaattccaagcaagcatgagtgatgcaatcactacttcatgtgtaaaagatcaccctggctattgtataaggagtggaccaacagactggagtatttgctgattaagtgacttctaggatttctttcaaattaatccaggagttgtggggagaaacagatgaaacaatattgggcatgtgtcagtaaccatcaaggctgagtgatgagtacatgagggtctgtgttactgtcgtctaaaatttccacatggaaaagttgttaaaaccaccatataaatgaatatcttttataaacaagctcagcgtgtgtgtatgaagaaacatttctagcctgtatagaaaaagtgatctccatcttcacaaatgaagggaaatggtttacaatacaaatatacagaaagagctaatgatgtgagccacatacaagctcccctgtggatcctggccacatctcttaaatccagtctcgggttcctggcctgggagtctatgtcaccctcatgattttttgccacagacaaaattaaccagtggttttagcacaactcatttcttcagcatacctgaagagtatctatgccttctcaagaagtgtccttcaacctccagggtagtaatgaagggtaccccaaagaagcatttttaacagaaaagagaccagagaaggagagaatcctcactgttggactttgccccatgctgcctccttgggaccctgggagatcctttcccggcctgctggatctgccctttccccctgagaggcaggaagagctgagatctccaagccagaccttcacagtgcctctctctacagtcttagtgtgggaggggcatctttccatggcttcctgagatggagatttatttaagaaggaaagcttgttgaattccctcttacctttttaaatgaaaggtattattattattctatatctggggaaactggtcagacacctgtttatgttacatgccatagagttacagatgttaaagacctcagggcttcatctggcgtgatgtcagcgagggcctacattcagggttggggagggtgtgtactgtccagcattcctctaaaagtgtgtgactggcaaggcaggctccagcatcttctgaccactaatctaatattactgtccccacaggccctccctgtcatcacctttaccactgccctctccacccgcaacacccccgaggttgtggacttgtgagttctttgtgtatagctgttcaaacatttcctatagacgtgggtagtggacaaaggacttgcttgtgagaacttttcccatggagtgcagaatcagtgggtgcgggggtagcttgagcacacttagtttttagcccaggatttctacttgaaaagaattccccaaatcattaaccagtaatcgcacatctaaaagtaactttatatgcacccaaataggcacactgggaagactatttttcttgcttccccttctgtctttctcatctttgcttcaaatgtttctgctcaatacttaacgtgtgcttgcctcaaaagcagcctgacctgcgactcgcagagaatggagtattcacactggcaggatcctcagaaattaacacaaaaaaggcatatgacgatgacacacacatttgtgtaaagaaaaaataaaaggcattccagctgttatttcttaattttttttaacttggtttgggaatatatactacctgttttctggtgtcaacatgccatcaggtttcttaggctgactaaatcatcccaaaatgctgataatgatgagacaaaagaaagtctatcatttttttagggcttctgaggttccactgagttttgccctcatctaggtccagaagggcttagggaagtcccaggcgagtcagcagagctcaggaagctgaagccttgtctcagaggttagtgctcctttgctgaatcatctccagcaagaaatcacgtgactcagggtctactcaggtgaagtcggcacccttgtctttgagctcacacaggtggctgagctaaataagtgctgaaaggagctgggtgcactctcctgagtcacctttgttgactctggaagcactgtaaacttggcatcagaaggagattataaagtgcttttgttcctaagctttataaagtgtgtgtgtatgcatgtgggtttctctgtcatccagcctctcagatttcatcatccgagcattgtctgcaggaatcctgtttgcctgtacgcacaaaggagggagaaccacagttaattcggggatcctcttttagccctgagtgtgtcccacatctgtcaccaggcagtgaattccaggagcattgactgtcttcctgttcatttccctactcccctcctgggagaggctggaatgttcaaggaagccagcaaaggtggtcagccaggagaaggctggggaagaggagggaaaaatgggacccgagtaacgcagaggatccaaccccagatcattagggctggtttttcaaacactgttaggggaaatccaaagaaagttatcaaaagatccttgagtaagaggagtggttaacatgcaacctggcagactgttgccaggactggaatacctgtctgaggaaaggaaggtgccccacaggcctcttaccaaaacccctagtgaggttaacacccttcagaaaaggaaccgtttgctcacagatcaaggccagtgtctgcagaaaacagaaaaacactgctcttcccagagattttgtatttgggtctttttaagtcatataattttactaaagttcttgatctctacttctttttccctcattaaattgtaagtttcctaaggttggaagtccttacattttgatagcagtgtaaaggattttttaaaatgtatttttaatagagtactcatgctgcatgtctcatttatctccatccctgccaggaagataaagatgtcaaagcttttgtaaaatgaccacggaaacttttcctgtgtggagatttgctaaccggtgtctgtgggtcagaaaagctttttgtttcgagttagaaaaactcttgtcaacaaaagtatttgactttgttgttttttgtttgtttgtccttgccaactatcaaaggtcagtaatttggggcagttgatcattagatttggtttggatgccaaagataatgcgcatccaggataaagaagggtactggccttgatttcatcagaggaggataaaggacattgtatagtccccactagagaatctttgttcagcactcacttctcttcagtagctacatttggggaatcatacctggaaaaaagtagttcgtatagcttgggcatgtagggtagcagcagctttttcttaacacttggaagtcattggagagcattgaaatccgccccatcagtcagagctgcttgagactggtttgtcaggaatagaagcatgttgtctaacaacgggcattggcacaactgcatgaccttgggtttccatctccgagacttgcctctaacctttacctacggttaatcaacattgtcccatgaccagaaagaagatacaaggaagcaataatgattataaaacccaggaaaggcagggtgttgggagccttggaaaggaattgagtatgtgcttatgaagggctgctggattccagtcacagacagcatggaaaacacagccagcaaacccaccacggatttgagcactgcccctgcccgctagaggaacagtatagggcatttagtgtactgagtttcatcgagagaaaataaagtacactgtgtagtgtgtctctggagatatcgcacagaatattctgatgctggtcagttacaacctgccaggtaaggcactgacccaccggcattctcaaatatacccacatgcccacttcctccatcactggctcagggagatcagcttgagcaagtttatttcactttatttttaataaagaaaagcccatttcagactcaaggaaaacaaagcatctgtagctgagggaaggacaatcttcaaaatgccagctttttttttttcctcccagagtttttagtgataaatgcaaaaatagaagaaagaaaagagtcccttgatatgggcacagactgtggaggccactggtgtggccacccacccacctgacgccggacaggccagtccggctctgcttcacgtgttttcaatgacacaatgctgttcctgccagggagcactctcatcacttaatggtactgagtattacaaccacattacgtgttttagtttttcttatgatgtatttagatatgctgcctttaacttccactccctgaacttatttctccctgaaattatttctcatctaatccctcttctggccgacagctctttgagtatttgaaaattttaagtgtccttctatcttttccagcaaaaagaccctcagtagtttgaaataaaaccaggtgtcaggctgaaggatgcctcggattttttccagccctattacttttctttcccttcacttaccacctgcactgtatgtacttctcagcccttctccttccatagaatcagaggaaaaagaatgtcacatgagccagcaaagaagtacaacacaaggaaacacacagagtgcgtgaattctcatcagatgaagtcctgagtgtcatttattaggtgaaagtaaagtaaactgtgtaatgattctcctcacctgtcggtccaagtatcttaacccagaatccaaataagaagattggtagcctcaaggggaagtctagcgtagggactgagagcaaaggcctgagttcaaatcctgactgtagcactcccaaactgtgtgacaggttacagatgggtctgtttctcagtttcctaatctttaaattaggaataataaccacagttgctttaaggattatatccaatgaatttggaacacttaatgcctatgcaacaaaggagtatgcagcatacatatatggtagtaatggctaccacttcttaagctgtaacttgtatcaaacggtatcattctctactctctccactcctgcagcttcccccttctcaaaccagtctggatacctggcagggtggtccattgccatgagtgtgcaggtaactagttccagccctccccagcaaattccatccagatccaatcttagcaggatagagcacctctccttctcttggctcgtccagtattccatagcagcaccattcggtataagaacctagacttgggaagattacagtttgtttccccagagagattcaggaagtctgttgtctgtcctttccaccctaccaagccccatcccacccccagtggactgtcatcagccccatcttgcatttaaatgtctgtcactgccttctcctatggaaaagtgacttatcaatgccaggtccaagcctggtgtctctcccatactgtgcagccacatccctgcatgaccactgccctgagctggagggtgctgctagcacggggtgtctccagatctccccaacagctggcaggaggggtataaaaggagaaggttggtcttcataactgggtcagaatctgcgtgtgccagcagcatccttcagacagacacgcgcctgcaacacgcatgcgtggtgtgcttctcgtcagccccaggtggccattagggtctatggtcatggcgaggttgggcgtcatggctgtgaaccgcactctattctgtgtcctgtgctctttctctgccctttctccccaggaccctctctagagccattaaatgccttttccccatttaggatcatcgctctggaatattggcaggaaggttctgtggcatagtttccttgccttctaacttgccagcattagctgctaactctctctctgccctttgtttaaggtctgaaattgaatgaatggagaaggtcattttgtttgcccaacagccacatccaaccattaggcagaaaatacagtgttctctggctcctggaagaaaatcttattagactaattgctttatttatataacttgtcctcttcctatgaaatcagacagattttgaaagaggaaaaaaatacttgtggccattacttatattttagtgagtaaagtacatttgggcccagttatttcaagactcataatgacacagcgttaaactctataatctggaacatccaacaactcaaaactgaagctgcctcctgtgtgcccacaagatgtgataagcaccatacctgacaccagatttgcaaagaagctgctccactgcacccatcttgctgcatttagtttctctgtcctattgttaatgcagatatagttgcacattaaaacctattgtttgtaggccgggcgtggtggctcacacctgtaatcccagcactttgggaggccgaggcaggcggatcacttgaggtcaggagttcaaaaccaggctggccaacatggtgaaaccccgtctctactaaaaatacaaaaattagtcgggcgtggtggtgcacacctgtaatcccagctactcgggaggctgaggaaggagaattgcttgaacctgggagggggaggttgcagtgagccaaaattgtgcaccattgcactccagcctagacagcaagagcgagactccatatcaaaaaaaaacaaaacaaacaaaaaactattgtttgtattctcgttttaagattgtcttagaaaaggttttctgtcaggaaaaaaaaaaaaaaagttttccaaatagggtttggtggtatgtgcctataatcccagctactcaggaggctgaggcaggaggatcacttgagcttaagagtttgagaccagcctgaacaacataggaagatcttatctcagaaattaaaaaaaagcaagaaaaaggaacattattttccaaagaccattcctcccactgcactactggagcctaggacagtgaaggcagaaagagatcttgttctctcttacctggctgtagaggaacagggagagccagatgagcctcagggtcaaggctgacctcagagtgtagtctctcagcagctttctatctgtgcccctgccttttagtagaacaggatggacttacaagtttggcatttgggtcccattagggacataagcaaataatggaagtattctgcaaaagaattatgctgccactgttcacagcggtgggaacagagtgtttagggacagtctattcgagcctaggacggcaacaagatgttcactaatactatcatttcttgagggctttctttatgccaggcgctttacgttaattctctcattgactcatcataactttttaaaatataggaaaatcttcatgttagagttgagaaatctaaggctcagagaagttaagaaatttgtccacagtcacacagtaactcagtggtgaaagaatgatacaaacacaagcagtgacactgcagagcctgaccagccctccatgtcagagaagctgttagttctttcagccttccctggcttgcaggaggcctcccaggacattcctatacaaacttggcccaaatcctttacatgtccccttagaactagcgtcaggagggagcatgcctgcttgctttcccctgcagccacacctcctctgtagtctgggaaaaaaactgttaagtgtctcattctcggggccaggtgtgcctctgattccttgagtatcctctagttcagttccactgtaatgagggccacagcaggaaggggaacataaaatgagtccctgagttcttgacccttctctttcccctgctctccagtcagtttgagacttacacttggggtagaatccagattttccaccctggtcccctcactcactctgtgcagcttataaagtgcttttcttggccctagaaaacattctgcttcctttagtaaatgtgtgcagaatatttcatgaagtcacattattttcctctttggccgactttccctcttggatcacagtcagggagaaagtcagctgaggtgaggcaacttttcagtgtgaccttaaatgtggatgaaagtgatggccccgaggagcacaattgttaacttactggcatttgggtcccattagggacataagcaaataatgaaagttttctgcaaaaggattatgctgtcaccattcacagcagtaggaacagagagtttagggaaaggcctgtgcccagcctaggatggcaagctatccacctccaactccacaccatctgcaccaacgtgaactgtgaaagatttcaggcctgggactaatgttaaatgttcccttaactcctcatctccacatcactggacgggggtagtggtagaagggccaccccaccaccaccacaacacacaaagcttctacccccttagtatcaccccggaccctccttctcccggtcctggtttctgtttcatggtattcatcctcctctggcctcttcatggcatcctccagctgccactctggctgcttctcaccctacaccaggggtcaggagccatgaaagtccgtgagtgataccagccaggtgggaggtgatagggagtggtggggcatgtgactgactgggcatctggtgccccatgaaaagcagaagcccctgctcaactccaggccgtttctatgagaggagtgcaggcccagtgttcccgagtatctcattttccacgagaagttggaaaacctgacttttcatgtgatgtgacatttcctagcgtttaaatatttgagaagtaattaaaattatttcaaaacacactaggtaggccaaataaaatgtgtctgagacctagggctggtatcagttctagtctgtctctgtcactttccacaatctaacctgccctcccagcttcagtggttactcaaatttcaatgtctctgagcgttagatggccagccctggcctgcaccccagatttaccctagaattcatctgcatgtgggtgcccacacacctccaatgcaaagcggagcccatcagcctcccagatttggcagactgtaggatctcagtaagtgtgagctatttttgtctttgttccactaacaaaaatactactactactaacactgctactaatactcatgctacaaagaataatctcttgcccctcttttgttccatttctgttactcaacaccactgccccatcaggcagccagggaggaccctgtgatcttggactcttcactcccattcccggcagttagtggattgtgtttattcttccacggccctctagaatgtgcttccaactcttccttccaattaactagaaactctcctagttgctgaacttgtcatgtgttctcagctattgtctcagcctctaactgctcaccaccaggcgctacctctgcatttaagatttattcatcacgctgtggctagtgtcatcccctaaattgccgtgcagctctcatcactcacctcggatggatcccaccggctgcccccgcagttcctcagccatccctgcatgccagctgtaccaggcacttgtatgcctctgcatttgtgctggctgtgtcctcaggcgcattttcttccttcatgcctactatgttaattctgttcgtcctcatctctggtcaaatgccacctcttccacgaggctgtcacttgccttcccaccaccagccccagtgttatttgccccgtgcctcttccaagctctcacagcacttgatctaagtctcttttcatttcatccggctgtgtattatgaagtttgcttgattcttcccccttctcttgattagctcctggatgaagagacactgtctttgtcatctgcgtatccccaagaaacccctagtgtgctgccttacatgtagtagacaccttgaaaacctttgtcaattgaatcaaagtttgtttgtgtgtgtgtgtgttttgttttttcttttggtttgttttttttgtaagttgaggatggctgcatctaaagggctcaggccaaggtattaaaaacaaaactgcttggttattcaaaaggatttatcagaaccccaagaggctaagtatcaagctagtgaaagggttattctgcctgtccccaattccaagggtgcagtttttagaggacggacggtcgtgtttggtctacttgtcgtcaggcaaggcctcttccacagtgccccatggaagcttgggttcagtgccaggggcagggaggaatgggcaagcctcttggacactggggcttcagccaccctggcatatagagtcctgcactgtttgtcttgcccagaagaacaggctgtacccacccattcacaagatgtcctctctcacatcattggcaggcctgggaatttcccacaggccatctgggtgtgttctgccgtcctgtctcccaagttttttgcagcattgtttcttgttaattagctcttagaatagcaactgctcttccatcaggaattgtatcccgttgactttcctaaggcaagaatctactcatttcttttttgtaagcattttctcccttcctgcctgcattgcacaggcttacttagtgagagcccaagcagtgtgaactaactcctagctcttacagaactgagttacttataatatgcatctcctgaatcctgggtgaccactgtaagtgcctgaagtggcagctgctctgactgggcctgtgcagctctgaatgctgcatttacttttgggtcctgcctccaacccagaaccacctgtggcctttaattcctgttactaggagagaggagaagcgattaaaccctgtcagtatattcatttattagctgccctttgaagcttttttgaaagcattttacaaggtatatcccgtcaggttgcttaggaacttttgcagcctccttcttcaacattatcattttcatttgaatcaacactggcagcttgacacctctggacacctggcatggcagtgggaggtacctccaaacactgtctttccgtgtctgcaccttcaacaagattttctctgtaaattcagctccaaaacaatttttataaacacagcattacttttgtgttgttcacaaatcagatttggaaagaggtgcttggggactgtcatgagtctatttaaagataacctgatttaaataaaaacaaaaacaaaactttttatccaaggcaattttctttcaatatgggaaattaaattagcttcagtgtctttgaaattgagaaccacactccggccatgaaaagtgaattatcctgtactaatccttgctcaggaagtgatcaaaacacctttcctggctattttgtgaaagcagatttagcccagcatattttgataggagcccagcactaaggaagtttcccaactgatggaaatacagagaatctctatgcacacatcgcttagctgtgtggcagcgctcgttttagtttttggtctatggagcaatggaatctcagtcattgaacctacttcgaaacagcagtggtggggggaacatcttgaagaaaagcctttcatctagagctatgatatcttcgctgcataaagaaaagtggccaactttgttttttctagagccaggacacagaccttttcagtatgtcacctttgctgcttcttcacacagatcttcaaaaataacgactctctctcctctctgtggtctcgtcagagagcaggaatcctggccagctggtcaggtcactcagaaaaatggcacagctgtttctgaaagtagccccattcataagatgtctgctgcccacaactgcagtgttggggaaaggcacactgttataaagagcttcttttctttaaagaggaaagaaaaatacatggtgtttacagaaaagaaaactggaccctcctgctttcttttagtggccatgtctgaaatggaagtgggaaaagccataaatccacacaggcaatcgcgcctttaaggcatgattcatactgactgtgctgcctgtgatggaaaacccagctagttaagcaagacctgccagaaagtctcgcacagctcctctgccatggctgatgcctgctgtcttgtgacgtgctggttgtatgtgaatgaatgattgacactttctctctctctcactcagttcatgaccaagaaccccaccatgcgcttgggcagcctgactcagggaggcgagcacgccatcttgagacatcctttttttaaggaaatcgactgggcccagctgaaccatcgccaaatagaaccgcctttcagacccagaatcgtaagtgtcccaggctgtcacagagacattcctttcttcagatgtcacagcattccaccaaagtccgtagaagagctggatggcccctgtgggtgacagaccagaaattcagctggatactgcacagggcagcctcccctggggggaatctgggctccttgtccatgggacaacaatgtcttcatgtgcccacattaattcttaccaagtttcacccctcgtttacccaatctccaacttctctcaacctaaattaaaatcttgtagggtataagaggcctgaaactttccaggtttccccaaaagagtttggctaattgagaaagtcattgttctggccaatttcctcatgctccttggggcactttttgtgccttttctaagcccctgagaaagcagagtgggtaggagatgttgctcacttcactgagcctggcctcttggcttggagagcctgggtctgtaatagctgctgcagtgcagagcccaggccaggccaggcttctttgaccaaagaaatactgggatctccaggggctcctctccaagctctgcagctgaggctggtggccttcctgagcgtggtcccgcttgtggtctgagagctgagctcgtgctcatctgtgggtcaagagctccacaggaggaaggcagagaagcaaggctagcgatagatcaagagtgatggggagacctggcgtggtggctcatgcctataatcccagcactttgggaggccgaggcagatggatcacttgaggtcaggagtttgagactagcctggccaacatggcaaaaccccatctctactaaaaatacaaaaaaaaaaagcctggtgtggtgatgcacacctctaatccctgctactcaggaggctgaagtagaaggattgcttgaacctaggaggtggagattgcagtgagccgagattgcgtcatgcgctccagcctgggcaactgagttagactttgtctcaaaaaaaaaaaaaaaaaagtgatagagaaatatcattgattaaggtaagagcagtgagatgtgtgatactcacttagaaatgatctttgcagcgtttgtttatacagatataaaatactcaacttttaaaaacatacagtgcacttaatcactaacagcctactaggctgttggacaccaggcacccagaggtaaagccgttccttcaatggtcagccccctgccagcgcccctgggattagggagagcatggccttcagaggctggagcctgtagtcctaactgcacagctggtccagcagggcgtaacgcatctacctagagagtaaaatgaccaacagttgttccctaagctcagcacttgcaagaaatcttttgggaagatctcttcaaatgtctagaactctgcgcaaacaataggtaggacaagtgtgaacctacccaacctctgttgacaaatacagctgcacacccctcagcgaggcctgctgtgaaatgccaccttggtgaaatgagaataaagggtgagtgagccagctgcttttggatgaccaaattaattcttagcctcccattaagacaggcctgctcagcaagattttcatgggattagtgaattggtggttgccaaatgccataataatgcaccatgcagtagacttgctgtaaagcacagtttcatcataacaataactgtaaataatgctactgaacaagctacagagcactcctctgaactcactggaatgggctatatcccatgcaagatgagtaagcctcaagcgcaaaaatctcacccttgtttcccttttttttttggcagaaatcccgagaagatgtcagtaattttgaccctgacttcataaaggaagagccagttttaactccaattgatgagggacatcttccaatgattaaccaggatgagtttagaaacttttcctatgtgtctccagaattgcaaccatagccttatggggagtgagagagagggcacgagaacccaaagggaatagagattctccaggaatttcctctatgggaccttcccagcatcagccttagaacaagaaccttaccttcaaggagcaagtgaagaactctgtgaaggatggaactttcagatatcaactatttagagtccagagggagccatggcactagaaatagttgataatgaaatgagattttatgaagtataccgctccacctatgagcgtctgtctctgtgggcttgggatgttaacaggagccaaaaggagggaaagtgtgaagaataaagtagatctgagaaattctgagccaatcaggcttcttaattcaagagacaaaccaagacgttctgtcaactgtgctgtgctcttctttaagccaatgaaccccaattcctggcagtctacaagaagtctcttaatgctaatgaagaatttaaaggtctttttaaggaaatgaagggctttccaaatagaatgatttactctgaagaaacaaacaatggtatctctgaaactcacaacctaaagcccaatcttgaaaatatgttgtgcaccaagacgactgcttcagcttcttctcttatccttactttctttaatagatatttattaaactgtccagtgaaaaggtgccacaatgcccagtattgtaaacaacaggtttgcattcatgaagctttcattcattctggagtctactaatttacctgaatggtgtttgcattctgtgaaatgcctctccacgttgcatatgtcacacttttgtctgcacataactcttttttcacaagaagggtcactgccacaacagcacagtcagcgggtgaattacaggtgcctgctgcctgcctacctgggtaatctgatcttgtctgtatcgccgtgtgctcatcactgaagaattgcaggccactcatgtcagtgaccagatttgtggcttataaacattagcagtttatttatgttttaagatgcaaagatgtgtgtttgatattcactttaataattagaaatggatcttgtaaacagggcatatatcaaagatgaccttataatatgtacccgaatatacagttcaagaattttgtctgactggaaataaatgcattttgtagcaaaaggaa

SEQ ID NO: 341 - DNA, 71967 bp, Homo sapiens
aattacggccggattccggagtcctttccagctccctcttcggccgggtttcccgccgaatacaaaggcgcactgtgaactggctctttctttccgccaatcatttccgccagccattcatcaccgattttcttcatcttcccctccctcttccgtcccgcagtccccgacctgttagctctcggttagttaagggactcgggtccttccgaactgcgcatgcgccaccgcgtctgcagggggagaagcgggcaggggcgcaggcgcagtagtgtgatcccctggccagtccctaagcacgtgggttgggttgtcctgcttggctgcggagggagtggaacctcgatattggtggtgtccatcgtgggcagcggactaataaaggccatggcgccagcagaaatcctgaacgggaaggagatctccgcgtaagcacctgacattgttgttgagtgtggggctgtggacgagggctctgagggtgtgcaggtcccccggacccattttttgcgggagggacacttgtagcggaagagttaggcccataacacctgaagacctgcagccaaagaaagagaacccgggcacaacctgcgtttgcaagtggactgcctagtggctgtagccgctggctcctgtgcttcggggaaaagtcctgtgccgactatgctcccaaacgcgcagctgctggtgactttctgccgggagagtgggtagttgcggcttcctggagcccccctagtcagaactcagaaatccaatctacttaattcccgttaatttggaggtgagtagatggagactagtgaggtgacaaggcttgacaagactacaaggctgataatgacagagggtccttccagctcatagcttttcccactataccatagtcttatcatacgctaagtgaaatctaatacatttttcctttctcttcaatctcgtgcttctctctaacagccatctctctgccctggtcctagagttacttgaaacgtaatttggctcctgagtcctgagaatattctgcattccacttgacctctgcctgttctacccttgcgggacatctgaatgcttaattagtgggtatcgttgccagctttactcccaggaagtaacactggctgctttttgtctgggaggtgactggtgaggaaaaatgagagtagaaggaagagggaaaaatatattccctctagtagatgaaggagggaaagatatattctgtgtgaccttactgagtttgctcttgggacctttcacatcacccgttatgtaagtaactgttgccagccacagcagttactaaattgtaattgtcctgtaactcctaactttgtaataggtttttgagtgaattacaaagtcatcggtggtgaaaagtccgggcccagtggctcatgcctgtaatcccagcactttgggaggccgaggtgggtggatcacctgaggtctggagttcaagaccagcctatccaaaatggtgaaaccccatctctactaaaaatacaaaaaattagccgagtgtggtggcaggcatctgtaatcccagctacttgggaggctgaggcaggagaatcacttgaacctggggggcagaggttgcagtgagctgagatgcgccattgcactccagcctgggcaacaagagcgaaactccgtctaagaaaaaaaaaaaaagaaatcacaatacttactgcttagtgcttttcaacatgtggcttgctaaactgtatttctgctttactttctgtttttgtttgcttgtattcaaacttacttccttttccagtggctttttgttttaatataaaaatcttccttttagaaagactgattgtgaagagataatttagtgcataataatagtgcagataatttagtacaataataatgcatctgggccagtactgagaataggtgctcactgaatatactttcgttaattggagagcaaattaaatatgtttatcaactccataagggcaaatacatgtattgtcttatttttgtctatatcctaaacacctggaaaccctgtttcctgccttactacttgtgtggttttaagcaaattaattaacctttctgtgccaaagtttcctcaaatgttaagtaaaagtaatgtctaggtcattgggatgttagtagaattaaatgggttcctaacagatgatcatttataattcttcctggcacataataagtattcgatatatgttgtattaataatcagtaattagttaatgtatatatgaatgattcattatctttttttttttttacatggtagctgctgccttgagatctatttttttttttgagatgaagtcttgctgtgtccaatcttggctcactgcaacctctgcctcctgcatacaagcaattctctcatatcagcctcctgagtacctgggattacaggtgcccgccatcacgcctagctaatttttttttttgagatggagtttcactcgtcgcccagactggagtacaatggcgtgatctcggctcactgcaacctctgcctcctgggttcaagcgattctcctgcctcagcctcccaagtagctgggattacaggcgtccgccaccatgtccagctagtttgtttgtttgtttgagacagagtttcactcttgttgcccaggctggagtgcaatggcatgatcttggctcactgcaacctccacctcccaggttcaagcgattctcctgcctcagcctcccgagtagctgagactacaggtgtgtgccaccccgtccggctaatttttgtatttttagtagagacgggctttcaccatgttggtcaggctggtctgtaactcctgaccccatgtgatccacccacctcggcctcccaaagtgctgggattacaggcatgagccactgcaccggtcctagaatttcttaaaaatccagcccacttcccacattccatcctgcggattaggaaatcatttgaggccagaaaagtgatgtgatttgtccaagggtgaatggcaatggctcaactaaaactaaggtcttcacccagtatatgatgtttttcattctaaccagcacttactacttgctaaaaggaatttcgtaagcttttctttttcttttctttctttctttctttttatttttcagacaaggtcttgctctgttgctcaggctggagtgcaatggcacgatgttgtctcactgtaacctccacttcctgggttcaaacgattctcctgcctcagcctcccaggtagctgggactacgggcatgcactactatgcccggctaatttttgaatttttagtagagatggggtttcgccatgttggtcaagctggtcttgaactcctgacctcaagtgatctgtccacctccacctcctaaagtgctaggattacaggtgtgagccactgcgcccccgctggcgctttgctttttctttacagtcttcctctcattagcatgtttcccaccctgctgagaatgctatccctgactcgtcctcttctattattattctccttttatgccttcctgggagctcggacatcaacaaagttcagcattccagattccttctctacctgctctactctgtgggaaactgggtacttacatgatggatttagttgccaaattatctttctttggaagtaacagccccttttctccctcacggggaattctaagtttgcagcctgaatttgacaaccgggggaaggtctgagagttagagacaagtatctgttctttgtgggtatttattcacttactcaacaagtagctgtatgtgtcccctaagccaggcaatcttcaaagctctgagagtctaatagtgaacaaaacagcccaaatccctaccctcatgaaacttgcatactgatgggtagagacagacatttaaataggtgaaacacattgtgagctggtgggaagcacaaagagaacaccagagcagaaaagagggacaggagtttctgtggtatggtggctgcaattttaaatatgggagtcatagtctttgtaaaagtgacttacgggcaaagacttgaaggaggtggagccttaagcctgccaatgttgtgagggaaatagctcctgaccaaaaacacagcctgtgccatagacctttgtcctcaccagttactaacttactgctttggggggtcaatggcaatggccctgtgagaagctgaccgagtggaggctcctgagtagaggaacctgaccctgccctgggcagaagggtggtgtcttttaaaagattatgcaaagtgggagaaggatgtgcattagtgttggaagacccaccttgctttgtaggcaagaaagcatagttgttctataagtgggcctttcaaaggggggcttactacatttatatgatttgtttggtttttccttcccttagtttgctataattaagcctgctctctccattggtggcatttttcttgattaagtctcctttctaaagagactggttgtgaagaggcagatggtttgagtaggtgctgcgagtgtttgctggccaagtgcagggcaagttgggtatatttgtaagctcgctgtggatggtagctccagagcctaagcacggtgctgcctcctctgtgcatcactgggtcatgcaatttacctctgtgccttagcttctgtatattggggtagtaatgtcacctaactcataaggttgttagaattaaatgagtttaatacctataaagcatttagagaagttgttggtacatggtaagttttaataaataggtacttagaaagtactcattgaataaaaaagtgatgtttgtgtttatccaggctgtacctttgggagctggcttataatcttgagacttaaaattagaatttatcctagtgatcaaagataaaagtttggaaccttggctgtacatttagctacagggctagaagaactgtttttgtgaaaataatttgcttaccatagtgaagggcaggtcttcttggttactaagttaacatggataagacttttactttgtcctgtagattaaatacatgtaggcccttttgtgcttaaaaagatttgtctgggcagggcgtggtggctcatgcctgtaatcctaggactttgggaggcccaggcaggaggatcacctgagatcaggagttggagaccagcctgactaacatggtgaaaccccatctctactaaaaatacaaaattagctgggcatggtggcccatgcctgtaatcccagctactccagaggctgagacaggagaatggcttgaacctgggaggaggaggttgcagtgagccagtgagccaagatggcgccattgcactccagcctgggcaacaagagcaaaacttcatctcagaaagaaaaaaaaaaaaaatttgcctgtaatgaactccaaagtgcaggttgctcaaaagttacatggaaacttgactgtcatagctggattgattctggaagcctgtgcaggagaggtcggagttccagagaggctgggaccttcagctaggaccccagccaggctgttgggcaggttgcagcgatagtgcagcagagcccagagctggcagccaactactatggtcatggcacctgattggggatgtggtttgcaaataagtgtctgtccttgtccatcaggggagttgggatcaggcagtttgggatttgggtagtggggttttgagcagaggtctgtggttccctgttacatcccctatttgcatgaagaatcttctagaaggaaagctggcctagtacagaggagggtccttggagtggaagcaaatggctcccttctcctctaattgactcagtagaggttggtagaatagaggttaaggggcagggatgcttgtgtggccttggaaaagttagcttcactttcctttctgtgcagtagggatgatgagaactgtctacttcctgacgttgccccaaggattaaaagaatgtaagactctcaaaacaagcttctttgacgtcccatccacagtgcagaaggcccccattacccctgcactgtgcggttggctctcctttgcaccccttaattgaccaaaaagcagcttctgtcaccctgtaaatccttgaccttgaagaagtgggtggctaaaggtgccacagtcaagattcctcagccactcggctactacccttaccctcaattttgcagtttatgacactttagccagaagctaagtgacttgcccaggtgttccaaggtaggtggcagaggctcgatggtgcatttctttccctaccatgggcttgtcattggcttgctagaaggaattgcaaacttctaccctccagcaggagacaccctgggtttggttctccctgaggcctttccattgtgaggaaatcattccacccatcagtctggttgggaagcacccaaacagattctcttcaaaaagtcatttttgaagttatagtccaattttgactggttagagacaggtcagacctacttactttgctggctaagctttttttttttctttgcccctcaccacaagcctggacgggagacgtactgcttggtatctggtgcttgagaggtcccaggagataagggagcatttctgtgaaaggttttgccagagcctgtcaggaacttaatcttgactgcaatgaatgacttaacattataagtgatctttgggtttaggtgcccaaataccagtccctccttagtaagcagccttttagacctaaccttttctacctaaggttttgttcagtctttttgaaaagcaggaaggccaggtccttgtgaggcttttctcattacaagctcttggcaggttcttccctccaagtggagaacccttaccttccccattctttctaccttcccctctgatgatccagagggctgcaagggacctagagctgttcattggagccctagtcagctctagcggccagatctatggttaggtaatcctccaatagtgagactaattctcagtgttagaattaggggtctgcctgttctcaccagcagacccactggcatcaactctcctttgttgacatatagttaagcaccgcttcttacagatcctcatactcagagccaaccttgtcttgtctcataactcttgctactggcagaaggtgataaaattgtggcctagaggccaaatgttttttgtttggcttacagaattagattacttctcaacacatttattactttacaacattagattacttcttaacacacttatgcctgtagttacacataaaaatctggatgcttgactttttgaaagatgtgaacagtttagcaatactgtactgtctatcttcatgccatcaatttgttggatctgagtagatgctgcctaccccctcatccttgagtgggtgggggtgggggaggtgggacctcattgttcaggaatcctaccacacttggttgcctgtaccaggactccgaaggttctttcctctttgagacctttttctgaatgaacttatggtccacttttaaaatcctaaattttataaagccttaaccagtccaacctagtccgtttattgcattagatcagaggttgtcaaatggggcagttttttcctccctctacctcagggcattgggcatgcctggagtcttttgggttgtcatatggggaaggggtatgctattggcatctagcagtagaggccaggactggtgccgagcatcctgcagtgcacaggatagtccccataacaaaggatgatctggtccaaatgtcagtggtgctgagatcgaaaaaccctgatcaagaagcttaatgtgagttattgtgtcattgtgtgtgtggattaatgatggactttaccctcactaagaattataggattcattaaaattttacactattctgacttattttcatgtcataaatatcaagcagtttacctttgctttcttagggctttgagttagagacaattggatggaagaactttacattataaactttcaatgaagcataaaatagcttcctcacattaagctttcaaatacgtatttgaggtaactgtcaaatttggtaaatgtctgggttaaattataataatttttttagtaaatattcttatgtaataatagtactattgtcagttgactgtcttgtatactgatatagcttttgctatattagtgataggtgaaaatcagttttctttcaacaagaaggtaatttagtgttttaatttgacttaaatgactagcaatttgaaatatatgtatttcttggaacactaggtggccttacaatcacaattatttttacaaggaactacatattaagtttttaaaaattttttgaaggtttttttttttttttttttgagatggagtttcactcttgttgcctaggctggagtgcaatggcgcgatctcggctcaccgcaacctctgcctcccgggttcaagcgattcccgtgcctcagcctcccgagtagctgggattacaggcatgcgccaccgctcccagttaattttttttttttttttttgtatttttagtagagacggggtttcaccgctcaggctgtgtcaaaccccccagctcaggtgatccacccacctcagcctcccaaagtgctgggattataggcgtgagccaccgtgcccagccgaagtattttttagtagtataaaaattgttaatgaacaaatgaaataaatcaacaaatgaacaaaatgggaataaaacatattaaataaaacatttgtgttctgcattttaaaaatcttataatagctgggcgccgtggctcactcctgtaatcccagcactttgggaggccgaggagggcagatcacgaggtcaggagatcgagaccatcttggctaacacggtgaaaccccgtctctactaaaaaatacaaaaaattagctgggcgtggtggcgggcgcctgtagtcccagctacttgggaggctgaggcaggagaatggcttgaacccgggaggcggagcttgcagtgagccgagatcgcgccactgcactccagcctgggagacggagggagactgcgtctcaaaaaaaaaaaaaaaaaaaaaaaaaaaaaaaaaaatatatatatatatatatatatatatatatatatatatatatatatatatataaaaaacagtaatctattggggcaggggataaattgtgtccttgtttagaagaagacttttttttttttagaagaagccctgttgtttttgttgttgttatttgtttgtttgtttgttttgagacggagtctcagtgggtcgcccaggctggagtgcagtggcgcgatctctgctcactgcaacctctgcctcccgggttcaagcgattctcctgcctcagcctcctgagtagctgagactacaggcgcgtgccaccacgcctggctgatttttcgtattttttagtggagacggggtttcaccatattggccaggctggtctcgaactcctgacctcgtgatctgcctgccttggcctcccaaagtgctgggattgcaggcgtgagccatcatgcccggcccgaagccctgtattttgaaggtgaatgtttttgcttcttctctgatcagttactaaaagtgttttccctgtgccatttgagaattatttgagaactactctaagcttatggcacatttcagcatttttgttgtctaaaggcagctgtattttaatcatgtaaatttcatgctgcctcctttgcctaccatatagcttctgttgaaatgtccatgttatattttattttatttactcatttttctatatccataataagagttaaaggttatattttagcaatgtgtttttttctctgtcataacatgttaaatattttaaattcagccatgatgttaaacagagtgaattggaatttctaacggatttcggcaggaatgattatataagacttagggccaaagagagcctgggtgactgtgtaggggtattaggctatgcccagcaccacatctggttgtcattcaggggagcagctagggctggaactgctggggagtgcaaactgcagtattccctgttcccttgtctcagagcagaattgtggcctctatccaggtccaatcccagttaaaaaaaaaaattccaatggtctattcttcttttgagctatattattgtagagaatactgacttgaaaaaacaaagtcactaactagaaataaaatttgaactgggtgcagtggcttataactgtaatcccagcacttttgggaggccaaggtgggaggatcacttgagctcaggagttcaagatcagcctgggcaacatggcaaaatcccatctctacaaaaaatacaaaaattagctgaagtgtggtggtgtgcacctgtagttccagctacttgggaggctgaagtgggaggatggcttgagcccaggaggtggaggttgcagtgagctgtgattgcatcactgcactccagcctgggtgatagagccagaccctgtctcaaaaaataaaataaataaataaaaatcaaaataaataaaatttgaaaatcttgggtatgacttctttcttgtaccattcaacattcttgatgtttactaggccagtccaaataatctatttcttgtgtgcctgtttatgtcagttttttgtgacgtgtggagaagtggaactgggagtaaccaaatcagaatgaaggaagagctgtttgtgaatgtccatatgacaaatgacaaaactggttttccaagagggacagagcatgttcaagttgaacattgtatcatatatcataactgggcaaggttgagctattcagatatgtatttatggatgtaatttcatttacttgacatcctagtgtattgttgagaagttgtatgttggtaaattgatcatcttagttttgcaagaggttatactttctttcactctaataaggagactgcaggaggttatacttttagccttgtgttaaattctttgtaaagaaaattcttttgtgaattagaatataatttgtaagtttatactgaatttggagtgggattcattgatttatcattcaaccttatgtggatacgctgtggtcatcttactagtgcaggttgagcaaaaggtgtgtgcttgagtttgttcctgtaaaatttttcatgacagcacctggagagtggaaatgtgaaaaaagatgagcatcagcactttctagaagtgttggtctaagttttcatttatttactatatgattttgaatgccatcaactaatacattttcaattatccctgaaccctgtggctcagttagtgtcagtgggagtaagaaaagatccacgtgtccgggaacagtggctcacgcctgtaatcccagcactttgggaggttgagatgggtggatcacgaagtcaggagttcgagaccagcctgaccaacatggtgaaaccccatctctactaaaaatacaaaaattagccgggcgtggtggcacgtgcctgtaatctcagctactcaggagactgaggcagcagaatcgcttgaacccaggaggtggaggttgcagtgagcagatatcgcaccattgcactccagcctgggcaaaagcgagtccccatctcaaaaaaaaaaaaaaaaaaaagaaaaaagaaaaagattcacatctacttgaggcctggaaaattgttgggaagttcctgtacatattaaaccagataatgtccattcagtggtgtttttattttattttattttattttggagacagtcttgctctatcgtccaggctggagtgcaatggcaccatcatagctcactgcagcctcaacctcctgggctccagccatcctcctgccgcagcctcctgagtagctgggactacaggggcctgccaccactcccaactaattttttattctttgtagagatggggtctcactatgttgcccaggatagtcttaaactcctgttctaaagcaatcctcttgccttaggttcccaaagtactgagattacaggcatgaaccattgcctgctcctggccagtgtttttgatttaaaagagaaatacaggccgggtgcagtggctcacgcctgtaatcccagcactttgggaagctgaggtggggggatcacctgaggtcgggagttcgagaccagcctgaccaacatagagaatctccacgtttactagaaatacaaaattagccaggcttggtggcgcatgcctgtaatcctagctactcgggaggctgaggcaggagaatcgattgaacctgggaggtggaggttgtggtaagctgagatcgcaccattgcactccagcctgggcaatgagagcaaaacttggtctcaaaaaaaaagagaaatacaggccgggtgcagtggctcacgcctgtaatcccagcactttgggaggccgaggtcctagatcgcttgagcccaggaattcaagaccagcttgggcaatggtgaaacccatctctaccaaaagtacaaaaattagccaggtgtggtggcacagacctgtaaagtcccagctactcaggaggctggggcgaaaggatcgcttgagcccaggaggtcgaggctgcagtgagctttgattgtgccactgtactcccagcctgggtgacagagcgagaccctgtgttaataaacaaacaaacaaataaaagagaaatacatctaataatctgcatcacttatttgtgcttgaaacattcagtgttaaccccaccctttcctttttctctaggcaaataagggcgagactgaaaaatcaagtcactcagttgaaggagcaagtacctggtttcacaccacgcctggcaatattacaggtattatgatagtgtattttcattaatgttgtctttgcttgatttctcagtatcatttcagacctctccctctactttcctcctttttttttggctgttgtgtaatctcatgccttttcagtctctcttggcaggctcccccctttggctcagcttctaaatgttggcatatcctggccctctgctcttctctgtggataccctttctctaggccagtgtctcttaacctttggtcttagtagggcccctttacaatcttttttttctttaatttaatgtatttatttatttatttacttttgagagacaaggtcttactctgttgccaggctggaatgtagtagtgcaatcatagctcactgtagcgttgaactcctggcttcaagcagtcctcctgcctctgcctgccaaagcatgggtattacaggcgtgagccactgtacctggccccgtttacactcttaaagatgtaagacctcaagaagctattgtttatacagatttatccattaatgtttactatattagaaattaggaagttttggccggacacggtggctcctgcctgtaatccagcactttgggaggccgaggtgggcagatcacctgaggtcaggagtttgagaccagcctggccaacatggtgaaaccccatctttattaaaaacacaaaaattagctgggcgtggtggtgggcgcctgtaatcccagctactctggaggctgaggcaggagaatcacttgaacccgggaggtggaggttgcagtgagccaagattgtgccactgcactccagcctgggcgacagagagattccgtctcaaaaaaaaaaaaaagagaaattaggaagttttaaaaatgtttattcatttaaaaatgccaatagtgagctcatttattatatgttaacataaataacattttatggaacaaaaacttttttaaaaagaaaatttagtgaaaagaggggcattattttatatttgtgcacacctctttcctgtatggcttagtagaagagagctggagtcctatctgcctctgcattcagtcttttgctgtgtgctggtttgattgaaatatatggagaaaatttggcttcatacagatgtgtagctataaaagggaagaatttttttaacagtccttccaggtaattgtgggtatttttctttgatgttgtaccaggactcagtaagtaaattttaaaagattagttgcaatgtagaatctgaaactctatcagtgaactttgatactttgttacatcttctcagacttgcacactttgttacatcaaaatgttacatttggaatgaatatttaccccatgcatggttttgtaacatcctttgttcctcatttggaaaataatagttcccggaattatgcagatcttccaaatgttaacatttcattatgcaatatgaaagaattggaatcattaacatcaccaacaagctcatcagagaagttttcaagtattgagaagctgtcaagctcacaggggtggataaaaaattttaattttcacccaaaaactcacattttatcattggcaacaaatacaattaattgtttcccttgaaataccagtttcactttattcatttttgagaaaatatttgtcaaatactcaagcctgaataatcattgcttgtcagttgttatttcaagtaggtgtttcatataaaaatgcatctgtttcagctaacaaggcaaaaaagcacaagtgcagcctggacaacaaagtgagatcccatctccacaaaaaaattaaaaaatgagccaggagtggtcgtatagaggtgtggtcccaactacatgagagggagacaggagatcacttgagcccaggaagtcgaggctgcagggagttgtgttcatgccactgtactccagcttaggtgacagtgagatcctgtctcaaaaaaaaataaaaataaaaataaaaaagcactaatgctttagtaacaaccacaaccactgtacttctgtatatagcagaagtgcattatgagtgcttcccaattccttacatagactattaaaaacacatgcactcaagagttgaggtttatttatatatatatattttttacttttttgggacagagttttactgttactcagtgcagtggcacaatcttggttcactgcaaccttcatctcccaggctcaagtgatcctcccactcagcctccagagtagctgggattacaggcatgcgccaccatgcctaatttttttttttgagacggagtcttgctctgtcgcccaggctggagtgcagtggtgcaatcttggcttactgcagcctccgctcccagattcatgcaattctcctgccttggcctcctgagtagctgggattacaggcacctgccattgcaccctgctaattttttttttttgaaacagaatctcgctctatcccccaggctggaatgtaatgacataatctcagctcactgcaacctttgcctcctgggttcaagtgattctcatgcctcagcctctggagtagctgggattacaggtgccacgcccagctaatttttgtaattttagtagagatagggtttcaccattttggccaggctggtctcgaactcttgacctcaggtgatccacctgcctcagcttcccaaagtgctgagattacaggtgtaagccactgcgcccagccttaattttttgtatttttttgtagagtttttttttgccttgttgccctagctggtcttgaactctgggacccaaagtgatcctcccattttagcctcccaaagtgctgggattacaggcatgagctactgcgcttggccttaattttttgtatttttttgtagagacggttttttgccttgttgcccaggctagtctccaactcctgggctcaaagtgatcctcccgccttggcctcccaaagtcctgagattacaggcatgagccactgtgctcggccaagttgaagtttaagaaaattaataatgtatatttcttcatcaagggtggtcctagtgaaactggcatttagttttactgggagtgtgtggtagtgaaggataccttgactactagtccaaagccattgtcttgatttgtgctggttcactagtagtcttacacaccattgcttttgcaccatcggtacagacgttaacacaatgaaaaaggcaaacaacattgtagtggtattattatgaagctagtctggccctcataaatctttgaaaaggtcttggggtccctcaagagtgtgtgggccacattatcagaaccattattttaggcagtttcatctatcaggccagtgacttctaaatctagatttcttctgagctccaggctcttggtctgggacaccactggtttccttcccaccttcaagtctcctttgcttgttgttgctcatcaccctaatacctaaaccatttgaatgccttgggctcacccttgagatctcttccccatcttattctttccctaagtaacctcacccagtcccatagcttcatgagggaatgcttccaaatttaggtctctatccagtatttcttccctgagctccagattcacccagtagggagatattcaatacatatttttacggacaaatgtatgaaggaatgtttgcaatcttgatttggatgacaggaaactcacggctttcatttgaaactcccatcagagtttcacccaagttggacatagtctccttctcaatctctttatttgtatgtctccaatagatcatttaatcccttgctaaatttctatcccttgttcatcaagaatgtcaaggtgggcatggtgcggtggctcatgcctataatcccagcactttgggaggctaaggcgggtagatcacttaaggtcaggagtttgagactagcctggccaacatggtgagaactcatctctactcaaaatacaaaaattagccaggtgtggtggtgcacacctgtgatcacagctactcaggaggctgaggcaggagaatcgcttgaacctgggggacagaggttgcagtgagctgagattgtgccactgcactccagcctaagactccgtctcaatttaaaaaaaaaaaagtcaaagtgaatagtacttaaatattcccctctcctcctctgctgtttgtctaagagggcttagctgagaagaaaagcacagaaggcctgtcactctctgcctggcatgttctctgctgtggtggattttcccttttttgcaaattactaagaatcaaaagtatatattgtgggtgtatactggtacatttggtggctggttatttcttggcttatttttgcaaattgtttgttgtagaaagagtaaatgtcataggcaagaagtataccctttttaaagcaacattgggggtgttttttttcctccattttaaaaactgacttccaaccttgttttttaaatttattgattacaaatgtttttattacataaacactgttctacagctcgtctcctacgtccttgctgataaaacagtggtagaatcttttaattttgtactttagcaccagagtcaacagctttctgtgatacaaggtttatataatatgttgtaatcacatctccctgcctcagacctctagtctttttcgctgtggtgctggcaccaccatcttcccacattccctgagctagaagcctgaggccgtctccttaggagctctcttcctcactccctgcatccagttaggggctattgtcctattgattgtgcctctcatcaactcttggaatctgttgcctccccttgattcctatttctcccaaccctggggccactatagttacctgcttaatgatttggggttctatctatatacctcctgtctgtcctcctgactgcaattgcaatccttgttaaaatgcaagtctgatcacaatctatccagccacactcactctccatcctttaccagaatgatagtacaagttgagtatcccttatccgaaatgcttgggacaagagtgttttagatgttggaatctgtatatacatagggatgagatccaattctaaagcaaaatttatttgtgtttcattatataccttatacttgtagactgaaggtaattttatatatatgtgtgtgtgtgtatatatatatataataataattattattattattattttttttgagactgagttttgctcttgtcacccaggctggagtgcaatggcacgatctcggcgcactgcaacctccacctcctgggttcaagtgattctcctgcctcagcctcctgagtagctgggattacaggtgtgttccaccacgcctggctaatttttgtatttttagttgagatgagatttcaccatgttggtcaggctggtcttgaactcctgacctcaggtgatccgcctgcctcggcctctcaaagtgctaggattacggacatgagccactgctcccggccaattttatatatttttaataatattttgcatgaaatgcacttttaactgtgttttgactgtaagccatcacatgaggccaggtgtggaattttctacttttggcgttgtcagtgctcaaagtttctgattttggagcattttttatttgtggttttttttttttttttttttgagacagggtctcactctgttgtccaggctggagtgcaggggtgtgatcacagttcattgcagcctggatctcccaggctcaagctatcctcccatctcagcctcctgagtagctgggactacaggcatccagctaattttagtatttgagacagaatttctccatattgcccaggctagtctcagactgagctcaagtgatccacctgccttggcctcccaaagtgccgagtcaccgcacctgactgattttggatttttgagttagggatcttcaacctgtactacttatatagagtgtctacaataattcaaattgtttgtttatatttctaatcgttctatgttttatactaccctacgatgtaggagatgtccccttatagccatagtaactcatgctcaaagatcttgggtagcttgcccaaagccagtcaggaagggactgagtctgggaaatgaacccagatctgtctctaaaacccatttgttcttcccctttgttttcctaattccttagcaatgcattcaagaacattcatgatctggcccaagtatatatttaaaagttgagttttcatttttttttaataaagtggatgagtaacttcccaaataactgaatatttataggaaattaagacttgacttttcattataagagatactaatgggctaggcatggtggctcacgcctgtaatcccaccactttaggaggccaaggcgagtggattgcttgagcccaggagttcaagaccagcctgggaaatatagagagactttgtctccaaaaaaatacaaaaattagctggttgtggtggtgcttgcctgtagtccccactactgaggaggctgagctgggaggattgctcacgcctgggaggttgaggctgcagtgagctgtaatcgtgtcattgcactccagcctgggtgacagagcaagactttgtctcaaaaaaaaaaaaaagtttctggtaaggtgatagaaatacagcctcagccccatagcctcattagtatctctcactctctctcttttttttttttttttgagtcagaatcttgttctgtcatgcaggctggagtgcagtgatgtgatctctgctcactgaaacctctgccctcccctgtcccccaggggatcctcccaccttagcctcccaaatgagctgggactacaggcacaccaccatgcccagataatttttgtattttttgtagagatggggtttcgatatgttgcccaggctggtctttaactcctgggctcaagcaatccacacaccttgacctcccaaagtgctgggagtataggcatgagccactgcacctggccaaaaaactgatttttaacagtattcgggaactattcagagtgctttatgtatagtaactcattcagtcctcacaaaatacatggacagaatacagttaataaactcaactagcctgtatcttcataaggttttctgaaacagaaagaaaaatgaaccagtagaccaatacccaagatatcttacggtgtagaacacagattagtaaactgtggcccgtatccaaatgctgcccagtttataaagagttaaaaaagcaatagcagcagctgctgtgacacggtatgtgtcccacaaagcctaaaatatacaccgtctgcccctctacagaaagtttgcagactcctggtataaaaaaaaagtgtccctaacctgttctggaataggatcttttttggatgatgtagtactcagccaccttcaaggagaaatcagcattcttttttttttttttttttttgagatggagtttcactcttgtcgcccaggctggagtgcaatggcacgatcttggctcactgcaacttctgcccccggggttcaagggattctcctgcctcagcttcccaagtagctgggattacaggtgcacaccatcatgactggctaatatttgtatttttagtatagatggggtttcaccatcttggccaggctagtctcgaactcctgaccttaggtgatctgcccgccttagcctcccaaagtgctgggattacaggcgtgagccaccatgcccggccagaatacacgttctttaaacattctttttgcatctagtctatcaatggttctataaccactttcccctataaaatgcctatactggccaagtgtggtggctcacacctacctagcactttggcaggctgaggcaggaggattgcttaagcccaggtgtttgagaccagcctgggcaatagagaaactccatttctacaaaaaatacaaaaattggctgtttgtggcagcgtgtactggtagtcctagcttcttgggaagctgaggtgggaggattgcttgagcctaggagttgcaggctgcagtgagccatgatcatgctactgtactctaggctgggtggcagagtaagaccctgtctcaaaaataataaataaataaataaaacctatactaagagtgactctttgaattggcttttagatgtcttttccaataaaactttgacatacgctcataactataactattaagttttctttctggaactggttgtagttttagtgttttagacaaactccttcagaaatattcaggccgaaaatagttacatgtaaaggaacaacaacagcgagagacttcagacttctcctgtgtgacattagatgccaaagacaacatctccgaaggaaaatgctgtcactccaaatcaggcaaggccagtcaagtgcaagggacagcagaaaaatattttcagttatacagacttagaaacatgtccacctacctttcctggaaaactgacttataagttacatttcacttacttgaaacatgaatgaagataaattctagaacagagaagttgtggcttccttactggcagcaagtgataaaacaatttaatctcagagttaagactaaataactagtggtaggtataaatatgaatgaaattgtaaaaaaataatacttttgtatttagaaccacctcctttcctactttgatctaaaaattccggaatgtatcaaatctggtaactgaaccagtgagggttgggtggtggggcaaagaacatacatagaaagtgaccaaagaggaaacatgagaggcacgaaaagtctagggaagcccctacgagaagcatctaatgtacttagatacaaataacccattaaaaaaaaaggtagaattcccctcaaaggactcttctggctcttgcaattcaaattagcaccacaaaactgagaactgtctgtataagggacaactgaagctaagattcaggccatgtcctgagatctgaggagagcgtccagtaatagcaccaatatgacaagctcagaaaatcctgtgttacaaaagccggcttctttctctgccatggtcctgttaaaaggagctgtgcttcagttgtctttgatatgaagggaccaccacctttccctctgtgataccctctgcaattctgggagaaacacaacttatggtagcatgtatcaaccttgagaaggagaaataccaaccactggagcatgaaacaatattagtacaataaaattttacaaataaatggttataatgataaactataaatatgttcatggtcaaagaaacagagggaacatagtgagacactgcatggtggttcaaaggatttagcctctgcactacaagtttctccctgtctctctcttttttttttaagagacaaggtctctctctgttgcccaggctgcccaggcatagtaccatgactcactgtgcactggtgcaatcatggaaaaactcttgacctcaagtaatcctcccaccttggcctcctgagtgctgggactacaggcaggcaccactatgcctggctaattttttgtaaagatgggggggggggtctcactatgttgcccaggctggtctcgaactcctgggctcaaacgatcctcctcccttggcctcccaaagtgcagggattatagacctgagttgctgcacccggcctcctctctgtgttggggccagcagattgccctttgtcttgcctggctgtttattctgtgtaaactagagggaggtccttccaccctcctttctattgtctgtgtggcggggccagggagctttccattgcccctgcgggtgggggagagggtgtggaatgtgccctctgggtgctcctgcctctcaggcatttttcttgcctgatgacagtttctcagccctccatactctgtttttctggtatggcagcagaaatcccacatgtttctagtaggcctgcagcatccttgcttagtttccagtgcagatgcagatatcctctactttctgtttggggtttggcagtgggaaccaggtgggccttgtttaggggaggggctgtaacaccatctgtgttcacataatccctcctgcccccacagcctccctatactcctgtaaaagttctctgcaacaagagtcgcatgattaaacatttcttttattaaaactaaaattgtagaagcttttctgtgcactttgcctttccctaatcatctgatttgcatgcatttattattctaggttggcaacagagatgattccaatctttatataaatgtgaagctgaaggctgctgaagaggtaacgccagaagagctgtgccatcaccctccccaacctccacctgggtcctatcgattaccccttgccctttttggtcctccctgtgaaaacttttatcacccacaggagacattagtttatctattttgtaagtcagaaatgggtgggttagatctgtggcctctggtttgcccgtgagtttttgttttctcattaatgattttcttcccaaagagcaggatgtcaattgaggaaagtgacaagtctcgatcattttaggagatttatttgccaaaattaaggacacacctgggagacaggtctatacctttctccgaagatgatttcgagttctccaaatttaaagaggaaagggtgggttattgaaaagtacacgttttcatgtaagaggtgggtagggaaaaatagtcattcatgaccttctctggctcagtgaatctgcattttttacataagatgacagatggccggacgcggtggctcacgccagtaatcccagcactttgggaggccgaggcgggcggatcacctgaggtcgggagttttagaccagcctaagaaacatggagaaaccccatctctactaaaaatacaaaaaattagctgggtgtggtggcgcatgcctgtaatcccagctactcgggaggctgaggcaggagaatcgcttgaacctgggaggcggaggttgtggtgagccaagatagtgccattgcactccagcctgggcaataagagtgaagctccaaccagaaaaaaaaaagacgatatagacaagtggggcagaggaaaaatgcaggcaatctgcattttacataagataacatagacagaattgggcaggggaaaaatcagatatacatttgtgtctggtgggctggggggatttacattgccatggtgaaattttaacagaaacatcataaagatgttgcagctcactacgaatttctttgtgggcaaaatatgggggaggcatgtagcttttcatcttgtaacatcttatttaggaaccaaaaagggggaggcagatttgcatgacccagttcccagcttggcttttccctttgacttaatgaatttggggtcccaagatttaatttcctttctcaagaaatagcaagcatgacattgctgaagtgcagtggtggcaattaacaagtgaatgatgaatgggttgaagtgagggactcattcttcagaacatataagggtgaaatgatgaccaacacctccttgcttgttagtcatgtctgtaaaagaaatggttcaatatctcaagttgtcttgccatttacctgcttttaatgtctgttttgcagattgggatcaaagccactcacattaagttaccaagaacaaccacagaatctgaggtgagcttttatgagttgattgtgaagagggaaggtgaagtggtttcctctctggttttggtttacgggggctttggggactgacacatttagccaagacctccaggtattttttttttttttttttttgagacacagttttgctcatgtcacccaggctggagagcaatgatgcgatctcgactctctgcaacctccgcctcccaggttcaagcaattctcctgcctcagcctcccgagtagctgggattacaggcgcccaccgcctcacctggctaatttttatatttttaatagagacgcggtttcaccacgttggccaggctggtcttgaactcctgacctgaggtgatttacccgccttggcctcccaaagtgctgggattacaggcgtgagccaccacgcctggcacctccaggtattctttcttcacagactcccacagaggagatggtgcagggatgaacatttggtactcaaagtgtgactgcagtactgtttgcttccaaatcatctgttgtgtttgttaaaactgatccttggagccaggcacggtggctcatgcctgtaatcccagcattttgggaggccgaggtgggcagatcacctgaggtcgggagttcgagaccagcctggccaacatggagaaaccctgtctctactaaaaaatacaaaatttgccaggcgtggtggcgcatgcctgtaatcccagctacttggaaggttgaggcaggagaatcacttgaacccgggaggcggaggttgcagtgagccaagatcgtaccattgcactccaacctgggaaaaaagagcaaaactccgtctcaaaaaaataggtaaaaccgatccttggcctgtaattatctgcattctaaaaaccaaatatgtattccttttatatgaggttcaggactaggcagaacaaatcagcggtgattaaagtcagaactgtggttgcctgtaggtgggagattaatgctaaactgtaggaggataaagcaactttcttgaggttatggcaatgttccatatatgcgctgtccagtatgggagccactagccccatgaggctatttgaatttagttaaaatgaaataaaattaaaaattcacttccttggttgtactagccactttgcaaggattaagtagctgctattgtattgtaaggtgcaaattatagaaaatttctgccatcgcagaaaagatgattggacattgctgctctacatcttgatttggatgattgtaacatgggtattattgctgtaataagttattagagttcttagctctttttattttattgtattgtatttttagagacagggtctcactcttttgcctcagctgcagcacagtggtgtgatcatagctcattgtagcctcaacctcctaagctcaagtgatcctcccaccttagcctcttgagcagctgggactataggcatgagccaccatgcccagctaattttattttatttttgaggcagagttttactcttgtcgcccaggctagagtgcagtggtgcaatattggctcactgcaacctccacctcccaggttcaagcgattctcatgcctcagcctcctgagtagctgtgactacaggcatgcgccaccacgcccagctaatttttgtatttttaattgcccatattgcccaggctggtctcaaactactgacctcaagtgatctgcccactcaagcctcccaaagtgctgggattacaggcgtgagccaccgcacctgtccccgcttttttttttttttttttttttttgagacagagtcttgctctgttgcccaggctggatgcagtggcatgatctcagctcactgcagcctccgcttcctgggttcaagcgattctcatgcctcagcctcctgagaggctgagattacaggcatgcgccactatgcccggcttattttttatatttttgtagagacagggtttcaccatgttggccaggctggtttcaaactcctggcttcaagtgatccagtagctgctattgtattgtaaggtgcaaattatagaaaataattttctatattttgggaggcctgccttggcttcccaaagtgctgggatgacaggtgtgagccaccacacccagccctaattttttttttttttttttgaggtggagtttcactattgttgcccaggctggagtgcaatggcacaatctcaactcactgctggagtgcagtggcactatctcagcggactgcaacctccacctcccaggttcaagcaattctcctgcctcagcctcccgagtagctaggattacaggcatgtgccaccacacctggctaattttgtatttttagtagagacagggtttcactatgttggcccagctggtctcaaactcccaacctcaggtgatccacccacctcagcctcccaaagtgctggaattacagtcgtgaaccaccgcacccagcccctggccctaatttttaaaaagtttttgtagatatcacatttcactgtgttgtccaggctggtcttgaactcctgggttcaagtaatcctcctgacttggcctcccaaagtgctgggattacaggcatgagacacctcgcccagcctcttagctcttttatttgatggacttcttaccagacacctaggggatgcattctatgttaaagtacaggtgctctcaggattcaaggggaaggtacattctgaaaggactataattaaagtgttggggggaaatagggcaacctaatttttgccttagaaagtgtttcttcctaccttttgatttctgtgtgatatacaaattatatatggtattacttttaggtgatgaagtacattacatctttgaatgaagactctactgtacatgggttcttagtgcagctacctttagattcagagaattccattaacactgaagaagtgatcaatgctattgcacccgagaaggatgtggatgggtaagtgtggcttggcttcctatgtctcattgcatgctttcatttataatatgtttctatttggggaatacagcataaatgtttctaaagagtaaagacatctaattgcctttatttccttcttatttccatcacttttttaagattgactagcatcaatgctgggaaacttgctagaggtgacctcaatgactgtttcattccttgtacgcctaagggatgcttggaactcatcaaagagacaggtaaaaacaacaaaccaaacaacaagaaagcaccatttcctgaatcctggtcttgacatgtggtggcatagaggaggtacattgtgggccataaataaatggacttgattggcagaagggcctgtctactaaggatgttacctaaattttctctcaattttctcagcaactctgtgaagtaggtactgttattgttcaactgctaagaaaataggctcaggccaggcacagcggctcatgcctgttatcccagcactttgggaggctgaagcgggctgagatcacctgaggtcaggaattcgagaccagcctggtcaacatggtgaaaccctgtctctactaaaaatacaaaaaaattatccaggcagggtggcatgcacctgtattcccagctattcgggaggcagaggtgggaggattgattgaacctgggaggcggaggttgcagtgagccgagatcacctgactgcactccagcctgggcaacagagcgagactctgtctctaaaataaacaaacaaacaaacaaacaaacaaaaccagctcagagagagcaagtaacttgtctgggagacaacggaaccaagatttgaattcagagttatctgagttcaaagcaatttattttaacctatacagtaataaaaatttggatagtttaaaaggatatgaagtgaaaagccccacctccccccacccccaaaatgggcactgaatctccacagtagttccaggactcgacagatggctggaaatgggtctcctgcacagttggccatattgtcccgttactagttagcaccttgctattttaatttcattatgaatacttttagcagaggttattttttacaaggaaatgggtcctggtaaaaagaagtaggtcagaagtttcaagtggaaagttttggccagcataaatgaaaattttctgtggttggcaagaaaaggtcaaaggtcaagctttgacagttcatttctacagttaaatgtatattcttcagcatatttagcaaacattgtagtgccttgcttaaaagaaaaaaatcccacgaggacagcacctgaaggcctcccactgcctcttattgagtgatgctaccatttgccctgatgcagctttaactcttctgctgaatcctaaaaagtatagaaagttaccttttaaaactttgaggtctttacttctagatgttcatgatgttcacattattataagagtttatctttttctgaaaaaaaatgattttatgcgagaagcacaatttaaacccttgctgctttgagcaagggtccactgccctcagccttgactgccctgaggactctgatgaagtcgtcaacttctctctgctttcttctttgtggacagctcattttcgggctccactttgtggccacaaacacctacagcctggttccatcctcatgcctaacagtcatgggattggatcttatcagctgagggaagaaatatggtcccctgtccactactgggtactcactcaggctgtctttagtagagtatgagtcagccctgaaaaggacattggtatattgccagaaaaatggatgctgtgatagcaaaaagaaagctttgctgccacagttcaatttcccctttatcacttccctgcaagtaaccctatggctcaggccctaagccaaaagagaaatttgggtgaggaactgtataaacaaacttaccaaagttagaaggaattaccgatactaatctaatttcttacacatctctccagcctgttacatacaccctatttgttttaactttttttccccatgtaatttaatctgatgtcttcttccgtatggctgattagctgtatgtcagggtttcttttttctttgagtgtaggttttcttcccactcccctatgactcaatgaatgatcttggcttaagctgctcccaaaaacccacggccagaaggacacaagtacaagtcccaatttatagctgaaaccctagagttgagaatattattgccaaagaaggaatgcttttaggaaggtttctgtttgatgttaagaacctgtttttgtgcacttattctaatttctccacgtggcatgcgaaggagggcagcttctatcctccaactctgatgcaggctggcttttctttcaggggtgccgattgccggaaggcatgctgtggtggttgggcgcagtaaaatagttggggccccgatgcatgacttgcttctgtggaacaatgccacagtgaccacctgccactccaagactgcccatctggatgaggaggtagggtgtccagaggagaggtaaaggtgttacggtggggagggtgggtgtgccagaggctgccatgtcctttacactcatgacctcatttaaccccatcatctcatttttacaagatgaaaaaacaaattcaaattaaaggctgagtggggtggctgacacctgtagtcccaacactttgggagtctgaggcaggaggattgtttgagcccaagagtttttgagaccagcctgggcaacatagtgagacgctttctctgcaaaaaaaattaaaaattagccagatggggtgggcacatgcctgtagtcccagctactcgggaggttgaggcaagaggattgcttgagcccaggaggtcgaggctgcagtaagctacgatcacaccactgcactccagcctgggctacagagcaagaccctgtctcaaaaaaaaaaaaaaattaattaattaaaaaaaacataaaattaaaagcatgctgaagtttatacagagtttgttctgtgtactttctctcttcctttttcttttttctttatttattttttttgagatggagtttcactcttgttgcccaggctggagtgcaatggcgcaatctcagctcaccacaacctctgcctcctgggttcaagtgattctcctgcctcagcctcctgagtagctgggattacaggcatgtgccaccacgcctggctaattttgtatttttagtagagacaaggtttctccatgttggtcaggccggtcttgaactcctgacctcaggtgatccacctgccttggcctcccaaagtactgggattacaggcatgagccaccatgcccgacctttgtcttttttcttttgagacagggtcttgctctgttatttaggctagagtgcagtggcagtccatgagagcccactgcagctttgaactcctgggctcgagtgatcctcctgcatcaaccttctgagtagctgggactacaggcatgtgccaccatgcctggctaatttttaagctttttgtagcgacaggggtctcactgtgttgcccaggctggactcaaactcctggactcaagcgatcctcctggttcaccttcctaaagtgctgagattacaggcgtgacccaacatgcctggcctctcaccaagtactttctaccctaatctgcctcgtggtggacagggattagcagtacaggcactcagattgacctctggcagccagatcccatgtgtgtaaaagtggtggcctcagagtgaaggtgctccagaggcagtcgtgggcagtagtctgctaatagctatggcagcttgttctagatccctgcatcagattcctgagcccaagaatgcgcacacacacacacgtgcctgttgacagtgcagtctcttaaatgtggggagagagcaggagagaggcctagtactttctcttttaatcctcccaaagtagtgctctacattctgtaggagaaggagcagtgtctggacataacacgcagggccccaagcctgtttgcccctctgccttgcaggttgacactgatttccctattgggtaaaatggctggtgaaagggagctctttggcatgtgtagaaatgagcacggcatgtgaagggctgtcagaaacagtgtgtggcttacatttgaggccttaacccaatatcttatgaaatagcttatgacacttaagaatttaatacaaagctcagggatatccttttcatttctgggtttttttttggtgtgtatttcattatttcatttctgatgtccaaatcccctacccctaggtaaataaaggtgacatcctggtggttgcaactggtcagcctgaaatggttaaaggggagtggatcaaacctggggcaatagtcatcgactgtggaatcaattatgtcccaggtgagtgttgttggaggagtaaggtggctgctggtattgaggatggtatctaggtcatcaaaagaagcctgagagagaagcttgtctcattttatgcttgtagtactaaggtttaggagactgactagcccaagggtgcacagagttagtagatagaagagttgccacttgcaggcaggtctgcctggtgccagagcctttgattttcatcatgtgctgtacagcttccaagatgactttgtccagggagaaagtgagagggagggcaggagggatatatcactttatcttcatgtagagatcaccctttattttagcaaagttgatggatggatttaaaatacagtataattattgcaaagtgctatgagagtccagaagagggactcattctgccaagaggagggctttacaaagaagatatttgacctgggtttttttctaggctgagaggataaatctagccttttaatcatgtccaaaactgtactcggcatcctcatccccaagttaccccttactcccgtcttttggttagtatcaccattcttccttcccgcaagtctgaagccttttagtttccctcccaagcattccctatattggaccagtctctaaatattaggaattgttttctctctcctctgttctgagtgtcaccactgagtgttaccttctcagctgatgggctgtgataacttccttgcaggtgtccctccctccagctgcttcccactcagatctatccccgtgctctcgccttgccacgttcaccttctggcatggaactctgagcctcttccttcttacttgccagactccttagcctcacactaatttcagtgacctctgcagcctgtgatctcacttgcgcatggtgaatacctgtcttcaacttgtaaagtggaccactttcccttccctgcgcatgcctcgtttgccctttgtagttccctcacctgcattcttagtggagtgggctactctttcaaacagaaaacttcacagaacaatagggcaaaacttgcgtacgtcctcatagatccaagaaaggaacaatctttaacggagcaactactgtgtatccagcacaatgccaggccttgggctacacaactgaataaggttcaacttcaccttcaccttcagctgcttcctccccatctcctctctgtcatgtctgttattccttccaaaccttgtttgatttccccttatcaagggatgatctttccttctctccctccctcctctcccatagaacatgtgtattgtatcttttgttgcatgtgtctcatgtacggcgtcctgtgctctcctgcctagatagctcctcaagggcagtggtcactgtggcgccacatccagcttcctgccatctgaccactggcactcatatctattgaattgtcgaagggagttatagctggaagtcttttttctcccttcccatctcaagtttcagatgtagacgctgagctgccaggaacattagtcactgtcaagccttcaccgtttttaacctccctcccactctccctaccgtgcttttaagacagtagctcataattgatcactcattttcttgtagtgtaattatctaacaggcgataaagaaattgctctcctacaactcctcactttgaatacttgcgatatgacattcaagctcagtctttttatttatttatttttttaattttttttttttttcttgagacggagtctcgctctgttgcccaggctggagtgctgtggcgcgatctcggctcactgcaagctccgccttgcgggttcatgccattctcccgcctccgcctcccgagtagctgggactacaggcgcccgccaccacgcccggctaattttttttgtatttttagtagagacggggtttcaccatgttagccaggatggtctcgatctcctgacctcgtgatccgcccacctttgcctcccaaagtgctgggattacaggcgtgagccaccgcacccagcaagctcagtctttttaaaacctcgcatcttctgtatcatatttctgcttttggcattttttttttggattacatgtgagaaatggagaagaaaaacctgagtggggatcttgagtgttgcagataggtaggaaatgttgacttaaacatgaaacttgccatccttttcacattgattccttatgtagacaataaaatatgaataaaatcaaagcagtatcttcccttctggtcaacagtgtttttactgatcttgggcatataggcaaattaatgctgatacagctggatgttattgtgttccccaaaggatggcagaatcactcagttacagaccagcaaatgggctgcaggacctaaagactgatatttgcaaatgttcactttagaagcaaacttttctaccaccgagctacttcttggttcatattttgattatttaaatagtttgcatggtccactcagggataacattgtaagtcacttgccaaattaagaatgaatcaaggtgtgtataccttttacaaagaagtaatatttttaaagattcaagtgcagggcagaaagtattggccagagaaacacataaaagtgctcttcctgcttggcttactaaagataaattgagaagggccagatcaatagtgttttatttggaagggttaaaaagtgggaacagattccccaccctaatgcaatccagtctcaacctatccagtgtagctgcttctggactggcctctattattagggtccccaaattaaatgtagaagagtcagggctcagctggatctttagttgatttttgtacatgtgatttcccaaagaaagagaaattctagggctgggggtagataaccaaaaggtttgctcattactgaggtcatatgcttaggctgagtagtggtcactttttccactgaccacatcatcctatccacgaagcactgcatgtttagcagtgtctcgtcaaccctgacagtatttggtttaggagcaaaactgaactcaccagtgctgcgtttagtcatgtagtcaaagatatgtgtctcttacctgtgggaaaacgaaaatgactaacattaacacgtagaaatagatgcagcgggtatttcaagctaactacagtgtgaagacgattgaaacttgtacagagggcaaacctctatctatatttccttggcattttgaaatgactctaggggctgtaagaggaaatgttctgccagtttgctgctttataatcttctagaaacttgaaaccatcccaatgagttgtgttgaccagctccttttactccatataaaaaatatcttacgtatctgtggtggaaagagaaactcttgcgtttggaggctgctttttcaatttcagtaatgtacacattttctcattttgccctcagcaaatttgtgataggtagtgttaagccttctttgcattttggacttcagattaatatggagcccacaggagctgcagaactaacttttttttttgagacggagtttcgctcttgttgcccaggctggagtggaatgctcactgcagcctccgcctcccgggttcaagtgagtctcctgcctcagcctctgagcagctgggattacaggtgcccgctaccaagcccagctgattttttaatatttttagtagagacggggtttcaccatgctggccaggctggtctcggactcctgacctcaggtgatccacccgccttggcctcccaaagtgctggcattacaggtgtgagccaccacacctggccctaatttttaataaaagagctgatgctacagctaatctcttttttttctgagacagagtctcgctctgttgcccaggctggagtgcagtgacgcaatctccgctcactgcaagctccgccccccgggttcatgccattctcctgcctcagcctcccaagtagctgggactacaggtgcccgccaccatgcccagctaatttttttgtatttttagcagagacggggtttcactgtgttagccaggatggtcttgatctcctgatctggtgatccgcccgcctcggcctcccaaagtgcctgctaatctcttaattctggcttcttgcctccaccttggagcttcttctcagttgtggcgatctgatcagagagaagtggtgatgtcgctaaaactaccagatgcagcgcgggagccttattgcttcgaggtctaggcccgcccccagcccctcctggaagtgcactgaagccaagtgtaggatgttctttgtgtgagtgagcaatgatgcatcattgggttttgttctcttgaatagctattctttgctggtaagatttgtagttgttcttgtgtccttttaagggaagtgtaattatattctttgcctttagcatacatttaagtagctgtgtctttggaattggatgttgaattgttcctccagctcacacatggagctcacaaaatgctgacagttgctgtagaaacgatatctggcagctgtgacagagttggatctttgtgcacccaaaaaatttcctttgtaggctttagcaaattaacattttaaaatgggtgctcattatatactgggtagttggttttaagaataaaaaacagttggtattttatttgccacctgagagactacaaaaggattctccaggttctgtaaaaccacttatgcatcttgtgaatttttgcaggtaaaataattttctccctaagaaatagcaaacatctgtcattccatagcttttaagttaagtaggcactggagcctgatgggactaacacaccctacaattctgctgagtttttgtcgtaactgatcaccaggactgtgattctgagacttagttttgatttctcccccacttgaccagatgataaaaaaccaaatgggagaaaagttgtgggtgatgtggcatacgacgaggccaaagagagggcgagcttcatcactcctgttcctggcggcgtagggcccatgacagttgcaatgctcatgcaggtaattgtgaataaaagtttctataagagttctgaaaagctgatcgagttttggctgcttttctccccaagtagaaatgtcaaaaacctactcagaagtaaagatgtgaatttattgagaaaaagggaagggaagaatagagaaataagatcaggcacattaatagaggaaagtagggatggcataattccagtctgttttggaatataataactttgaaagaagaaaagtgcgatcacactggcttggccaggtctgttttggtttgccttccctttctttttttttttttttttttgagacggagttttgctcttgctgcccaggctggagtgcaatggtgtgatcttggcttaccgcaacctccatctccctgattcaagtgattctcctgcctcagcctcctgagtagctgggattacaggtgtgcaccaccacgcccggcgaattttgtatttttagtagagacaggtttctccacgttggttaggctggtctggaactcccgacctcaggtgatccgcccaccttggccttccaaagtgctgggattagaggtgtgagccaccgtgcccggcctgttttccctttctaacatgcaccagctgacaggggccaggcgagcagccccaaagcatgttaggtgcctcttgactcttagctaggattgaagcatggtaataagtgggtctgaagcagttcattttgtgattgaactggagtgacctggagcttgaaactgaggtgaggattaaaataaccacctcttctaagtttcatttatttcattttgcttagagcacagtagagagtgccaagcgtttcctggagaaatttaagccaggaaagtggatgattcagtataacaaccttaacctcaagacacctgttccaaggtaaaaataaagttttactgatttaaaactttgtgaattgttggtttttagttgacagatactgtgggttcacatatgctccctctgaaggtgccttcagtggttggggttgggttgggggcttgttactactgtgggattaattaaactcagtggataaacattaatacctattttctatgtttccaaagtgacattgatatatcacgatcttgtaaaccgaagcccattggtaagctggctcgagaaattggtctgctgtctgaagaggtagaattatatggtgaaacaaaggccaaagttctgctgtcagcactagaacgcctgaagcaccggcctgatgggaaatacgtggtggtgactgggtatgctttttattcatgttgccatccaaatcttagtatcagtcctgatactaaggcgttgcatttgcacttggcacatgtatgtagaggtgcctttaatttgattttagcattttcacccgtatttgatctcatttgatccttacagcaatcctgagaggtaggtaagaatagattataatcatagatgagaaaattggtcaaggttatccatctagtaagtggaagagtttggtcttaaaacccggtcttaagatagaatcaccttttgctgttgttgttgttgttgttgttttgagacagagtctcgctctgttgcccaggctggagtgcagtggcacgatctcggctcaccacaacctctgtctcccaagttcaagcggttctcctgcctcagcctcccgagtagctgggactacaggtgcaaggcaccacacccagctaatttttgtatttttagtagagagtgtgtttcactatgttggccaggctggtctcgaactcctgaccttgtgatccacccacctcagcctcccaaagtgctgggattacaggcgtgagccaccacacccggccagaatcacctttttgaacccaaaattcattaattcgatggatttactaagcattcatttttattgctgggctgaggttatattaaaaagctagtttttgagaatataaaatgagaaattaaaattatagccgtgtctctacaagataaagtatatttgcttcttacagcaagaagagctaaaatacaggaatcattttttttcttaaagttttttggaaattacaactaagacttttgaaaaagatatctttcagggcttttgtctttctttttctttgtcttttctttctttttttttctttaagagatgggggtttgctctgttgcccaggctggagtacagtggtgcagtcatagcttactgtagcctggaactcctgggctcaagtgatcctcttgcctcagcctcctatatagctgggactacaggcatacactgctatgcctgactttgtctttcttaatctttagattacgagtcattctctaggatctgctaggtatgacttagtgattcagatacacttaattctttaaacctttttctcttttgctttcgtcttgaagaataactccaacacccctgggagaagggaaaagcacaactacaatcgggctagtgcaagcccttggtgcccatctctaccagaatgtctttgcgtgtgtgcgacagccttctcagggccccacctttggaataaaaggtactagtgagactggaccatgggtggtgacaggggacctgcttctccttcagtcctcccaggcccacgcaacctatgatacttatggggtcttcaactcatttcaacaccaggaatgtcattctcacaaacctctgtagtcatgcttttgatgaaggctgtcattggatctccccagctcctgctgtcactgttggccactgcacagggattctctgggatgggtgatatgtagctggaggtgcttttatttgaccctcatagtccactgctacagtaaccataaaggtaatcatagctactgatcatcttacagacactctagagacaatgacaaaccccacagatgtttcaccttgttgggaataagaaaagcctacctttattgaatatatgctttgtgccagatattgtgctgagcagtttttgcatattattctatcatccagtacgagatagtattgtcaccattttaaaatagcagcaactgggacttcagaggtggcttggtcaaaggcacctgtattaagtaccagagtgattcttccatgtctatttcaagctctaaattactaccatactcgcactttaccttcagatttttattgctgcggtactaagaacatgtgtttttttttttttttttttttttttgagacagggtctcactcactctgtcgcccaggctggaatgcagtggtgtgatctcggctcattgcaacctctccaccttctgggttcaagagactctcctgccacagcctcccgagtagctgggattacaggcacgcatgaccatgcctggctaatttttgtatttttggtagagacggggtttcaccattttggccaggctggtcttgaacttctgacctcaagtgatctgcctgtctcagccttccaaactggtaggactataggcatgagccaccgtgccaagctgctgtcttaattaaaataatgtttattaattatgataggttcttagagttagctttctctgcttggtgagggtatcacattttgcttgttctagcaattactacaaatgttgacaccgggaacaccttcacccttccacctttttttttttttttggagacacagtctcgctctgttgcctgggctggagtacagtggcacgatcttggctcactgcaacctccgcctcctggtttcaagcaattctcctgcctcagcctcccaagtagctgggactacaggtgcgtgccaccatgcctggctaatttttgtgtttttagtagagatggggtttcactatattggccaggctggtcttgaactcctgaccttgtgatctgcccaccttggcctcccaatgtgctgggataataggcatgagccaccgtgcccagcccacccttccacctattttataaatgtaatcactttgttctgctcttgagcttgtcttaaccccctttcaacttcagcacgagctattccttgttctgcttattgaacccattattttccttttactcttactgcaaattgcctcactgcacggtctctgcctcacaaaaacaaaatacatattaatatatctctgggctgggtgcagtggctcatgcctaaaatcccagcactttgggagggtgaggtggtagattacttgaggccaggagttcgagaccagccaggccaacatggcaaaccccgtctctattaaaaacacaaaaattagctgggcatggtggtatgtgcctgtaatcccagaccattaccctccagcctgtgagacagtatgagactctgtctaaaaaaatatatatctgatttacatttattgcactgataatgtggtaacctggactttttttgtttgtttgtttgttttttttgagacagagtcttgctctgtctggagtcccagctcaggctggagtgcagtggcatgatcataactcactgcagccttgatctcccaggctaggactataggcatgagcagccatgcttggtgtcctgaacattttcaactggcttttggctaatacagattgagcatcagaaatctagaaacctgaaatctgaaaggctccaaaattctaaactttttgagtgctgacacgatgctcaaaggacatgctcattggatcatttcagattttaaatcctggatttgggatgctggatcagtatgatgaaaatattccaaaatctggaaaacaaaaacccaaatccaaaacccaaatccaagcattttaaataagggatactcaacctgtaatccaagtagcccaaaaaaatctagcaattaggctgctttctaacagcctaatctatttatctctatttaggaaaaattatagtctttttgttaggtgtatgtattttaaatatttctgttttaaaagccaaagtagctttatgagagtaggaaattgaacaggttgcctttatgtaactgtcagctgggtgttttaacaaatgccagtaattacaaggaacatatttctaaagataatgagtaggtatatatttgttcatggttttgtcatttaaactcagatttcaattgagagactagtattagaaaacacttgatcaaaactgtccaaatgattctaaaaaataaataaataaatgtgcttagtagttacaataatgcatttgcatttatttgatttctaagtcattggagaagcatgcttaactgagcttccacccttgacctgtcccctaggtggcgctgcaggaggcggctactcccaggtcattcctatggaagaggtaaagtattctgggatttggctgaattagatccccctttttttgtcgggggggagggtgctgaattagctccctttttttccccatgacggagtcttgctctgttgcccagagctggagtgcaatggcgcaatctcggctcactgcaacctctgcctcccaggttcaagcaactctcctgcgtcagcctcccgagtagctgggattacaggcatgcaccaccacgctcagctaattttgtatttttagtagagacggggtttcaccgtgttggccaagctggtcttgaactcctgacctcgtgatccgcccacctcggcctcccaaagtgctggtattataggcgtgagccaccgcacccagcctagattctttattatagctttttctctctggagattagccttttttgtagagctcttagcggacaaatgacttgtttctcagcaaaagcaacacctagggggaaaacaacttaatttgcagacttgtgatacagcttggtttcaaactttggctttcagtgggaatgattattataagcaaatgaccaaatgaagcatggtatcgggaagcaccaacacacagcgatttcagaattcatttatgtaactgcagaaattggaacattacatagacatagagtcggtgctgctcccgtgcactcctcctcgctgttttgaggtgtgtcctcagtaacccagtgtggctgttgatcccagtggtgtggtatttgtggtctctggacatctcattttggaaaaactgcaagttctgtatttgggaggagattcttctgtggacagataattagtcttttatgttttctttttctttttctttttcttttttttttttttttaagacagagtctcactctgtcacccaggctggagtgtagtggtgtgatcttgggtcactgcaacctccacctcccaagttctcctgcctcagccttccaagtagctgggattacaggtgcgcactaccacacttggctactttttatgtttttagtagagatggggtttcgccatgttgcccagggtggtcttgaactcctggcctgaagtgatccgcccgcctcggcctcccaaagtgctggtattatagttgtgagctaccacacccagccagtcatttatgttttcaagaactccctatattgggtgtttgtccactaactgggctgccttcagtattccattggctttaaaatagggattgagctttgcaatagaatgaaagttggaaagatacagagcagctgggagactaatgtggcttctgttcttttgtagtttaatctccacctcacaggtgacatccatgccatcactgcagctaataacctcgttgctgcggccattgatgctcggatatttcatgaactgacccagacagacaaggtaggatgccaaagccccatgaaccccattgaacagttttgaaagtattgaaccatctgaattagtgttggtgtcttgggtgctgaggatgcaggtagcaaagcagtggggctcctctcattttaaagcccctttcttttctttaaggctctctttaatcgtttggtgccatcagtaaatggagtgagaaggttctctgacatccaaatccgaaggttaaaggtaagctttttttcttccacattttttatattgtatggaatctggaatctgatcattgattaggacataaaagtcttcttggagtagcctattttagatgaagttacatcagtaatcatagtcttaaagtcatgatatacatagcaaagatggatggtagaggttatttctcatttatctatagattagaagtggctagtgtggaataaatagaacactgacaacctgccctcagctaagaaagaaacgacacttcctttataacatgaacaagagtcaggatgtcactgtggcggcatagcagcctttggagtttgcatcattgggaccttaagcaaatttgttaaatgacttgtttctccgcttacttgtctgtaaaataatacttgccttgccctgaatagataagggtctgtgttaaacagttaaaaccatagttatatctatattttatttgaatttctgtaacaaatacatagttagtaagcatacaccataccacctgacccagaaatctcacccaaaataaatgaaaactctgttcacataaaaatctgtacattaatgtttttagcagctctattaataatttccaaaaactgggaactaatctaaatgtctttcattggatgaataaataaacaaactggtacatccatccaataaaaataaatgagctattgatacaagcaacaacttggatgaatttcagtggcattatgctgggtgaaagaagccagtctcaaaagcttgcatattgcatgcctccatttatatgatattctcaataagagaaaactatagtgctagggaacagatcaatagatgttaagggtatggatgaagggagggtatgaccataaaggaacagcaaaggagaggtgttttgttttgttttttgttttcttttttgagacagcgtctctctctgtaacccggctggagtgcagaggcacaatcacagctcactatagcttccaccttccaggttcaagcaatcctctcatcttagcctcctgagcacctgggactataggtacacacaccaccacacctggctaattttttattttatttttttgtagagaccgtgtctcaccatattgtccaggctggtctcaaactcctggtctaaagcgatggtcctgcctcagcctcccaaagtgttgggattactggcgtgagccaccacgtctggccacaagggattttttgtttttgtttttctgttttttaatttttcaaaaatttattggttggttgtttgtttgtttgtttaagacagagtctcactctatctcccaggctggagtgcaatggtgtgatctcagctcactgcaacctccacctctcaggttcaagcagttctcctgcctcagcctgaatagctggggttacaggtgcctgccaccatgcccagctaattttggtatttttagtagagagaaggtttcatcatgttggccaggctggtctcgaactcctgacctcaggtgacccacccgccttggcctctcaaagtgctgggattacaggcgtgagccactgtacccggcctgtttgtttatgtttttgagaaaagcttttactctgtcacccaggctggagtgccgtggtgcaatcacatcttactacagcctcaacctccaggactcaagtgattctcccacctcacccaactaggtagctgagactacagccaggtaccaccatgcccagatttttatatattgtgtagagaccgggttttgccgtgttgcccaggctgatctcaagcttctgggctcaagcaatctgcctaccttggcataccaaagtgctgggattacttgcatgaaccactgagctcagcattttttttttttttttttttttaagagatgaggaggccaggcgtggtggctcatacctgtaatcccagaacgttgggaagctgaggcaggtggatcacctgaggttgggagtttgagaccagcctgaccaacatggagaaaccccatctctactaaaaatacaaaattagctgggcatggtggtgcacgcctgtagccccagctactcgagaggctgacacaagagaatcgcttgaacctgggaggcggaggttgcagtgagctgaggatgccccactgcactccagcctgggtgacagacagagactgtctcaaaaaaaattgggtttgtgttttacaacacttcttggtcactatgatactatgattatttaggtctaggcttagggaaatcttctggtgctcagttatagggacaaacatgttaataatacctttgtacatgtgtgagtaatgtgaatttgcagatatcgggataaaatcacttttgtcagacccagaaaaaacagggctgggaaaacatgaagaagaggaggcttacacttacgtgtctgtgataagaactgtttgcaaggcctgtaatcccagcactttgggaggccaaggcaggaggatgacttgagcccagcagttcgagaccagcctgagcaatgaagcaaaacctcgtctctacaaaaaaatttaaaaacgagccaggtgtggtggcatgcacctgtagttatacccagctactcgggaggctaaggcaggagcatcccttgaacccagaagttcaaggttgcagtgagctatcattgggccactataatctagcctaagtgacagaatgagacctcatctcaaaaaaacaaaagcaaaaattgtttccaacaactttataaaaccccaaaagaaatcccttcacgtccttcacacatctcctgctttgcacagcttgcacatttcaaatgtatacttatgtttccatgacaagacttatcactagacattcttcaggatgggagtaattcagataagatgctcttgaaagtacacttatccagcaacggcaactgcaccaatgaattgacaactctggctttgagcttctgggagcgatgaattctgttttttttttttttttgagacagggtcttgctctgtcacccaggctgtagtgcagtggcacaatcatggctcactgcagccttgacctgaactctctaagcagactacgtgaagctctccctcttttcttttttttttttttttttttttttttgagatggagtctcacccaggctggagtgcagtggcgtgatcttggcttactgcaacctctacctcctgggttcaagcagttctgctgtctcagcctcccaagtagctgggattatagtcacccaccaccatgcccagctaatttttgtattttttagtagagacagggtttcaccgtgttggccaggctggtctcaaactcctgacctcaggtgatctgcccatctcagcttcccatagtgctgggattacaggctcagccacaggctgagcttcacgcctagctgaagctctccttctttgctagtaaaatcttcccttccctcactaggcatatttgtggcatcccaggttataatcctcgttgctcattcctgaataaactcaacctacttggagataattttttgtaatgtctttctttaggctgacagtaggaaataacccccagctttcagtttttccttctgaatttaagatggtttgcatttcctagaggggatcccatttagaggtaggggtcaaaatttttgtcttacgtttattgtgcttctgtttgtcttattttatgttttcattttcctacactttcagagactaggcattgaaaagactgaccctaccacactgacagatgaagagataaacagatttgcaagattggacattgatccagaaaccataacttggcaaagaggtaccagagcagtatacaagccccgtttgttttggctatattgcacaccctacaccctccagaagagttgttaaaatgtgaggctcagaagcttccatgttggtattttaccagctaaggcatgaccaagatggtgacattatttctttttcttgccacctctctcagtatctctccttattagctatcatcaaatctctttgttggattggtcgaacattttgctggctattcagtgttgactgaaattagggtagttaaaccaaaaatcacattttacaaatttaattttatgcaaaaagttttagtgtcatgaagtagagaaattatgtttaatcacttcttgaatcatgtgtgacctttattcttagaactcttgtgtggcataaatgacttgatttttttctgtagttctctagcttacctaatctttttttttttgagatggagtctcgctctgtcgcccaggctagagtgcagtggcacagtatcggctcactgcaagctctgcctcccaggttcacgccattctcctgcctcagcctcccgagtaactgggactacaggcacccgccatcatgcccggctaattttttgtatttttagtagagacagggtttcaccatgttagctaggatggtctcaatctcctgacctcatgatccgcccacctcaggctcccaaagtgctgggattacaggcatgagccaccgcacccggcctacctaatcatttttttacctcattttattaaattctcttatagcatattaggtagccttcaaggtttaaatacttaccagttcagtaagtaggtttcctggcttcactgccatatgctacttttctcaatgcacaactagtgtagcttagatttcactttgcatcaacaatgcaaccttctattctgtatcactattgagaaagaatcttcatccactcatgcagaatagagctgaaggccagtttattgactgtttttgtgattttccttgactcaataaccgttgctagctaatggccttatttagatgacactctcaatgtctaaaaccacattggaatttctcttcctttgcttcaatagctttagacaaatggtataatattttataaggaataagctaaaagtccattttgaagatttagtatccgatttacttttcttttgcttcgtgtctcattcatgttttctaagcaactagaggcagtcatacctattgactagctattttttacagaaatattagttacatgaaacctgatacttttttcttttgaaaaataagggttggctttaacaacacattacagcaagagtggggggtgtgtgtgtctgattgctatataagacactgcttttggtatgaaattatgacagtctttatggaaaataatttggcatattatcaagtgccttaaaaatgcttctcctccttgactcatttagagtatgaactgggtttttttgttcattttgtgtgtgtgtgtgtttttactttgaaattattttaattttgaaatagaaaacatcttgaaaaaaaaacccacaaaatatataggcaaatttgtactctgtgagcttctcacatccttacactgcttcaccaatctctaagatgaaaaactctgttctaaaacatattcagccatcagcaatgatgttattagtaggaatatggatcaatttaattttgtgtttctttgatattgtttggcatttgatactgaaatggcaactcctgtttcctctctatactcatagtactctcagcacctcacttctgacaccagatgggtagtttttctcttccacaacaattcagctttcacttctccagtggatattgactgagtatcctatgatttaactcaattctgacactaactgtctggagcagatcctacaggtaaagggctcagtcctaaaagactgccccacttcagacacgaatcgcaagtccaggttgtcacctgtgcttctgaccaactggttataaactggagggtccccacaaccccctgctcaggttcatttgctagaatggctcacagaactcagagaagcatttcacttgtgtttatggtttattataaaggatacagctcagaaacaaccagatggaagagaagcgtagggggcatcactctcccagcacctggatgtgttcaccagcccagaggctcatcaaatcatgttgttcaagagttttttttttgagacggagttttgttcttgttgcctaggctagagtgcaatggagtgatctcagctcactgcaacctctgcttcccgggttcaagcgattctcctgcctcagcctcctgagaagctgggattacaggcatgcaccaccacacccggctaattttgtatttttagtagcgacagggtttttccatgttggtcaggctggcctcgaacttttgacctcaggtgatctgcccaccttggccccccaaagtgctgggatttacaggcgtgagccactgtgcccggcctgttcaagagttttatacacccctaacaccttacccagaggttggtgggtgggactgaaagttccagccctctaatcatttggtctttttggtgaccattcctttcctgaggctgtctaggagacctaccataagtaacttattaccataaactcaggtgtgatcaaaaggagtttgtaatgaataacaagacactcctatcacccttggaattccaagagctctgtgagccttttgtcaggaacccatgacaaaggtcaaatatatttcctattacactacacataccaaaagccagaactgagggtacactaaaatgttaacagtagttagtcctgggaggtcgttagttggttagttgcttggtctttgccatgttttttgtggttatataattggatagatattctgtcatcagaataaaaattctctctgctaagtgtgctatgtttcctaaatttccagaccaggcctggcacccagcgtgtttcaaaagatatttgcacttgccctgatttgatggctcctgcatttcttacggtggtggaaagtcaatgagtcatcatcccacagaacaacaacacaaacctcagtcttttgaaaaaatgtagactgctctgtttttcttatatgtggaatatgctttaaaatagattccagatttctagttaactgtttgaattctctagatgggataaaaccaagccattccacattcctttgctgtaaaaataactcctgtgtatttatggtatatgaacatcatttcttaactttaacacatattctagctttgccatccattttgaaatattgatagacaatcatgaaattagacttattgctttaaaactctgctgcttcctttaactttgtggtccttttactcaaaatcgttctatatcttgcctgtctgctgtagtgttggataccaatgatagattcctgaggaagatcacgattggacaggctccaacggagaagggtcacacacggacggtaacaatttgtccctttccaaggaaattagttcagaggcactagatcttgctgcttctctcctcctccatcctctctcatacgactgatactgccaggtgttgttctgccttctcccttttaaaatggaagtgagtaggtgtgtggcattgagcactcctgacagcttttgcaataaatcccatgtgtcacctgtgtgtttttcccccggcattttttcctggaggtggagagccccaagtgaatatccttgcatagaaattgattaaaattgcttcttttttgtggccatttcactgtatatctccttggtttaagaggtaccatattattcccttgtatatgaaagaaacaataagcgcatgattataagcggccttcatagggataaaatcatagctttttggtcctactataacatttattttaaaaaactgacaactcagggctgggcgtggtggctcacgcctgtaatcccagcactttgggaggccgaggcgggcggatcacttgaggtcaggagttcgagatcagcccggccaaaccccatctctactaaaaaaatacaaaaactagctgggcatggtggcacgcgcctgtaatcccagctacttgggaggctgaggcgcgaaaattgcctgaacccaggaggtggatgttgcattgagccaagattgtgccactgcactccagcctgggcaacagaccgagactctgtctccaaaaaaaaaaaaaaaaaaaaaaaatgacaactcagggtcttggaataattaattaatatatttttttgctattagaggattattttcattaagtattttgggtagtattctgttattctatccttttaagctatttgtttaagcctcagatgtaaaagaggatcacttttgcaattcacacttctggtttaacacaaagtttttgctagtacctcttttccctgcccacaggcccagtttgatatctctgtggccagtgaaattatggctgtcctggctctcaccacttctctagaagacatgagagagagactgggcaaaatggtggtggcatccagtaagaaaggagagcccgtcagtgccgaagatctggtgggtacccagacacgccaggcttggcgacatatctgtgtctgttgtcctagggtctttcagcagttattaataacaaaatgtaatgctgtacttaagacattgcaattaattcatcaatttaatcctattttgctaattacaagataattatgaaatgtttaaaaagtacatcagagtgaataatagctggtatgctttagtaatagatcacaagttccagatgatttgagtaacatcttcatcctgtgggcatctctaaaagtgggtgtatgacttcaatttgcagagaacatcaagagtaccattgctttatctttgttgctaggtagttcagctacactttgatggcttaatagagtgacctgatgttaaaagttggtattgaactcttgcgtaatattgcagtttcagctttggaagacacatattgagtttggtatttatagaaatttctgcccagataccagagttacaaataactgagtactctgggaacgagcattgtcgtgctctaaaatagtctagaatggatttctcacatcagtcagcagctgagcttgattaagatgcttgtttctagagttacatgtttttccagatattacatgtgaatgtcatttgtattctatctggcaactttggccaggcgtggtggctcatgcctgtaatcccagcactttgggaggctgaggcgggtggatcacaaggtcaggagattgagaccatcctggctaacacaatgaaaccctgtctctactaaaaatacaaaaaaattagccgggcatagtggcgggtgcctgtagtcccagctactcgggaggctgaggcaggagaatggcgtgaacctgggaggtggagcttgcagtgagccgagattgcaccactgcactccagcctgggcaacacagccagactccgtctcaaaaaataaataatttaataattggcaacttcatagcatatccagaaaaaaaccatgaatggtccaattcaggtgaaagtatcaattggtccaagatggctaacatgggtaagcctagaatgtcaaatattggtttcagaaggttgggtttttttgctggtgggagttgatgctgcacacatttgttttgtagggggtgagtggtgcactgacagtgcttatgaaggacgcaatcaagcccaatctcatgcagacactggaggtgagcagagtgactcctgccttcttgaattggttttggacagtcagagcagagtggttataaagcacacttgcaaggcgcggtggctcacacctgtaatcccagcactttgggaggccaaggtgggcagatcacaaggtcaggagatcgagaccatcctggctaacatggtgaaaccccgtctctactaaaaatacaaaaaattagccgggcatggtggcgggcgcctgtagtcccagctgctcggaaggttgaggcagaatggcgtgaacctgggaggcagagcttgcagtgagccgagatcacgccactgcactccagactgggcgacagagcgagactccgtgtcaaaaaaaaaaaaaaaaaattaagcacacttaacctgggtagtcaagaccttctccacttgctcatctctttcttctcattcttcctcacacctgtgactgggacgttactgaaataaaagagatgactttatattttccctctgggaagtattcttccttccgattccaaatcaattccataccgttgaatgtgtgatcccactttgaagcaggattggcagctcagctcacggtgtcctggtttccacagggcactccagtgtttgtccatgctggcccgtttgccaacatcgcacatggcaattcctccatcattgcagaccggatcgcactcaagcttgttggcccagaagggtttgtaggttagtgttttttgcaaaaccagtgaatagactgtatgtttcttttaacatcaggggaattgggatggcatttttactgttgctttcctctttacagtgacggaagcaggatttggagcagacattggaatggaaaagttttttaacatcaaatgccggtattccggcctctgcccccacgtggtggtgcttgttgccactgtcagggctctcaagatgcacgggggcggccccacggtgagtggtgggttgaagtatctgattatcggcagtgtgctgacggccaaaaggaagttggatgacttctgcctgtttcttcattgagttgctcttatcctcgtgattaacaggcagcaaaagcaagggacgggcagacagcccttgtgttggctgccttatcactcacaggcaccgtcagcgctcagcattttaagagggccaaaatcggctgcctggcctacctttcggaggacatctgacaatatctaaacccctccaaggacgtgtactcggctagccccacaaaaaactgttttacgttcagactgttctttttaaatctgcatccctctgtatagtgacactggcaaccagccaaccaaaccagttagctgagacagaggtcagccccttcttgagtatactgttcatgctggacagggcctccacaccctagggagggagtgggggagaggagaatggcagatctgcccagggctgccctgggtaacagagaaacaggtggagactggctcatcctcacctccagcctgaattttgtatttctctgaattcctactgcttagaaattcctactactttttatcctagtattttaacaccttttctttagggcctacatgaaaagacatggtgctaggttttctgaaatcatttgaaaaactattaaattcctgtccaccaggagcttgtattataacttaggaaataaggactccctggcctacaggataaaaatcaaatttgttttggtcagggtttgtcctaatgtagcagttctctgttttggcctcagaacctctttacactcttgacagttattgagagcctaaaagagtttttgttcatatgggttatagctattgatatttaccatattagaaattaaaactgagttacatgtaaacataaagaactttgtaaacatgaaaatgcattatcttttcccagcaaaatttaggcattgtacatttttcagatcttctctgggtctggcttaattgaagacagcacttgatctgttgtgacatcacatgtctcataacctttggaaaagtccattatatgctcaatgagagaatgataatgagagtaaaagggccataagatgttacagaatcttatggaaatagttttgacttcatggaccccttcaaaggattgggtccccggagcacactgggaatgctgccataacaaccccagcacccctatccagtcttagttatccctgagtgccaaaggcactcccaacccagcacactcctttctgctagtagcacaggatagactcccttttttttcccagtcacaactaacattcctctctcttacacccctcactcaccctcacaccatcacacctcctttccttgcttcctcctgacctcacagtcaggataatgtcccataatgctgtgcatggaggggaacatttgcacatatggctctgtcaagagagtaggcctcctgctctcattagcttgctgacgggaagctacctgtaaggtccttgcttcttgctctgcctccacacagccccttctggagttggagcacatagtctcactgcaatggaagagggcagagcttcttaatcactatccactgcccatggtggggcccatgaaatggacaccttcacccatttgctcatttctgtggatgcagcagggctgagccacggcatagatcaagactgggggctggggggcggggcggggaggcaccagacacctccatcctttagatatactctacaaaagagaaagaaaatccttctgtattgttttccctcttgtttgtattgaccctgcaccacggttcagctccaccaatgctaggttggcactgtggaccagttcatgaaaccatggcagggctcatcacgggctctatcgacagacatcccagggtgacttccgcaggcccgaccgcttcctctttccccacactccccttgacttccaaccccactgctatggccttcactcgagtcactgcacctgcttggtacacccctttccacctctcctgccatcgatccggtccttctcacctccttaattcaggtcatagaggtcttccacgctgcccaaagcagtcgattttgttctgtgctgtgtgattggtcacataccctaagtccttagggcaggaaataatcttatactactgtacagcctgcaagcattgcagcgtcttgcctttaacacatgaaaagcaccattttaagctaggagatttaaataggaaatgcctctgactctgtttcttttccttccaggtcactgctggactgcctcttcccaaggcttacatacaggaggtaacctgagttatttctcatcacgtgtcctagaaagcaccacaccttgaatcagcatttctccacctggcccatgtggaaatgaatgggttattgctgtgacccagggtgcagggtgccaaaaggcctgcagtgtgctgaggagttatattaaatgagtagatagggaagatgtacctcacaaaatagaattgtcccacatagggtgtcaataagccactgccctagaccagtggttgattctcaacagctgattttgaccccggggacatttggcaatgtctagagactttttttattattacaactggaggtggggagtgctactggaatctagtgggtagaaactggggatgctggctaaacatcctttaatgcacaggacagcccctacaacattatccagctcaaatgtcggagtgtgaggctgagaaaccctgtcctagactaatagcagttcccttccattgtcttccctgcattggctgggtaagttccaaatgccattcagatcagaagcaagtagagaccttttttgaaatggcttctcctctgccgatttaaatccatattaacgggccaagatatatggtcaggattctggttgtttttctagacaaagcttcctggatatttatagcatcaaacaggaggctagagaacaactgtgagctcaaatcttttcatatttatgtcatttaccatcaaagaaacatctctaaagccagtttggggtggttacaggaaagacaggccatcagataaggtggcaaggtcacctgctgtcactgctaattcaatttttctgcctttttggaaggcttttaaattatcaagcaatacagggtcactgttcaggccccaaatgaagtatttcaaaactggctagaaaaaattgctggtaccttcagtctgcctgtcttctgagttatggtttgccttttatggtcatttgtctgattcacgcgtaggaggggaattcacagttctggccctcctgccaccccacagcctttcctgtgtctaattacagtgactgcccctagctggcccagctggtgtcttcatttaagaaattctacttatttaaaactgttcttgatcagcgttacatattaattggttttcatgtgactagaggtaaagaattagcagtgttctttagaagctcaaataaatcataatctcagttttcaattattaaaggaaaaaagcataaatcacatttataatgaacctagttgttttccaccttttatcctacctatttctgcttttttgggatcaacaaacattagtgctgggttttgctcgatgattcagtatatgtatttttatagaagactcttttatttttaaaatatttaatgtattgttaagcctacaatagtaatataccctttgtaaaaaataataattaaacattataagaatgtaatatatgtgagttgagtccccttaacagttcggtgcatatttctcgacatttaaaaatttttcatgaattatatacatgtatttttgtgtttgtcctaaaatggaataattaagctctccatggttttgcacctttagtacatcttggacaggttccatgttaacacagatgggtctcactttcataacatctgcatgataaatatttattgagtgtatatgtcataattcattggcccagtcccccttggaggaggtttatgtttataattttccaatgctacaagcagggctgcagtaaacatacttaaagatacatttccttaattgcttccctttagtttgtagtacttggtttttggtgggtttttttgttttgttttgttttgagatggagtctggctctattacccaggctggagtgcagtggtgtgatctcggctcactgcaagctccgcctcctgggttcacaccattctcctgcctcagcctcccaagaagctgcgactacaagcacccaccatcatgtccggctaatttttttgtatttttagttgagacggggtttcaccgtgttagccaggatggtctcgatctcctgacctcgtgttccacccgcctcggcctcccaaagtgctgggattacaggcatgagccaccacgcccagccggtttttggggttttttttacagacagggtctcactctgtcacctaggctggactgcagaggcgtgatcatagctgcagcctctaactcttgggcttaagcagtctccccgcttcaacctcccaactagctggaagaacaggaacacgccaccacaccaggctaattttttaattttttgtagagacggggtctccctatgttgcccaggcaggctgctgtcgaactcctaggtgcaagtgatcctccgatctcagcctcgcaaagtactgggattacaggtgtgagctaccacatccagctcagttctttttttttttttttttttttttttgagacagagtcttgctctgtcaccaggctggagtgcagtggtgcaatttcaactcactgcaacctccgcctctggggttcaagtgattctcctccctcagcctcccaagcagctgggactacaggttcctgccaccacacctagttaatttttatatttttaatagatacggggtttcaccatgttggccagtatagtcttaatctcttgaccttgtgatccacctgcctcggccccccaaagtgctgggatgacaggcataagccaccaggtccggccctttttttttttttttttttaattaacttctcagttgtagagatggggtcttgttatgtttcctaggcttgtctcaaactcctgggctcaagtggattctcctgcctcagcctcccaaagtcctgggattacaagtgtgagccactgggcccagccactggcctgattcctaaagatagtatttatcttatttcttgccctcgttcacggtcgagttcattaaaacctttgaaaacatcactgcttacttcatatttcctggcagtatttacggcagccatataacgaatacctcttctgtgccagccactatgttgttaggctctgtcttctgatggaagggtctgtgctgtgcagagtagagttaatttgtattatcataaccctatgaatacataaaatctataaacacaattggtaaatataatttgggtaagggtaactaattcctttcaaacagcaaataagctataatgatgtggcataatgacaggaaacataccagctctttttttcttgaaggctgggaaacaagcagagctctactctagtgtcataggctggagtgaaagctgcagttctccatagcatccactcaccgcactggaaaaaatgcaccaagggaccttctctcttctttcttggcctccttgtcctgatagtgagtggctgctggctcaaggaggttgtttgcctttgaagaagaacctgcagtggttttcaactctctgatctcataggcctttcactgttgtttttacagaacctggagctggttgaaaaaggcttcagtaacttgaagaaacaaattgaaaatgccagaatgtttggaattccagtagtagtggccgtgaatgcattcaagtaagtgtagagtgtaagcgaaaaggatgaatgtggaaaatctcctggagctgattgtacagcactgcttttagctttattttgtttttcagttactgctattggttatagcctgtggttttagcctgcactgtgacaggcattgcatacgtcactgcgggctcaccacctcacccactgagggtcccaaagtcagattcagctcctatgggcccttttcctttccactgggggaagtaacacacaagcctgaagttcaatgttcctttttcatctttagaggccttttatgctaacagaaggtcataggcctatagtgttccattattttactagatctggtgggatgttgtcttgacaaagaattgggcatattactctggaaggggtcatgcaagaacttgtgtgggttgtttaggtattgcattggtggtcagggttttgttataatggcctcaccgtagtagaatgggaagcaaaaaatctttttttttttttgggggacgaagtctgtctctgttgcccaggctggagtgcagtggcacgatctccactcgctgcaagctctgcctcccgggttcatgccattctcctgcctcagcctccctagtagctgggactacaggtgcctgccaccatgcccagctaattttttgtatttttagtagagacggggtttcaccgtgttagccaggatggtctcgatctcctgacctcgtgattctcccacctcggcctcccaaagtgttgggattacaagtgtgagccaccgcgcccagccagcaaaattcttaaatgctagtatttactgattccttctggagtgctgggaattttccaagtattttacatggatttaccatctgagtctcataacgtcccaatgaaataagtgctgtgattattcgcgtattaccagggtggaaattgaggcacataaagattaggtaactggccaaaagtcaccagctagtaagtttcggagctgagattcaaacccaggccaaatttcttggttagtgttcgtttatcagtgggtaattcacatgaggtttaatggcaaaaagaagacaattctgtctctccagccattttccatgctttgatatgaaatgcttcctttataggacggatacagagtctgagctggacctcatcagccgcctttccagagaacatggggcttttgatgccgtgaagtgcactcactgggcagaagggggcaagggtgccttagccctggctcaggccgtccagagagcagcacaagcacccagcagcttccagctcctttatgacctcaaggtgggtgatttgctgtctgcaaaaaaagaaaaaagacgaaaagggcacagtgaagtttctgtgtggctacttctattagagccccatgcttcgcagcttcagccttgcggtttgattcccacgtaggtgacttacacaaccacagcctggactcccagctgtagacagccttctttttatttttgagacggagtcttgctcttttgcccaggctcgagtgcagaggcatgatctcagctcactgcaacctctgcctcctgggttcaagtgattctcctgcctcagcttcccaagtagctgggattacaggcgtctgccaccgtgcccagctaatttttcttatttttttagtagagatggggtttcaccatcttggccaggctggtctcgaactcctgacctcgtgatccacctgccttggcctcccaaagtgctggaattacaggcgtgagccactgcgtccgcccagacagccttcttataaacatatgccactgcttacttacagaggggatttaagcaggaataccccagggtggagggggaaccgttgctcatatcctaacttcgaaaagggtcaaagtacaggtggcagaagagaaggttacatatagaccaaatatgtaattcactgtagcctttaaaacaaggcaccaaccatgtagcagattggtaaggggctgcatcgagcttacaaaatttttctgatggcttttcagtaataggggaaagaagtgtgcccccacgttcacttcctggtaaggtgctgcctcaagttgagggccctcacatgcaaaaccaaagtactccaggaagcttcatcattttttccatcactaagcaaattaaattacacctggtctaagtagagccctgcttactctatgatacaataaagttagttcaggaaaaggttcttattatagggttgtgttttgttttcatttatctgtccagtgtatttcaggatgtgatttgacattaagtagtatggaaacaacaactggaaactttgttaggaatatgagatatatgctgtagttaatttttcctattctctaggctagtttctggcttgatttttttgttttgttttttgttttaagacagggtcttgctctgttgctcaggctggagtgcagtggtacaatcatggcacactgcagcctcaacctcctggacccaagtggtcctcccacctcagccccctgagtaggtgggaccacagacatgtactaccaagcctggctaatttgttttattggccaggcacagtggctcacccctgtaaccccagcactttgggaggccgaggtgggtggatcacctaaggtcaagagttggagaccagcctggccaacatggtgaaaccccatctctactaaaaatacaaaaaattagctgggtgtggtggcaggcacctgtaatcccagctacttggaaggctgaggcaggagaatcgcttgaacccgggaggcggacgttgcaatgagctgagatcactgcactctagcctgggcaacaagtgcgaaacttcgtctcaaaaaaaaaattttgttttattttattttatttttcttgtagtgactgggtctccctatattgctcaggctggtctcgaactcctgggttcaagtgatcctcctgcctcagcctcccaaagtgctgggattataggcatgagccaatgtgcctggcctggcttggtttttaatagataatcatagactttcaaaaacagccataaaaaagcagaaggaataaacttattactcttgagttttagtgttctcttatttctctttgccccttgcagatataatacacttacagttaattaacattgacattgacattctcctgttgagctttgattttataggcaagttttaaaatctgttcagcaatcatccttttagaaaaatgccataaacacaaatttgcacacaaatgcaaagcatttataggcaccctctccaggctccaatgcatagcacccaaggctggaagcccagtccttgaaaaccagcaggagacctgaaagagcagggacatatggactttagaacccatttctacttgcaacttttatccattctggcaaacaggaggctgccactttttgtcttactcagcgtctgctagtcttaaatcacccttcaaccaaagtgcttttgcttcagaagttctaaatgtgccttggcatttatagagctccagttatgagatgcatatgaaaataatctgtgtttcatctttataaagtccttattgaatgttcactttattcatgcccattatataaagccccttcataaattatcattgtttagttcaaaagggaatttttgtttttatagatagattattgctccttttaaaaacaaaacttggctgggcgctgtggtcacacctgtaatcccagcactttgggaagctgaggtgggtggatcacctaaggtcaggagttcgagaccagcctgaccaagatggtgaaactccgtctctactaaaaatataaaattagccaagcatggtggcccatgcctgtgatcccagctacttgggaggctgaggcaggagaatctcttgaacccgggaggcggaggttgcagtgagctgagatgacgccattgcactccagcctgggcaacaagtgcaaaactctgtctcaaataaataagaacctgcctaatatgttcttttagctttagttgctataaagacagatatattgcctaatttttgtaatttgctcatccaaattacccatgagtagctttgcttctgatttcctttaggcaacctctccgtatgctgttctctttgaatcttaatgccctgaactagtctacacagcatttaagaagccagctccacttctctgaaggctttgccccggaggaaacagcccatgggactgaggccctcaccagttagaccactggtctctgtccactgcactgtttgcttcaggtgccacagaaagtggacatgcccaatgcgtgttgatcatgtaaatcactgggttgttttttctaatacctgggtgattttgattttatgactatttcctaattcctggtgcttgcacttaatcaattgtgttaagggtggcatctgcctctcatatacagactgggagttatgtagatggacattggttgtcttatttcataaacagtgtccccaggtctggtttgacaggactgatctccagtattagaatagaacatctactttttaatttttattattattttaaaatttttattttttaaagagacagagtgttgctatgttgcccaggctggtttcaaactcctgggctcaagtgatcctcctgccttggcctcctcccaaagtgctgggattacagggatgagccaccatacccagcctgaacatctactttttatttatgaagaaataattattcttgggtagtcagcaacactgtttatgatgtacttagcgagagattttaaatatgtacttatgtaagtatatatttaaaaccttaatatatattaatatgtgtatctatatctatatatatatgtatgtgtgtatatgtatatctgcatatatagatataaaaactttacctctgtgggacattttcacttataaaatctgaggcttgatattaaaagaaagtgttcctggctgggtgcagtggctcacacctgtaatcccagcactttgggaggccaaggctggcagatcacctgaggttgggagttcaagaccagcctgaccaacatggagaaactccgtctctactaaaaatacagaattagccgggcttggttgcgcatgcctataatcccagctactcgggaggctgaggcaggagaatcgcttgaacctgggaggcaggggttacagtgaactgagatcgcgccattgcactccagcctggcaacagagcgaaactccgtctcaaaaaaacaaaaagaaagtgttcttaacccaatcatcaacctcaaactatttgcttatgtatatgtatataaaaaccatcttctgccccttttagggactctgacctagaatgtggctatgtcctggttaaatgtcctcacatgtgtccagtcatggtgtccccatctctttcttgtgcattagctcccagttgaggataaaatcaggatcattgcacagaagatctatggagcagatgacattgaattacttcccgaagctcaacacaaagctgaagtctacacgaagcaggtagatgtttggttagtttgtcctttcaactctttgcaaagcaggacttggagtcacaatctctgggtcctcccagccctgccaagtacccgttgcttcacttctctgggtggcagccttctctcctctgaaatactgagtttggattaggtggcacagtccctggttctttatttacccataggcgttatatgaatgtgtagaaatccatgaggaaatacagaatgtcttaccaaaatattgagaacgtctccagtttttgttattttgagatagggtctggctccattgcccaggctagagtgcagtggcacaatttcagctcactgcagcctctgactcctaggctcaagcgatcctcccacctcagcctcctgagtagctgcgcctacaggcacgcaccaccacacctggctaatttttgtgttttttgttgagatggggttttgccctgttgcccaggctggtcttgaactcctgggctcaagcagtccacccatctcagtctcccaaagtgctggaatttataggcatgaaccactgcacctgaccctctccaattttattctcatatctactccaaactattattttaaattagttttatgttatttccatagatggaaataaaatattcacttgtggactacagttgtgagtacctaactccctcacccaacagttctttttttttttttttggcttaataaataagctggaggacagcaagatagagatgtatataaagggagttggatgtttcgaataaattgaagaatccatgtaatcacagggcccagatggtcattgctgggttgtcatcttttcatttgtcctccctctcttcccttctttccccagggctttgggaatctccccatctgcatggctaaaacacacttgtctttgtctcacaacccagagcaaaaaggtgtccctacaggcttcattctgcccattcgcgacatccgcgccagcgttggggctggttttctgtaccccttagtaggaacggtaagtgcatgctgcaagggagtagtgggcgcatctgcacttctcgtctgaagtgtgttgccgaaaccatcaagcaaatgccaagtgagcagagttcactgcccagaagaaaattggaatcgggcctattatgattgctgtggatcataagctataaagcaggagctatatagctcttgctgtggaccatcttggtgtcaaatcaagaatgatgccaggactactcatactgaataaaaaattctgtttcccagggacagtatgctcttcactgaatctaggatgagcccagttgataggctggggtagtgctaacataatcacagttaatgtttattgggagccttacatagattaactcagtccccccacagccctaggaggtagggacagaggttttactgacaggcctagaacttacgtctgaaattcagggggttcattatttttaagtaaggaatttccccattaaaaaatgcaaatggacccttgagatatgaaaggtgaggttgcttatttacgcttcaaggtgaacaaggtgtccattgctttcttatcttacagattttatgcatattcaaagaagaatattgccagttgggaagcagaggggagggatgcttaaggacataatcatagtttgggctgacattgttccaaggttaacttggatcctgaatctaggttatcccctaaatctgccctgtatcctgtatctacagattgtactgccatgcaatacaggactgaaatattaaactaaatcaacacacatggaaaagaaaccaacatacatccttttggatttatgtcattctttcagtatagtaagaaagtggtaggaggtggcattatagagttgaaaacgtaggacattagagctgaattcattttcacctcttcagatcttggccttgggcaaattatgaaaggtgagagccctgctgccctcagctcacactgtaggcaacatcatcacatcacagtggtgcttagcacaaatgcctgcatctcactgcctccttagctctctatagagagcagaaggcttagacttgctatgatgtacatcagtctccaggatttgtagaaatcccttgtggtaggaattttccaccatttttacccagcaccttgaatagtgcagaaatatgtgttgttctttttggagaagttgtcagcagctaccagctgaaagacgggtagctgtactctttcttgtcacttttgatcttcacatgaagaaaagggtaacagtagaggtgaaagcaaatctggaagcagtcaggccagtgagagtcaggctgtaaggtggagagagacacagcctgccgaactcaagactttctcatttagaacaaagtatgtgtcagaggcttttaactttaagttggaccaaggcgtttccacacatgatcaaatggtttaatcactattctaacaccttccagttgccgttggggccttaacgagactcagattatttgaatattttctatattaattcaaagtgtgatggcttattttcagaactttatatctaggttcatacatgtgcgtacacataatattgtctttttttgtattttttctgattatcagtgaccagtgtttaggagggaaaatcctcttggggaatgagtgaaaatatcaaaaatcctactcatcactgtttagggaaccatctttagggttttctgctgacatgcacatgcccgtctacaacaatgggcatgtgtcttttatctttataatgtcatcttccggtttttctgctgtgtctaaggacccatcctttcctctctcctacttgtctcacacctagcacctccttacctcttacacaatataagaatataaaccagttgtcagatccctataatgtgttttggggaatattgattggtactcagaagtcagtcagaatgaggttttctaaagtattgatgatgttttgtgttacagaagatgactctttttaaataacctttttatagttaagttttagaagtaacctaagctgttttcctgtctagatttgatttggaacttgtgtgtattcattatataggacattgttacagataaaaatatacggagttttcacttgcaagccgtacatatttgcatctaagtagaaatttgtcaaagccgagtctttagaaaagtagtgagtacaaatataatttgtaagcattacaagtttagttttagaaggccattttgggccagtaagaatggtgattataaaaccatctagattatgtacaaaagtgtcttggcccaagttaaaggatactaactcctaccatcgtgttgctgaagcaaaaatcacatgggcagctcagctagcaagactgaacgaaacaaaatttaaaagcaggcaagccctgtacctccttttggtcttgcaaagcgtgagctgaggaggcgagtgagcaactcctctactccccagcactcattcttgtaaggtgaaggtggaaacacctcctgctactgcttgtgaccacatggaagatgatagtgaaggctggcatttggtttgcagaaggacatgaggaatcagtttcttttcttttccttttttttttttttgagatggagtcttgctctgtcacccaggctggagtgcagtggcaagatctcggctcactgcaacctccgcctcccaggttcaagcgattctcctgcctcagcctcccaagtagctgggattacaggcacacgccaccatgcccagctaatttttgtatttttagtagagatggggtttcaccatgttggtcaggctggtctcaaattcctgacctcaggtgatccatctgccttggcctcccagagtgctaggattataggcatgagccaccacgcccggcagggatcagtttctgagttttttaacaggatcagtgacttgatttttaatatgtaacaagagtacccactttattgacaactataaaatgatgttctatctttatgccttgggctttctttctgaaggaaaagtgaaagtaaagatgactttacgtttattttagacatggccttgctctgtcgcccaggcaatcggatgatcatggctcactgtggcctcaacctcctagcctcaagcaatcctcctgccttagcatcccaagtagctggaactacaggcacatgccatcatatccagctaattttttatttcctgtagagatgggggtctcactatgttgcccagggtggtttagaactcctggcctcaagtgatcctctccacctcagcctgggattataggcgtgagccactgtgcccagcattagtttatttgtaatgcttttttacatcctagatgagcacaatgcctggactccccacccggccctgtttttatgatattgatttggaccctgaaacagaacaggtgaatggattattctaaacaggtaagttgttactgggtaataatttggcttttttcctcatgtagcttatttatgaattatagggctcaaactgacgctataaaaattcacattctaatgctttcaaaacatttcttttcagacttccctgaggggagaggggatagtaatgagagttggcaataaccaatgaattgaaatatttatatttcaacacatttttggaagaagcgcagcatggcttgtcacaggttgacagtgtaggggagaaaactgctgtccaataaactacagaggaaactacaggagaggttagactccctctgctgaagccccaggaggcttggggttcagagttgatgacacattgcaggtcaggaacagctgacggtctgtatactctgaataggtagttagaaggcaagaattagcaaatgtcttaggaagtataatagaaaagagaaggaaacaggaccaatctggcagttcttagggccttaggtgaaagggccctgagtaccgactgcaatgagtgacattgcattgtttgatatttttgaaatttcaacaggacgtgtctctccttaggcagacccttggggctgaagcagcaagttgcagtgtgcacttatatccctagacacatcctgttgaaactgcaaaaatatcaaacatgaaaatcctaacatctttctccagagacgaaaaaagtggcttgcctatgaaaagaatgagaactagacttaacgcccgtcttactggcaataagaagcttttagacaatggaggagtgtcctgtaaggtcacagggaagatgactttcaacatgtgctcacacctagccgaatctatctggatattttcagacgtgcaagggtttgccaccccacatctcttcctaagaagttatttagcaatgtacttagcaaaatgaggaattaaccaagaaaaaaggaagacgtgagttttgggaaactgaaccctcatttggacattagcgaaggggcattctgataaccatgcaaatgacctgaagttacaaatcctgtgtggaacaggttgggggagcacctgagaaaaactagaaaaagctagaaaagacaaggatatcaaagggtcatagtataaaacaaaagctcttgcattatttgagaaagttaaggtccaagtagaagcaaactgtagtttgatgctagaacactattctttgagagggtatgtgtgatactcgaaatgcagtcatggctcacggcttggtctggtcttgaacagtattcacacagtactatggaaataccatgcatcattttcaagtccatttatggacacgccctagaagagctggtggcaggaaaggatgtaaatgttaacagctttggcaatgtgagtgggtaatggtgcagtatggaaggaacaggaaacatttcagtgcttgcttagagaaaacatttatttcttgtttttccttccagatcaccatccatcttcaagaagctactttgaaagtctggccagtgtctattcaggcccactgggagttaggaagtataagtaagccaagagaagtcagcccctgcccagaagatctgaaactaatagtaggagtttccccagaagtcattttcagccttaattctcatcatgtataaattaacataaatcatgcatgtctgtttactttagtgacgttccacagaataaaaggaaacaagtttgccatc

SEQ ID NO: 342 - DNA, 39532 bp, Homo sapiens
atcactacccagcccttgaaagatgagctgttcccgccgccactccagctctggcttctgggctccgaggaggggtggggacggtggggacggtggggacatcaggctgccccgcagtaccagggagcgactgaagtgcccatgccgcttgctccggagaaggtgggtgccgggcaggggctgctccagccgcctcacctctgctgggaggacaaactgtcccagcacagagggagggagggagggcaggcagcggggagaagtttccctgtggtcgtggggagttgggaaaagttcccttccttccggaggggaggtctgacaggcgatggggagaagggttcccagcaggaggaatcgccctgtttgtctgttgtaggtttctcttctctgaatcaaggtgacagacaggcttgtgtgtgtccagtgtgtgagggatttcgtgattggattttcacatactttgagtggacaccttggagtaaggcagcgaggtgtgtgtggtgcagcagggacgggtgctgggtggaggctccagaacctggcttttcacccacagctgtgccactccttggccctgtgtgaccctggacaagctattcaacctctctgagcctcagtttctctgtctgcaaagcagccagctcgctggctccctgggggtggcagggttaaatcagaagcaggcgggggtgggggggtttgtgaatgttggctgatgcgcctccaggaggcaggtggtagtgactacctcagatgggcttagagaccctcttcccacggtcctggctgaccagggcagggggataggatggtgcaggggttccaagcaccggctttgcatccggcccaggttgcagctccagccctgctctcaccctgtgggtgacgtttttgggcgagttattttgtcctgtctcctgagctataaagaagacctggaagttcctctttatgcaaagatagaggtaggctcttgcctgtgaagcaccacgtatgtcataggcactaaataaatggcagccgtgattcgagttgctgagagtaggtcgtttccgcagcctgggtggaggtgaacagcaggtgttgctgttccaggcaggtcagaatgtgcctcactgagtcacaggccgcctgtggctccccagcctacaggaagtgggagccctggcctgggtgtggggtgatgggggcctccctggccaaccccgcccctaattccatttctgagttggagaagggcttaggtggtgggggaacaggtaagcaaccccagaggacattgcaaagaggccctgcccgaggttctctggagaaaaaactgtgctgcgtccttcgggccctggcagcagcaagagacattccacagttgtgagccccacaagcttggaggaagcatttgctgtttcccctgcttggggtgagagcaggggacagccaagagaaggcgtctttggatgaaaaagaggaagcatgcgtgctgtccccacaggcagcaccccaggcctcatcccagctctccctgcaaccctgcactccaagcctctcactgcactgatgaggaaactgagtctcagagggggaacatgacctcagccagcccttcgctcagtgtccagggaaatgcctcaatctctttgggattccctcccttgcaaacggggaggttcccatggttgggcctgcatgatggatctgaggactttgaaagtggtatttgcctgccggtgggacccaacctggaaatattaggttggtgcaaaagtcatctcggttcttgccattagaagtaatgccaaaaaccgcaatgacttttgcaccaaccgaatagctgtgccacgtggtttttgctaacacagtgactggctcagtaacaagtttggtggctccagaggtaacattagggcggcctcctcacctgtgctgcttgtggtcagggaggggcccacctgggcgcggtggggggagccctgcagatttgcccagtgtcatagcctgtttgagctgctataagaaatactttagactgggtaatttatcaaaaaacagacatttattgctctcggtgctggaggctgggaagcccgagatcaaggcactggcagattgggtgtctggtgaggacctagtcgtcatagatggcaccttctatgcatcctcatatggtggaagggtgaacacgctctcccaggcctcctttaaagaccaccaatcccattcacaaggagggggacctcatgatctaatctccccccagaagtctcaccttttaatatcaccagcttggagattaagtctcaacaggtgaattttggagggacacaggcatttggatcatagcaccgggggactctggttttcagaatgaaagtaggggccttgtctatccgctcaagctgcctcctctgcactgaaaacgatgcctagcccaacatggatggatcagtgtttgctgaaatgctgaatggttaaatgaataaataaatattgctcatatagcaggcaataaaaaagcatacagaacctatcactaagtgaatgaagctactctgaaaaggcatatgctgtatgatttcaactatatgtgacattctggaaaaaggcaaaactatgaagacagtaaaaaataaaaaaaatcagtggttgccaggaattaggggagggaggagagaatgggaggagcccagagacttttagggcagtgaaacttctgtatgacactgtaatggtagaggcatgtcattgtgcgtttgtgcaaacccacagaatgtccatcaccaagagtgaaccctgatgaaaactatggactttgggtgatgatgatgtgtcaacgcaggttcatcaattacaacaaattgactgctcttgtgggggatgtcagtaacgggggaggctacgtatgtgtaggcacaggggatatatggtaagtctccgtactttctgctcaattttgctgtgaatctaaaactgctctttaaaaaaaaaaaggcacacagagcagatctgcatgttgttttgaggattcagaaggcacttaggacaattacggtacctcagggtcatgagtcaaacaatcagacctgccaagacttgacaccccaaatgcatcacttctgacatccattgggtccaggaatcccctgcctcatgaatatccatcttagtgtgcatgcctccaagaatggggagctcactactttgcgaggcagcgcattccatcttaggagagttctactgtttaaaagctcttcctccaactgcccccactgagcaatgggtccactttcatttccttggggtttgtaccattctagtcctattgcttctctctgagctaaatatccacagctactaaatctgccccccttgaaaagtgttaaatcctcaattcctcctctgagctcctctggttttcctggggacctaaggctctgcttccccaaaacacccactccagggttgttttctagaacaaacgtaaggcatgaagtatttctttgactctttcatcacagtgggttctggaagattctggaggctggaaacatatgtgcctccccctccccacacacattccaaaaaagtcatcacagcagaaagcacggtggaacaaacagctctcggttcgaattcaccgtcacttactggccaggaaagttatctgagcctcagtttcttctcctgtacaatggggagcatcattcctatttttgaggaccactaggaggcttacctctgtttgtgctgatgtagtgaaaggggatgtcaggcacactgcaggagctcaggtaccagacggactgtctatggaggcaggagtgagggcctggggcggtcacagaggttgcatttgctttgcagtaaggccatggccgcttaagggtgtccagaaaaaagccctgtccgacatgcacacactcctgtgtccaggcaatgagcctgtgggcactgacagcaagagtccttctcacgcttctcttcagggctcaaactttagatttactccggcctgtcccatcccattcactgccaacccctctgagcctctctgatctgtgccaccggtgaagggcagtcgtggggcacagagaagtggcccagctgagtgacatctggaaatgagcagtgcctgaggggacgcccgtggggtgttgtgacctgtacagtgccaggctccagcacagccccgtcgcttctgtggttcttatcatggtcatgaggtcgcttctcctcttccctgcgggtttcctaagtggtcacactccagtggcagggtggtctgccggagaaagaccaaaatttgtcatactttagaatcacctggagactggtcacccacgcaggtgcgggggtcctgctctggggactgtgatttgaagtctgggtactattcactgaaatgacagactgcggcaaatctcaatcaatcaaggttcatcgagttgataaacttcaattgacatttatcgagagtttgagggtgcacctgggaaaaacatgagccacagaaaatgtgtgtggcctatgctctccgaagagtcatgagacttagtgttgtaaatcaaagagaaactgactgaagcaggtctcaattatttttgaagtttattttgccaagattaaggatgcacccaggaaagagggacacgaaatcacaggaaacatctctggcccatgcttctttcaaagaagggtcttcactattcaaagggaaaaaagcaggcagtaggggaaagaaggaaaaatcgggggaaggtggccaaaagaggcaagcagttgcacccctttgagccttttcattaacttcactgaatgcacatttttcatgtgaaagaagcaggtggaggaatcatcaattccgcattcacctggtgctcagtcaatctgcatttttatataagataaaataatcatagggctgggcacggtagctcacaactgtaatcccagcagcttgggaggccaagttgtgtggatcacctgaggtcaagagttcgagaccagcctgtccaacatggtgaaaccctgtctctactaaaaatacaaaaactagccaggcacggtggtgcatgcctgtagtcctagctacttgggaagctgaggcaggagaatcatttgaactcaggaggcagaggttgcagggagctgagatcacaccactgcactccaggctgggtgacagagcaagactctatctcaaaataataataataataataatcatcatcatcatcatcatagcatataggaagctgtcagctatgcactcgtctcaggtgagcagagggatgactttgggttctatcctttgttccatacctgtgaagctaagctgttaatttatatcatgagggtgaaatacaacagagctgcttgaaggcaaagatcctggggcccacaaggaatttcactgtgagcaaaatgtgagggaagtaaatagttatccatttagacacaaaacgggaggcgggttgcatgacccagctcccagctagacttttccctttggcttagtgcgtttggggtctggggattttaattttatttttctttcacagtatttacacatgtccttgaagtggagaaagcatgtaggaagaggaggttaggcagaaggaggcctgatctcatcttgcctttgtcttgcttttatgctgtacctggggagatcagcaccatcagcgtgactctaacagacttgagtgtgaggagctaggcttggattgcagacctcaagttacaattgatgtgtccttgttttgtggtaagatccacatcttgaaaggtttcacccagcaaagaacaatttgtgggggcagtcatggggagatatccgaggccttttcctttctgtgggggtctggctaatgtctaaggttgtggagtaacagctgtcattaggaataaggatgacaatgttggctgactcagtctccaggcttaactttccctttggcataaagagtttgggggtcccaagatttctgttttcctttacagtactcaaggacttgctaatatctcaggggatttcagccacactttgaaacaagctaccttagcaaatggtctgtcctggacccaaaagccactctcctcaggcccttcctcctagtcccaccagccaaaaaacttggggaccccaaacctgttcttcactctctggcacctgtgctcatgtgcctgctgcctcaggaaaggacagaaaccctccccgatccaagttattagcaaactgcccatctccacaaaaatttaaatggacagattgttaaatgcacacagctcacagccagctcctttcaaggtagatttgggcccaaacatttcgggaagcatcaggctgtgccccgccatccctaccaaacaggaatcctctcgagggaaaagactgggcctttccctcagcccctagcacccactcatgcttggcacctgctgtgctctaagagtgcaggggtcactccctgaccacagagggaggctctctggggttctcccggagcctcggagattgcaccttgtgcatgcgctgctgcacctggggtacatcacccccactctggagcccactggccggttagcaaagtgagaggtgagagaaggacctcttggtcttctttgaacagaaagatccagaaagcaatggctagaacacaagaacaggtcaggggaggcaggagagggtctgcacacctgctacaggtgtgctcacacgtgggccagggcctgcagatgagggatctgtgctgatcatttgtgatagccaaaagtagtgaaaacctggggggactcctcaaatgaactgtagcacattggggagatggactctgtgaagatgattcctctctccacccacttcccttctccctcctcctcccgctcctcctttttcggaagccaggcacagggattgaatcccaccccattcctcccctgctgtgtgacctagggcaagagatgtggtctctgggatccttcggttccttcagctataaatagtagtagaattgcaaactacctacgaaaactgggaactccctgcgaaggccggtgcattacagggcagtcctactctgaaatactgtgaggctattgaaaagcaaggtgggtcgacagattgttaaatgcaaagaggtgaggacacagccggcggtgcatttagggtgcttctgcaggcgtccttatacatggatatgtgcacatctgctcctgaaagctcagaagatgtctggaaagcaacaggagacaccagtgagcctggctgtctcttgaggcaacaggcagggacagaatctggagggagacctacccctcactgtattctttttcgcactctgaaatgttaccatgaggatgcatatctctttgcaaaaatttaaatataaaaagcaaaacaaacttgaatagaaataaactacttgaaaattttagaaaacactgttacatcaaagagacagatcatcaaaactgaaattatagatatttgagaaacaactaactataagaacactgcttaccaaacttatgggatgcagccaaagccatagtcaggggatgagtcatgcctttaaatttttaaattattaaaccaaaaagattgcaaaaaaaaactgttcaattcaataaactagataataatgatccaaaaaagtagaagaaagaaaagaattacaaaaacaaaatgacaagttagaaaggtaaaaagcattaatgtcagtaggccatctaaggatggctctttgaagagcagacaggagaagggcaatcccaggaagtgctatgtgctatgcagagaattagaataagttgatggcagagatcagtgggtggcggctcacttgggtggtaaagagtagcctgcagccaaagttgggcacagcagtgcagtcttcactgggggaatgcctgggaaacaagatttgcctgggtaggagtttccatcagcacccccagaaaggtctcctttctaccctggcccccagttctttgatgggttttgctgatgctcctgtgtctctgaacagcaggcgcctcacctatagaaaggtaggatagcaggagttaacgccccctcccccattccatggcccctgcctgggattctaccatctctgcttcatatgctttataggagttcggtctgagcccacaacccaaacaggctcacagatgtgctagctatttcgccaccagtatttttttaatagtcaatatttagaaattggcaccaactggcccgattgttcaacagtcctgggttaggttactaggccaattacttgctgagtaacccaggacaggtcactgacctctccgaacctctcctttctcacctgtgtgataaagactactgctgtgccaacacaataggactgtgtatgaaagtacccagactgtgcctagactcaggaagctggtttattccttcctcccctaaccacttactgagagactgctcagggctcccctcagctcagagatctttccccacaaggagctgagagcctggtgggagagacaggcagagacccaagtggttctaacacagctctctgaatctgtaaccccaagtcccatccccagaggacactgggacagtcacactgatggtttgtccctaagcctccagcatcaggagccatgtggcaggatctccactcttcttcttcctgggcctctgtctggaccgacccaaacacacacacacacacacacacacacacacacacacacgtgtacacacacaagttgcttctttgctgcctgcatgtcctcacaccagcttatgacacacctacaatgtttgatgtgtcattgtgggcaggtttcaagttggaggacctagacctaggtaaagtagagggtctccctaagtaagggagggtgcacagtggagagaaagggtaggggagactgcccagtgccattgacatatgcctgagccccagggcacccttggccccccaaaacaatcacaagtatcccccccgacaaacctgccaagtaggcattgtgtctccacttgacagttgaggaaatggtccctagaggggagacagagctagctagagactgggctggccctggagcctggcctgggtcttcccatcgcatcctgcctccctacataagcaaaggtcgagaggtgggaactcccaaagatgctcaggcagggccaggggagaccagtggggcagggaggggacaggaggggaaggaggagctggggctggagagatgggtaggagcatgagtcccttgcctgggcctccccatggtgggcggtgatccaaaagccccagtcagagccctctgccctgtgacgggggcaccctgcatgtcccctcactccctgccctccagtccccgccagtcctcatgttttccatgaggatgagtacagccgcagggactttccctgcaagtggtctgggccatatcttccgggagtctgtttggactgtggtgtctgtggctgagggggtggaggtgagggcacccaggcccatcacttgacagaacaatctgtggatttgggggaaagaggaggcgactgtcattcctgagagaggacgggaaccaacaggaaggattcctgagtgccagggatgaccacactggatcctcacaacagccctcctgccggggacaatgctccttatcccacaagcggggacctgggctctgacaggaggccacacacttacagtccctcccttagtgaccggcagagctgggatttgaacacccctggtgagactccctcgtccagaccccttcgttgtacagcaggtttgcctcacatgccagagtcggggtggcctcagggcacagccaggagatgtccccaaatcccgaaatgtggtttgagtcccagtccctcatctctccagcctccaagccctcacctatgcaatggtgccttgcccggctcacaggttatgaaaaggggtgagacgagacagtgtcccctaaatacatctgacagcacttttgaatggaaaagagaaaaagaaaatactataagcatccagattgactggaggttggggagttggtgggggcggggacaggcaatccataaagcaagaaaaatcaggctgggttcaggcttttctgcagcagcgaatgcatcagagctgccaggggggcagctgtagacctaagagagttcctttaagcacaaattggctgattatcttttttacgtaaataaacccataattcattccaaacacttggcttatttaaatatttttattgccaaaggaatatatgttcttcacagaaaacttggataccatgacaaacagtaaagaaaacccaaaagcaacctatgatcccatgctcaaagacaaccagcgccagtaataatttggtattttgccttctcaacttttgaactttgttgtatgtacaatttggttacccagctttttgttcccctaacatgttatcagaaacattctctcatttttggtgaactcttagaagcatccttttttcatgtctgcttgacatttgttgaatggatataagatcatgtatttaaccaactgcctggtcctaaacatttaggttgtttcctgtgacccttcttctgcatgatgaggaacatctctgtgcataaagcttttcctgtccttttgattattttcaaaaatgccaaacaaaaaaaaaagggagggggttgaaggttctgggttttcttcactgaattatccaaatattaaatgatctagagacaggtttgggagccactaaaccctctcctcctgtctgaccctattcagagaagacattggaagctgccatctgctttcctctcacagtctgtaagtggctcattaaatacttgcaaactagattatttttatgttgtcttggctacaggagtttctgcaggaatcagaaacaggaagaaaaggcaggtccttggagacagaggagctggcatctcatcagatgcaatttcttattaatagtcatccctaacattgattcggcatctactaataatcaatcccttcttacagataaggaaactgagtagcaataatctatcccatcttacagataaggaaactgagactcagagaggttaagggcactgcagtaagcgcagacacagagctatgactcccgttctccctgtgtcagcccctgcgcagtgcgagtgggaggtgagccactgttgcgtgccctctgccagacacaggcctgcaggtcagactcacaggagccaagcagagcatctgggaggattttgtttctggctccaaaaatgaaataccaaggaaagtaggcaagctcatgcatgtcagaatcctcaatctcagctcaggaagtaggaattttccacctttgttagcagcagagatgacaaaccccagggccccacatatagcctgtgccttagtcactgcctcgggccaggttgcaagacccctcctaccaactgagctacaaatcacagttcctggagggtgggcctttatataacagggaacagaactcttctgtacctcccacctccccgcaagaagtaggccaggcatggtagctcatgcctgtaaatgaagcattttggtagaccaaggtaggagggtcacttgaggccaggagttcgagacaagcctgggcaagatcccatctttaaaaaaaaatttaaaaattagtgagctgtggtggcaggagctgtggtcccagctgcttggaaggatgaggtgggaggatcgcttgaacccggtgggtagaggctatggtgagttataattgtaccactgcactccagcctgggcaacagagcaagatcctgtttcaacaaaagaaaaagaagagagaagaggaagaaagaaggaggagaagaggaagaagaaggaggaggaggaggaaggaggaggaaggaggaggaagaggaaggaggaggaggaaggaggaggaggaggaaggaggaggaggaggaggaaggaggaggaggaggaggaggaggaagtaggagaagaagaaggaggaggaggaggaggagatcctacagcactgtttggaagattatgggaaaattaggcccacacatctgatatacaatcggcacatcctacaaatgtaaaatgtgtgtcttgaaccagaaagcccaaggagtgaggggctgtggcattgagtggggtagctatacatagccctagggcttaaatctatagaatttaagtaatcctggtccaaattcaccagaaacattgcctagactttacttgaatacctttagtgacagggaactaactactaccaaaggcaactaactcagctcagcaaacattcagtgatagctgcgcttccccaggaccagagattcagataagcaaacaccctgttctgtgctcaagggactgatggtgtgtgacaatcgagatagtgtgaagaaaaaggacagcatatgtgtgtctctgtgcatgcatgtgcaaacactgacactgcagtatgtattcagaggaagtcactacaatggtgaggcccacctggcaccagaatgaacagatttaagaaagctagtcaccgcagacggtcacagctggaaggattttacaaaataatctatcttatcatcctcctttgccctagagatggggaaactgaggcccaaagagtgaaagccacctgctcaaaggcatattgttgagtctaataataaaaataaccatagcaatagcaacactgagggcagctgtcccagatggacgctggctccatgccagcccctgggctaggcgtctggtggcactacctcatttcactgccataacaactgggtcccccatcttgcagatgaggaagcccaggttcagagaggtgaagtggggggctgggggtctatcccagaccttgttgtcacctcctcactctcccagtagcgccagccagagcacctgtcttgggagccccgaggcagggacaggctatgcatccaggaagcccccaggctctaaggaggcggccctataactgctggatgaccaaaaatcaggcagcgatccctaagtcccttctgagccccaggctccagactcctccaaccaggtctgccttacgcttttgaccacaatcaacccggctctttctcggttcttttcatctctctggtggttttgtatgcagagtcacccaggtccccacttacgagcctgtgagatgggataaatcacttccctttgctgagcctcagttccttcacctgtaaatgggcataacaagttcctccaggacaatcgtgaggctcagggaaaggactgtcgtgcaaacccaccatggcatgagctgtcgagtgcagtgcccgctgccactaaggaatgagtgccactctgggattgtggaaagtgcagacgggcagggttgagatgctcgtgcatgactttggacaggtcacctccctctcagaggtttagtttccttacttgttaagcttggactaaaaatatctaaatggtgagatttttccaacttctttggctctagcatgtctgtggtccttgatggtttacaaagcgcttttgcacttgagacccctaagtgctaattctaccacatccccatccacttcatagtgggatgaccttagccaaggctcttcacctaaacctccataagcccctcgctggaatttgagcctgttttgcttttttaaagtgagggcaatgctactggccccacccatcttacaggacaagggaagcccaaggacatgagagctttctgagctgcatcccaggccctgctctgccactgactcgctgaggctgggtttccccatctgcaaaataaggacataaaaacccatctagagctgggcatggtggctcatgcctgtaatcccagcactttgggagtccagggcaggcagatcacttgaggtcaagagttcgagaccagcctggccaacatggtgaaaccccatctctactaaaaatacaaaatattagccaggtgtggtagctcatgcctgtaatcccagctactaggaaggctgaggcaggataattgcttgaacccaggggacggaggttgcagtgagccaagatcacgccactgcactccagtctgggtgacagagcgagaccccatttcaaaaaaaacaaacaaacgaaccaaaacaaataaaaacccatctagagtgttgtggggattaaatgagttaatatctgtgaagtgctttgaacagagctggcacggccgggcacggtggctcacgcctataatcacagcgctttgggaggccaaggcagggatcacttgagcctaggagttcaagaccagcctgaccaacatggcaagaccctgtctctactaaaaatacaaaaattagcagggcgtggtagcatgctgctgtaatcccagctactcagaaggctgaggcaggagaatcgcttgaacccaggaggcggaagatgcagtgagccaagattgcgccattgcactccagcctaggtgacagagcgagactctgcctcaaaaaacaagaaccaaaaaccccttaagagaaatggggttttctcttatgagaaaaataaatatctccggtgtttcctctgacttgcccagggctgcacagctcacaggggaggggtggggaccgggacctggcacttggctcctgctgctctgccctatgcccttggggacttctggacaagggtgggcttctctgggctgacagaggagacagaggcaatggtgtgctggtaaatggttaacaactggctctctggaaaaaaatgccctaactgtagcaaaaaaaaaaaagagactagaactggcacattgcagatgatataggcatttgctgtcactatcagcatcagcatcattacttgtcctttcaacaaatatttcctgagcccctgtcgtaggccaggcccagtgctaagaggtggggacacagtggagggaagacagaaagttaagtgtgctgtttccataaagtgtgctgacagccatataggagcactggggctggggtgtctctacggtgcctgggagggtctcctagagaaggtgacatcaagcaggttctgaaggatgagtaggagttggaaggagttggaagagctcctgccctttgtggagcaggagagggaggtggtccagggacctttctggccgaccaagcctagagccaattgcagtgagccattgtgacattggacttgaaactggtcactgcgagagtatttataccatagaaatttgcaaatgctacggttagggcatttttttccagaaagcccgttgttaaccatttaccagcaccccactacctctgtctcctctgtcagcccagggaagcgcacccttgtccagaagtccccaagggcatagggcagagcagcaggagcccaagtaccaggtcccagcccccacccctcccctgagagttgtgtggtcctgggcaagtcagaggaaatgccgggggtatttattttaaaaagtgtctatcaggactctacattatgccaggggtctcaaaggtgaaagaggcatgagtttgtccctcaagcagctcaggaggagctggaggaggtttcctaggcacgagcttatccacaccatgacacatagaccctgaagtgttttaaatcaattacaaaaagcaaaaatacaaggaagctgacagatctttactttgggagaagtggaggcttgggaacaaatgagatcatcaaggtctttttgtccgttttctaaggagttggggtcattggctgagatcctgcagatctggaggtaccaacatgagactccgagggccacctcctctgcccctccctccccaccccctttaaggccctctctggaatccatcccttttcctccatctccccagacctggctgaggcctccgttgtgcctctggtctggtgcctcagccccctcgcttcctgcttccagattttgccaactgccccccacctttgaccatgtccaggcatcctggctcaaaagccaagatgagatctatacttgagagcgtatatgagagggatgcaactgaggctacctggagtgcgtggacacagccatggcctcaggtcatcatctcccccacgaagcctcccacacctcctgtccccaacttgggcacacttcccaccacctgggagacccctgagggcaggcaccatctgtccttcaccactatatccccctataaagagagataatgcagtgaggtgccggggttcaaatcccaactccacccatcaccagctgtgtgactctggacaagccacctctgtgtgactctggacaagtcacctcactgctctattcctccaatttttataaaattgggatagtaccagtgcctgcatctaaaataggtgtggattacatgaattatttcatggaaagtgcttagaacattgcttggcattcatagtaagcctccaaaaactgaagctattattattccctggttgctggcccagactaagcactcataaatttgttgaatgaatgcaatgtaaacagggaaatgctctgtaaatgctggtgcaagctcatcagcttcgttgtcgtcatcagcattgtcctgatgctattcatggtgggtgtcctgtctggagccctgctggctgtagaccaccaatgtgggcacagtcctagcccctcgctcaagtagggtatgcgaggactcaggagacgtcaacagacattcacagtatttacactgggaccttggaaccagtgtggttgagtagacacccggaggacagagttctgagtttatttgggaggggttgccggggagagtcagctgtctggaaaggcttcctggaggaggaagatttgctagaggtgcttgagtggttggtgcaagggggcttgtggggaaccagagcgtcctggtgtttagagcagcaaggaagaggctgggtaaggacaaaggacattgggacagacagaaagcctgactctagaaagaaggggccaaggtcactggagaggagagagaggaaggattaaggacgattgagtgggtcataggggttgagggctctgtgtagggaaaacagtttcccactcaatcctttcgatgccactgtgattaaatgtgtgggtttatttcctcagaaattgtcttacaattccgttcagttctgacattatctgcccggaggcagcacaggataagagctcagtcccacaagactgccgccacttcagaacccatcgcaagtctcaagtggcctgcacttctgaccaaccagctgtaaggcagggttcccacaaccccctccacgggttcagtaatttgctaggatggctcacagcatcagggaaacatttacttacattactgacttataataaaagacaccactcagccacagccaggtggaagagaggcacagacccacacgtggggcaggggcctggagcttcggtgctgtctctgggggcaccaccagctcagcacttccctgcgttcaccaactcggaagctctcccaatcctgtcttttagggattttgatggaggcttcatcatataggcatgatggataataaattcaatctccagcccctcttcccttcctggaggatgtggggtgaaagttccaagctttgtatcatggcctggtcattctgatgacagcccccatcctgagcctatccagccaccaccaagagccacctcattagaacaaaagatgtgcctatcatctagaaatgtcaagggagttaggagctccgtgtcaggaactggtgtcaaagaccaaatatgtatttcctaatatatcacgatatcacaggttgtgagaagaatgcaatcaatggtcaaactccagagctgcacactctccaatatggcagtgaccagccacatgcagtcaccaagcacttgaaaggtggctgcttcaaactggtatgctaagtgtaaatacacactagattttgaagagttagcaggaaaaaataataatataaaataactcaatgactttttgtattgattacatattaaaataatgttttggatatatttgattatatctcatatataaccaaaattgatttcacctgtgtctttttactttttttaatgtggctactagaaaatttgaagttacttctgtggctaactttatagttctattggacatcaccgaccgctctaggctatggaaaattctgtagaacaaacaactggaagttggaagaaaagacagtaagaaatagcaaggaagggtgtgctgttgggagttgcttggaggttggcggcacagggctgaaggctagcaaaccgagcgatcatgtcacacaaacaaattcactattcggacagatacgacgacgaggagtttgagtatcgacatgtcatgctgcccaaggacatagccaagctggtccctaaaacccatttgatgtctgaatctgaatggaggaatcttggcgttcagcagagtcagggatgggtccataatatgatccatgaatcagaacctcacatcttgctgttccggcgcccaccacccaagaagccaaagaaatgaagctggcgagctacttttcagactcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctcagctgagtgtgaccctaggaggcacaatgtgctctgtatccagaacacacttggcagatggaggaagcatctgagtttgagaccatggctgttacagggatcatgtcaacttgctgtttttgttttttcctgcctggtgttgtatgtaaggtcacttgtggatttatgtttcagcgtactggaaactttccattttattcaagaaatctgttcatgttaaaagccttgattaacaaggaagtttttataatctaaaaaaaaaaaagaaatagcagggaaggctgtaggtgaaaagaaacttaagagacctatcaaacaacccaatgtgtaaagtcatttgcattctgattcaagaaaaccagctgtgaagaaagtagcgtgaaattcatatgattgaaagttgtaatacttcctggatagttgatgccatttaggaattattgtcagtttcttcgagatgtgataatggttgtctagttatgctttctgaaataagagtccttagcttttagagaagaatagtgaaatatttacagatgaaatgacagacatgcaggatttactgcaaatattacaggaggggtaaggtaggtttgggcatagagaaaaagattggctgcgagttggtaattactgaagctgggtgaagtatgtggagtttcattatgctagtctatctacttgtgggtatattccaaattttccataataaaaagttaaaaagcaaaaaaaagaaccatcatctccacctgaggttctggcccagactgcttatgttcaaatctcaactctagtcttgctagctgtgcctctgtttgctcgtctgcaaaatggggatgataatattagtccctacattgcaggggtttctctgtaatgtgcttaaaaatatggaaacaatataaatgaaatgaagatatgttgcaggcactttgcacattgtcacggtgctcccagtgccttgttccagggaggttatccttatttaccaagaggttaagtcacctgccctaggtcttccagtcagtggaggcaaagccaagacatgtcccgagttcatctgacttctgagttcaggcatgacctgaatgttcttgcctcgggctcagggctcaacatttcctgtcttctctgcttctccagtcctgagagattctgggcccgtttccctgcagatcagctctaaggaacatgcttctctcctgctcctttctagaaaaggcgtaacattggcagaaccaggaactctggaattctgaaggttgactccctcaattccaaggggctccacctcctgagcggaattggatagaagacaaaggtcacatggctagggtgaggctttgagatgggcgagactgtgagcaggactgacaggtcagggccaggacccaggatcttcagaagccacagggagcaaggcagggagcagcctcctttgtgccacacccagtgaaggggaacttgctaagacagatttgttcctcccatctccagaagagccgttggatgccaatgggtgaggagctgaacctctgcagactcagtgtgctgatcccattgcctctgcttgcatgcctctcaggatggggagttcactgcatccccctctttaaagacattacggttgtacaaaggtctccagaatcatctgttacatcccctcattctcccaatgaggaaattaaagctcagagatgccgaggcatttacccaagggcacacctggtcctgggcctacgacccttagacaatattccttccacctctttgctatagagtctcagactagggatcttggctggctgagaaatcagggaaggcttcttagaggaggtgagattggaggtggcccttgtagggtggcactaagatgtcgcttgatatcctaattttttttttggccctgcccaccatgtgtgtgcctgtgctgccatgtcacactaagcagagtaaaatgaaggaaggaacggatgaaaggggcaggaaagcgactcccaggagctgaaagggcaatagtataggtcccttcagcacctaggatatgttgtgggaagcccttagaccccagatactaccctgtgcagatagggataaaactccacctgtcccagctcagtgctctccccggctcctctggcctgcttgctgggcagggcccaaaccagttcaggattcctttttctctgtgacctaccagttagggttctctgtttactgtgtctcctcctccttgttttgtatacccagctgggtgggaagaaggtcacagcccaggtttgcacgtggtggaggagcagggccagtaactggttaggcagagaccccgcccaccaccctccactcccaccctagcagggcctgtgccatccccaggacaccggagaccaccagggggctggagaggctgcgggagaaacagccttcctggacacacccagctacggctcacttcccagcctgagctgttccttaggaattgcttttctgggaaacacaccctcttccagacctgcagccttcctttctatgtggtttttggttttgctctctggtgagggtttctattttttcctggtatacatgaatggcatgcaggaaagtggaatgaggacatcatgaccaccatgcaaaggccattgctcttaaggtttgatgtaagctccccactctccacccccactacccctctgcctcggcctggggtatgaggtcttggttttgacaatcagacaatgttagcacactgctgtgtcttccacctgcaatggagcactgtaggacgattttaaaaagcaaagtggcaggccaggtgcggtgactcaagcctgtaatcccagcactttgggaggctgaggcgggcggattacctgaggtcgggagttcgagaccagcctgaccaacatggagaaacccccgtctctactaaaaatacaaaattagctgggcgtagtggtgcatgcctgtaatcccagctacctgggaggctgaggcaggagaattgcttgaacctgggaggcagaggttgcagtgagccgagatcgtgccattgcactccagcctgggcaacaaaagtgagacttggtctcaaaaaaaaaaaaaattacaaagtggctgaataccaagatcctaggaactaggttcagccaaactggctgtgtgtcctggtagaatgcccaccctctgtctctgggcctccatgcccatctctgtagcatgagggattctgatgaaataatttccaagagcccttcccacactaatactccaggattctgtaaggttaatttggcaagaattccaacggcggaagaaagatggagggaggaatatgtccagtctaataaccctatgctcaagtcagaaagcccctcgggcagtgtccgagagggctacagccctggccccagaacctgagtccctctaacctgggtcaaacccctaaaagccactccagcaagagacaggcaaagcccgggctcttgctccaggctggcattgccttgccgtgtggctgtagacatcgtttcacctctcgaggcctcagttttcccttctgcaaaagacaggctgggggaggttgggcattttcttcttaactaccaggagtctttcctccaataaaattgtgatggaaaccggatgtcacacaaagggaaaggaaacactggcatttctggagtgtttgaagcatgtgaagtattgtttaagggctttgcaatcattaatgtactttgtgctcacattaaccccacaaagtaggtgctattattatccccatttgacacatgaagaaactgaggccctgaggagttaagccacttgtccaaggtaaagagtgggagctgggcttctgatagggagtgggcctcagtcatgaaaccacaagacttgtgtagttccaaccccctggggacatctccaggcacttgacccatgctcttccaacattcatgtatgcacgcacacgtgtacacacacgtgcacacacaaacacacacatgtgtgcacaaacacatgcatgcacacacaaacacatgcatgcacacacaaacacacacacatatatacacacaccaacacaaacacacatgtgcacaaacacacgtgtgcacacaaacacacacatgcacacacacacacaaatgcacacacatgcgtgcacactgtggctactcctctgtagcctgctggccacactcggctcaagccccaaatcaaaggtgactagcaagattgcgagacagatttctggagatgggaaactgcgtcatcaaattgtctcagggacggaacacccatcagagccctgggggagagaagagacacggggtggctgccaattttgctgacctatgctgctgactttccagcagcccccgactcctgtggccagctgagcccaggtccaagctgccccctgcacagggcttgttccctggagggctataagccacagcatcccctccaagacagccagtcctgtgaacctgctcaatccctcactattccttggggcctgccctgggagaagggagagttccctggaccccttcttgggacttgcggtgacaggggtgtggctcacttgctcaaatcccttgtgtgaggggaagcatgcaagcaagtgggtgctggggccggggcaagcgcttttgggctctggccctacagtaccgtctagggttgtgttacaattaatgctcttttagaagttgccattcactgatggctaagtgttaaccaactcagtggagagtgagggtgacagccttttacaccctgccctcttggtacctgggtccttgtctggcatccaggaagaatcaggtcacacggacttgaaggatggtgaatgcagaggttttattgagtgatggaggtggctcttagtcgggtggggagctggaaaggggatggagtgggaaggtactcttccagatggctgaactcttctccaactgtccagctgcctcttccacattcagacacttcttctcttctctccttctctgccatgctgctctgctcctctgccagtggagtttggggtttttatgggtataggatggggggcatggtgggccagggtggttttggcaaaagcaacactcaggtgggaaaacaggaatgtgaagttctcatttagggccgtgggcccaggcttgtgggtggggcttttgccagagagctgtcctcctctacccagtatttccctgcctcctgtccatatcacctgcaccaagaacctcactgggtgggagccaatccagagccagagaaaggacttgacacttggcctcaggcagacccaggcttgaatcctggccctgcctctgatgagcagggtgacctgaactgtctcaggttgcctcgctgactctgctttcccatctggaacatgggaatagcaatgcatcagccactcagtgcagtgttgaggctggaacaggtggggcacactgtgagctccatttccttttgcctccacccagcaattatgtctgctggggagaagaggagaaataaggatcacaccctgccctctatcagtcagtcaacgaccatttattaaacacctactaggtgtcaggcacttgacagagaaatgaaataacaacacaagcaactcttatagctataccctataataaatgttatagaagcaggaggcaggtagaggtggaagagaaccttctgcttgcagggggatatcagtcagagaaacagaaccaataggagacacagattaagagatgtattgcaaggaactggcttatgtgattgtagggatgactaggcaagtcagaagtcgcttgggaatgccagaacactcagccttggaccgaagctcctgcccgcaagctgaatttcttcttcttccaggaaacctcagatctgctctaagtcctttcaactgattgactcaggcccatgcagggagttgaggacaagcttccttagtgaaagccagctggctgtgggctgtcaccacacagacaaactgcttcaccccaacaccaagattagcttgaaatggaataactggggcctgtcatccagccaggtggacccacagactcaccgcagcagagcacctagaggcggccacggagggttagtgacagagcagaatcaggcagggcacccgggcagggggcagacccagcaaaggctcctagggcagattgtagaagaggtccttggagatcagggagtacagcaacgtggctgtggcactattaaattaaattaaattaaattgaaaataaaattaaattaaaaaggattggtggctcacgcctgtaatcccagcactttgggaggccgaggcaggtggatcatgaggtcaggagatcaagaccatcctggctaacacggtgaaaccctgtctcttctaaaaatacaaaaaaaaaaaattagccaggtgtggtggcgggcgcctgtagtaccaactactcgggaggctgaggcaggagaatggcgtgaacccgggaggcagagcttgcagtgagccgagatcatgccactgcactccagcctgggctacagagcgagactccgtctcaacaaaaaaaaaaaattaaaaaggattggaataaaggaatggtttagtaaacaaaaataaacaaatgcaatgccttttttgaaggcgtcattactacagccatgatggagcaacacggataaattcccatgacaggaggtttcatgtaaaaccacggtgacagaacatagttggatgtggcatacataaacagctgtgcccagggatggaactctgggagattttcccattagttttaaatgctctttcatgtagttattcttttatttttatgtttttgagacggagtctcgctctgtcgcccaggctggagtgcaacggtgcgatctcggctcactgcaacctctgcctcctgggttcaagtgattctcccgcctcagccccccaagtagctgggattataggcgcccgccaccacacccagctaatttttatatttttagtagagacggggcttaatattagttttaaatgctctttgctgtagtttttttttttttttgagatggagtctcgctccgtcacctaggttggagtgcaacggtgggatctcagctcactgcaacctctgcctcccggttcaagcgattctcctgcctcagccccccaagtagctgggattataggcacccaccatcatgcccagctaatttttgtatttttgtagaagtgaggtttcaccatgttggccaggcttgtcttgaacttctgacctcaggtgatccacctgccttggcctcccaaagtgctgggattacaggcgtgagccacagcacccagcctagttatttatttatttattttttttttaaagagagagatgttattttttttaaggggaatgagtggtattaggatgtcaaatgaaattgcttatttaataaaactgaaaagcccagtttggggaaagaaacaaaacacactgagcagaataatctaaccacagtgaacaggaaaaaaagccaagaataaaataagttccggggtatccaagggtgagcaaagccaggccggcaggcctcctcctcccttgcagaaagcaggatggatgaggggctctgcttctccaggctccctcatgtccccactgaaagtgtttccagaacattccaggcccataaagtgtccaaatgctggaaggacttacatgtatatgtctgggattgaatcaaatcttctgactcaattctctttgggagttctgagaatggaggtcacttcccagaaccccgtcttccccctacagacagctttggccttcttttcagggaagaaaagaaaagggactcttggaaaccctgctgagggccacgcagctctggttgttgaggctcatatggtttatgaggcgccatcacccccttccgccaccccctgcctgctgtggcctgaggcttaccttcgtgactgccctaaaaacagcatccagactcagtaaccacgtcaatcagcttttagaggaaaacatttattctggggaggtgtcagggaaaggattcaggagatcttggttctttctagctctggccttgacatcgacttgctgggtggtctgaaggatttcacttatttacagagcgaatattgttcaagagtttgggatgtgcaaaactcagctgcaggcgtgatgcagggtgggaagatgagcaaggcagggtcctcctctccaagtacagcgaatatggtgggacagatgcacatgcactttatgcacgcatgcacgcacaccatgtgctcagctgccactgagaggagataggagatgcagagggagagggagaacagccgccctctgactaaggatggagcccagctgtctcaagagctctcctggatggacagactggtggcgtcccagcaaaatcccccatctctccatccggctgtgtaatgaatgactggaaacctcagctggcctgtgagcaggagatctggccaggtggaagggaatccctgacaccccacagcccctggtgtagctaaagcagacgggcctcctgggctggtgcaggaagaacagcttatgttctcgaacacattgaccacgtgctccatgcatctgacacacacggactcgtctactccacacagcaccctaggagatggggctgtttaaaataccaatccccactgtatagttgaaaaaaacgaggtgcaatgaggttaaataacgagctctagagaggaggactcaattcacagtcagcttccagagcccatcggcctaaccgccaggctggcttcccgtccgtaatgcacgtttccagctagaggctttcaggctgtgtttcccacacttagccattgacattcacgttcacagtttttgccacatccatgtcacctgtacaaccatttctttagtagtgacttacttttgaactgcaacttcatgtcaccaatttaaatggaaaatgagtatcacttatcataaaaaagatgataactgtacaaaataaaagcaatagaatgtgaacaatgctattagagcctgggtagattcggggaccagccaaggctctgaacctgctcagtctgttgaaaaaggagattacgcacatagaaaggcgttgaagtgcacggacaccacgctgagacgttcttgttggcctaatcaggaggaacgactagattattcaattcaaggttgtttaccaggccaaactacttcccttgctgggaaatgcttcccagctctaacgtgcagtcagaaaatacgggacacaagttgacatccgaaggaaaaatatcttttccttctccacttccgagttcttggttgggggccctgaaacaaaaaacagatgaacaagagaaaagtgaacaaattaatttaatgtaagtttaatgtgacatgggaaccttcataaggaaatgaagtgattaagcctgagtgcctttttgtttttttgagacagagtctcgctctatagcccaggctggagtgcagtggtgcgatacggctcactgcagcctcgatcaccccgggctcagctgatcctcccacctcagcctcccaggtagttaggaccaggactacaggtgtgtgccaccacgctcacctaattttttggtactttttgtagacacagtctcggctgtgttggccaggctggtctcccactcctgggctcaagcgatccgcctgcctcagcctcccaaagtgctggggtcacaggcatgaaccactgtgaccggcctgagtgtttccattagatgtcatgaacagtggagaatcatggggctgtggtgggaccagggggcacgagcgaagtacagagaactggagaaacagcaaggcctgtcggggctcctctcagtgtccccagtgctcggagtggacggtgcccctttcctctggctgtggagtctggtgtcctgcttcagggaacaatcacatagtccttctgcgcctgctgtttcttggattctttccacttaaaatattcaacatgcgaagctgccacattttggggtagcgtgccctgaatcattggctacaaggtcgcgggccccacatgaggcacagttggcccttgagacagtgacactatgtatttcgtggaggccactgcttcaaaggccctaaggtgtggattcctgggaaaccaaaacaggctgtctccaaggctcaagtggaattgatttctaacagcccaggcccacggtgtctgtgcgagtaaatgaagaaagtgtttttacagtaagtcttcttggatagaattctgagggagagagagaatgagtgaatcagaatgttggatgttccctctaaggcatctgtttaaaaaatcaggggaaaaacccaggagcagagtcatcacctgtccccagctctgaggatctgtgtctgtgaggcacatgagtccaccctcctagctctgtagacaaggaaactgtggtccagagagatggagatcccacagacaacggcccacctggagcaccccctccccgcctgactttatattcccaggatgcattcatcagggtctcagtaaaaaaaagagggcacattccaattgggtaataggaagaggatgttaatgaagcgtttctttacagtgctgtaggcagcatattggggttctgcgaagagcaggcagcaccctgggtgcctcagggctggtacggcaaagcctcagcaccctccctacctccttcccccctcgcgatcaggcccctgataaaagcagtgaactctgctccaggtctggccagcataaaggcccccaagagaggagccaacaacaccccatcctccctctcaccctccctcaggctcctgctggggctcccactggccaaacccaaagagaagccggaaggcaaagagctccgtggtacccatcagggctcccaagcaggggccacagaggagaagccaggaggtgacctggagcaggacacagcagctccctgacagggatcctcacccagggcacgcctctagagcagatggagaaaacaactcagtagacttcagactcccaaattctcccagttcctcaacccgcctgccctctggacttcgggagaaagttgagagggaaagccctcaactttgttttgaaaatgagagcaatgtttacagccactagcaagcaattaggatccagctgggctgatgtggccagatctggggacacccagccaggtagatgcacaacagacccataatggaggccagcgaggaaacgctggacacgtcccccatgactgagctgtgaggacctgacttatctgtgcggcggtcactgtcgtgtagaaatggaagctgtacatgcaggctgaggcttctcagctggacagttcagcccgagtgagccccaagaggacaggggaggctggtcttcattcttcccctctgaatcaccagcaaatgatagaccgtcaataatttgttaaatgctttttaaaatgaatgctttaagccgggtgcagtggctcacatctgtaatcccagcactttgggaggccgaggcgggtggattgtttgaggtcaggagttcgagaccaacctggccaacatggcaaaacctcatctctaccaaaaatacaaaaattagccaggcatggtggcaggcacctgtgatcccagctactcaggaggctgagacaggagaatcgcttgaacccgggaggcagaggttgcagtgagccaagattacgccattgtactccagcctgggtgacagagagagactccgtctcaaaaaaaaaaaaaaaaaaaaaaaaaaattacgcttcaaacacatgatctctcaccactgttgaattttctttctatgagcccaggagggcctctcagagaggaaagctcctaggtcttcctttccctctgcaaactccctgccttgaaggatcagaaggactgtgctgctcgttgcatcctttgcaagttccaaaccctgatcccagctgtgcttaggggttcctgcaaaccttttccaggtgttaattacctcccacttcatttcctgtttaccaactcagctttttgttttagtgtgtttgaattccctgaactgaccgttgtctgatctccacctcccaactgaattaggggagctgggcttctggaaacccaggtgccgggtgttgcagagtggctgaaagctgggatgtggcagatccgtggctacattcatgcacacacacacacccacatacccacacatgcacacacacacacacacctgcactcacacacttgcacatgcatagaccacagctttccacacccttcctagacaggggtcacttggtgtcctggagagagtgtgaagtctggaagggaaagaggggggattaagccccacctctagccatgggactgagacaagtcacccccacccatctgcgccttgtttcctcctctgtgaggcaagcacagagcccatgcctccctccctggatgggagtgatgtgaaacttgaagaggggtagagacaagggtcgtcaatggaagccccttgggcaaaaaggccctttcaactaggggcacagaggaggccctgggctgagaacttgacagcaccttgtattggtaaccagccggagggactggaaatactcagatgtgtctgtctcccttattaggttcaaagtccctcgagaccctgtctccatcacagtgctccagtccagacccctcctctgagctccagaccctgctggacccaacagccatccccatccccacctgcctggaattctccaaagaacctcccctttaacagttccagcctttaacagttccagtctaaacacatgacctttctcctctaaatcagccccccatctctgcctttgcaggagatggaagccatgacacctgcctcgcccctgtcctcaccccatccatgtccaatcaagcactaggcatgtcaggtttaccctctaaactcctctggaatccagtctctcagtctccatcatcccaggtcgaagctaatgggctaactggtccttgcttccactctacccccactgcagtcctgacttcctgagcagcagccagggcctaatccatattcacaccaagcgccttcctgactgagatatcctcctgcaccatcatccctccaccctgtttagttctgctcaccctcagtgttctcatcaataatccactcgccctcacaggcgcgtttgggaccccatgttctatgctctcacaggaccttttgcttgatttttcactgtactcaggtcagtttgcagttattaagtgactgagcaatgtctggcttctccagtagactgtcagctcctagccattgtatccctagcaccgctgtgtgggagcacttcacaaacgtccattgagtcagggactcagcagtctccatttctcctccctgctggagaatgcgtgtattttgcaatccccagcccctgtgccatctaaccatcttttcttctctgttcagcccaggtgtggcctcactcacatcccactctgagtccaaatgttctctccctggaagatatcaatgtttctgtctgttcgtgaggactccgtgcccaccacggcctctttcaggtgagtcaaagggattcctcagttcactagttaggggaggtgggcagacaccctggagaactccctggaaagctcaactctcatgccccggacaacagttgaaggaaccagtgatgttaagcccaaagacaaaacctctcaggtgtccaagtccctgtaggcctgttgggagcagagggaatgttctgcggaactagaggaagaggggctcagggagaagaagggcacattcctggttgtcatatgtgatctatcccagatgaacttggaagtgaagggaagagagttaaacattaaagtaaatacccagtggatcagacagcaatgtgccagattgccttggagacaaaatatctccaacacatggctgacatttggtgggagatcagaacaccctaaagagagaatttaaggggagggggaggaggacctgagccagagtagaagcagaggatagggagatctgttcttggggacagcatttgcaagaaacaaggctgaggggtccactccaacctctccaccctgctgcaggtgctgcctatgatgaagatgagcagatggccatctcagctggggccacagtgcactggacctatagtttccaattccgcactcagcaggcatctttctgatgatccgatggcttctcagagccagggatgggccaggatccatccccttggctactgtcttgctgagaaattaataagcagcatctggtgctatactttggtctctagtgagttagctcatgaaagatgacagactctccaagccaggggtatgcaggaaatgggttttctgtagctacagaaatggggttgagggttggaccaaggggactacccaggggaagtcttaccttcagaggactctggaaaggaggctgcaagttttcatgggtcaagaattcagagcccagtagagacagcttatctctgttccaagatgtctggggccttggttggaagattcaaaggctaggaaaccaggagccaccaaaagcgtaactggggccagaggatccactttcaaggtggcaagttggttccccccatgtggctgcttgagtatcctcacatggcggctcacatccttccaagtaagcaatgcaaaaggccaagaaagatgctgcaaagcatgttatgacctagcctcagaaatcacacaccatccctgccaccattagtaagaagtccagcccacgtccaggagaagaggaagcagattcctccttttgaaatgaagaatatcaagtaattcggggggcatatgaaagccaccacacaccacagggatctttttagagcatacttcttataccatcactgtagttccttaagactcaggggcaaagcctcacttccttagcacccagtgaagaccacgcttactccctcactcaacctcttgctacttcccacctctcctgtccaacatctagtgtcactttccagaacataccaacagcttccccagttctgtgcctctgctcaggctgttccccctgcctggtccacttgtcctccttcttgtcccgtcaaaatgcttcttatccttcaagacccagctctagagtcacctccaaccccttacccaccagccccctctccaagtctgtgtcccacaacccccctgctccctccagggcaccctccaccctctgggccacagttgtcaggagtcaggcagggcaggggccgggtggtgtcttctttgtgttcttgcactcagggcagagctcagcacagagcagacgctcaaaaaacatttaaaggatagaagcattgatttgtgggtcccccagtctggctccaggatgccagccagctgctcctagaagcaaacggacttttcctgggaaatcccagaggtgatgatcagtatctctcccgtgactcgtagttcagctcttcctccatgagcctgactatcagtggaccttccagaaagagccccttttccttctctcacccacagcacagggcactgggaaaatgcccaatgagtcctgccctctgggttgtgctttggacttttcagtgtgtcttcgcatccactcttcagcttgaatgttgcaacagccatgaaaaaagaaatgcaaagcgattcaggatgagagcaataccctactccaaagaaggcaaaatagaagctcagagaggtcaagcattttgcccaagaccacacagctaggagtggaactcatggctgtccaagccccacgcctctgctgaaggtagagatgaattacagcaacaagtctagaaaggtgcctgccctatggtctgtgagtcttgcctaagaatgaaagaggagccagtgggttaaagatgaggtcaccaacaaacggtggtgttggagtttaccactggttattttaatgggtttgcaagaattgttaattactaatgtttattgagcctagtgcagtgcttggggcattttgcacattgtctctgatccctatcacaaccctgagaggtagtttttttaactcccattttacaggtgaggtcattgtggttcaaggacgttaagtaacttccccagcgtcacacggcttataagtaaggcagccaggatgtgaacccagtaggactatctggctgcaaagtccccaccctccctcgccatctgtatcctccaatcatcttcagtgctttgctgatagaaggtacggaaatacgatgccacagactgtccaggaagacagaaactaggcagatgggctggccatggtctccaagccagactggaatctccaggtctggaatgatatcatttttctcttttaataaattaactcacccaccacacggctttgagaggctcaaaggtgaccaactcccttgggagggccccggttgataaggaaggaatgtgaatcctcccatcacggaagcttcaaggaggtcaagggtccaacacttgagattgttagtgctgttggtggatactggccaaggaaatatcccagtggagcctcgagatgaagaacatgaggcccccgtttagatccaaggatcagagggggctctgtaagacccaggggagtcaggtgcactggagcgcgggctgcagaaaacagcctgagctccacctcggcttctccttgccctggctggttgtccttaacccctgtctccttctggaccagtttttgtccttcccttgtgaccctgaggggtaacagcctcttttccactttctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacagagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagttgatgtctccggtaaaacaccggagactaattcctgccctgcccaattttgcagggagcatggctgtgaggatggggtgaactcacgcacagccaaggactccaaaatcacaacagcattactgttcttatttgctgccacacctgagccagcctgctccttcccaggagtggaggaggcctgggggcagggagaggagtgactgagcttccctcccgtgtgttctccgtccctgccccagcaagacaacttagatctccaggagaactgccatccagctttggtgcaatggctgagtgcacaagtgagttgttgccctgggtttctttaatctattcagctagaactttgaaggacaatttcttgcattaataaaggttaagccctgaggggtccctgataacaacctggagaccaggattttatggctcccctcactgatggacaaggaggtctgtgccaaagaagaatccaataagcacatattgagcacttgctgtatatgcagtattgagcactgtaggcaagagggaagaaagagaaggagccatctccatcttgaaggaactcaaagactcaagtgggaacgactgggcactgccaccaccagaaagctgttcgacgagacggtcgagcagggtgctgtgggtgatatggacagcagaagggggagaccaaggttccagctcaaccaataactattgcacaaccatctgtccctgcctcagttccctcttctgtaacatgaagtcgttgtgagggttaaaggcagtaacaggtataaagtacttagaaaagcaaagggtgctacgtacatgtgaggcatcattacgcagacgtaactgggatatgtttactataaggaaaagacactgaggtctagaaatagctccgtggagcagaatcagtattgggagccggtggcggtgtgaagcaccagtgtctggcacacagtaggtgctcattggctcccttccacctgtcattcccaccaccctgaggccccaaccgccacacacacaggagcatttggagagaaggccatgtcttcaaagtctgatttgtgatgaggcagaggaagatatttctaatcggtcttgcccagaggatcacagtgctgagaccccccaccaccagccggtacctgggaagggggagagtgcaggcctgctcagggactgttcctgtctcagcaaccaagggattgttcctgtcaatcaatggtttattggaaggtggcccagtatgagccctagaagagtgtgaaaaggaatggcaatggtgttcaccatcggcagtgccagggcagcactcattcacttgataaatgaatatttattagctggttggagagctagaacctggagagctagaacctggagaactagaacctggagggctagaactggagaggctagaaccaagaagggctagaacctggaggggctagaacctagagaagctaaaacctgagctagaagctggaggactagaacctggagggctggaatctggagagctagaacctggagggctagaacctggagggctagaatctggagagctagaacctggagggctagaatctggagagctagaacctggagggctagaacctggagagctagaacctagaagggctagaacctggagggctggaatctggagagctagaacctggagggctagaacctggagggctagaacctagaagggctagaacctggagggctggaatctggagagctagaacctggagggctagaacctggagggctagaacctagaagggctagaacctggagggctagaacctggcaggttagaacctagaagggctagaacctggagagccagaacctggagggctagaacctggaagggctagaacctgtagagctagaacatggagagctagaacccggcaggctagaacctggcaagctagaacctggagggaatgaacctggagggctagaacctggagaatgagaaaaatttacatggcaaagagcccataaatcctgaccaatccaactctgaattttaaagcaaaagcgtcaaaaaaaagattccctccttacccccaacccactcttttttcccaccacccactctcctctgcctcagtaagtatctggaggaagaaaacaggtgaaagaagaagtaaaaaccatttagtattagtattagaatgaagtcaaactgtgccacacatggtgaatgaaaaaaaaaaaaagaggctgtgttttgtcacacagggcagtcattcagcaccagagcacgtgatggtctgagactctcttaggagcagagctctgccgcaatggccatgtggggatccacacctggtctgaggggcaactgagtctgcgggagaagagcggccctatgcatggtgtagatgccctgataaagaacatctgtcctgtgaaagactcaatgagctgttatgttgtaaacaggaagcatttcacatccaaacgagaaaatcatgtaaacatgtgtcttttctgtagagcataataaatggatgaggtttttgcatagctctagcatttgttacaactcccgaaacccccgagtttggtccctggggtaccgccttgcacactcagaagcctttgggaaggggtgctattcatttctgctcaatctgttaacaggcttctggcatgtagatcagtggtctccaagcttttgtgattgtat

SEQ ID NO: 343 - DNA, 32743 bp, Homo sapiens
tagagaacaatatgtgtttaataatatttaaataatggttgtataaaattgaagcagcaagaaacccaaaggagaatagctctaggggagggaggtggatgagtatgcatgggggagaggctcttctgtgaccaggttgggtctggagccctccccactgtccagaacacctccaagcccctacatctttttccatataccaacgccttggagatataatgcagaagtgaagtgagcaggctgaggattagggcaggtgtctggaatatggtcaggagtgggaggggagtgacatagctcacaggcaaggcagaacagcacaaaggctataggtttcattcccagccctcaacttaaaagacctcaggggcagacactgactccagcctggctgtgcccttaccctaacgccattcacacttttttttttaaacacaggtaatccatgtttattatagaaaaatgccacattactctttattgaatgcgagcgccagcaccggcccctttctctccaagcacaggggcacgcaggcaaggggcacgaaggcaaggggctccgtcccctggccaggatgcagtggaagcctggctccactaccattcacctacagccagcaccctcctcggtgcctggggctcaggtctgttcaaactcctgctcacagaagcctacattgaggggttgggcctggacacctcgcctgcaagaggacatgaagaaatggcaagataagcccctcagaaggggccccagcaacacttttcacaccagtcaacagtctctccttccccatttcggtgactctcaaactgtcactgtacaccaaatgcacctgggaatctcaattccagagattctcacctggggtggggcaaagtattggcaagaatctgcaagctgaacaggtgcctcaggtgattctgatacaggtcttggagatccagaaacgttggcgacatctatttatatcctgcccatctctgtaccctaaccccaaataactcaatccctttagaatatagatggatgtctgaaaggcagccaatgctcttggtctacttagccctctgttcctgactctaaaatgctgtaaatatggtggcactgggggacttaggtgctgtcctgtccatgaacatggatgcgaaatcctgtccttgggtctcagtctataacctgaccaatctccttaggggacctctaggcatgcttcccttatcatccaagtaagcaacatgcttagagaaccagctggaagttacccagtgaatgacataattgaggcttagacaccatcatgcttgactctcagcccaggactctgctctgcactaggctatgtcccccaagtactcaagacctagccaacgaaggaatcagggaaatgactatcttacacaggcacatccctgacagaggcaaaggtgtcatgacatcctgtaagtcagcctggttcaaatcctgcttcttagtgactttgggcaaggtcctgaactctgtgcttcagtgtctatctctaaaatgcacctgtctcatggggctgtggtgaagactaaatgagacaatatttgtaacaaacttagcacagtgtttgccacaaaatacagttgtccctcagtatccacaggggatttgtttcaggacccccgtggataccaaaatccaaggatgctcaagtcccttatataaaaatgacatagtatttgcatataaccaatgtacaacttcccatatacttgaaatgatcttagattacttatacctaatacaatataaatgctatgtaaatagttgttatacagtattttttatttgtaccattttttgttgtattttttttttcctgaatactttttatcgcagttggttgaatccgtggatgagggctgactataagcctctgtaagtgttagctattgttaattattgtcttcctctctctaaggggttccccagccctggatctggcctgctccgccttgcgaaggccccacagcttgcttacctcagcaattcacagcggaagtgtgacaaacgttcataggcaaatgtcaggtcagatgtcaacttgttgctccacagcctttcggcaacagcccctgctctgggcctggaggaaaaggggcatgtgccagattgggccctgtattccctgcaaaggtgctggacatccacaggctgctacctcttgtctaggcaccctggactcactcaggccaaaggaagtgatcaataccttgttatgagccacagccaggttggatggctcccagagagttctacggctcagctccaccttcattaaaatgtgggtagcaatcccactctcttcctctctcaaagatatgggaataagaataaaccttaaagccatcattaaccacaatgacagtggcagcagcagaggtccttaaaatgtaaactttgcacacccaaccatacttggtaaggctgcagtgaaaacagcagagggaagccttattacaggaatcatggatgcttgtgctgggtcttgagcaactcacctatgttctccaggcctcattatctctctgggaagtaaggttaacaatccctatcccacataccaaagggcagctggagggatatagacggaagtcatgtggagagtgaatattgcacacaaatcttcagaaggctcgttgcacggcctgctctctctcaggcctgaaagaagggtactagtccagaggtggctagatgggattgggtctctaagggagaactcctgctctcaggcccaaccctccacctcccccccgaaaacccttaccagagcctggggaccaggtttgtgttgtccacatattctccccacatacaagcctctccaccaatcaccagagccttctgctcaggggtacctgagggaaaacaagcaacaacagtctggtgatggtggggtaactccagggtccctctcaaccaccttcccaatgtggccctcaccccagctaagttgtttcatttactaactggaaatgtctggcccagaccttcctgcctcccatcctgtgccccaacccagcctcctttggttagcaaggagagctctctgctttcaccttcaaatgccaggggttccactatgtagaaatccttccagtcagggccataggatatacggttcaggtaccagggggcagagagaagggcccggaagccggccttggtgaccagttccagctccttcatatagttcactggaatatcctctcgccacacctgtatgattgtgtctggctgaatctgttataaaaggtcaaatggcagtaaggacacaaagctgaggagattcctgggccttattcatacacaggcaacatgggacaacaggtatgtgctccctctgttccccagcagcaaagtatgtctctgtgactcctgaccattgagctcacacctcaggacagaggccaaggaatccagggccctaagaggcctccctgcagctctcctccccgtccctctgcagcctccctgtccacacagagctagtaataccagctgtgagctgagggaggcaagcagtgggacccaggagctgccatgtccaaaagtctccagatgtttctggggacgggacaaggttcctgaagagtccttgcatgtgacaggagactgggatcttactgatcaacaataaaggagaaggtaaccttggtcccacagacccagaagaccctcatctatgatttaggaagaaaaatccagcctatccaagtaacctaacagcagaaatagttcttaattaagtttgtagtgagggaagatagaaactctgacacataaacccagggctcataccacagcggcctttggtttttttgaggcagggtctcactctgttgcccagggttgagtgcagaggcacatcttggctcacagcaacctctgcctcctgggctcaagcagtaccccaacctcagcctcctgatttttgtattttttgtagagatgagggttttgctatgttggccaggctggtcttgaactcctaggctcaagcaatccccctgccttggcctaccaaagtgcttggattacaggcgtgagccactgcacccagcactctgtggcctttctagagagaaaaggagagtgctccgaccattaaagcccaatccaaaccaggaggatcagtctctgtagaggcagggaggagctggggagaccagagggaggcactgctggtggcttcttctcttctctgccccggctcacctttactttattatcaaacacctcctgccacaccacatagcccttgccataagaagagacgatgtccagcagcctggagaggagaggagtgtctagtaagtgtctgcttagctcagatgggttctagactgtttgtgccagtgctctaggggttgagcctggccaggggcctattcctcattaagcagtgtctttcccctgggctgaaaaccaaccactccaaatctgaaaggatgggacaaaggacaagggaaccctgcagggaccagacagtggccaagcagggcctgactcggtatggaaagggaggaccccacaggaggacccccaagggaccccacccaccctccttccttcctcacgtctggatgtagaaggactccagctgcttgaagtcctcaccgaagcctttcttcctcataaagtcctggatctctgggttggacttcctgaatcccaagagaaaatgaagattaatctttcaacatcctgaaagcctaatgcctggggattagtcacctggccccctataacttcctcttttcacctgaaaaatcaaataagcaaggatctcagaagccctacatgtggaaagtgtggccaagcaaagttatgtgaagcaggtgggctgttgacacaggctgagaaaggctgagtctggacctgaagagttttaagttcaaactcccaaagagaaaacatattaatcctctctggactgcaacatgagaatccaaggtcttaacttgaagctccagcacactggatttcggctttcctatctgctcttccagttggatgacaagccttgctgtctaacacctgctgcagatcccttgcgttatgacgtccacattttgctcacattgttctccttctggaatattttcccctgctcacatctccaaaaagccaaattgatttccccagattcagctctagcgccctcttctcaaagaagcccctcagcctcttttgagcttactagaaccaagggtttggactttacaactgaatactaattagacattgtcacctattagtcttgaattctgtgtcttgactcttcaactagacaattttaagccttcataaacagggattatttttctctatcccgaacttttccaagacaattctgtgcccagggctgttttttctatcaatacctcaaggatatgagagtaggaaggaagaggttcacagtgaaagccttgccaaaatcaggtaggatctctacgtagatgggcagaggaaggcctaagacctgagcaatgtgagcccatacagacccctgagagcagcagctgagctaagcagcccctcgggtgctaacttctattctgagtaagcaactgatcaggccacagtgggaagatcaaagggctcataccagcaggtgaaatcaacctcatctcctccaagatgaagataaaaatctgggaagacagagctgacttctaagaagaatgtgctcatgaactcataggtattattgagactgggattcactggtccaaaggtgccagagggctcagacccagagtagcaaggagtcagtaatccagggatacctaagccaagagaaaaccccatatgagtgtcacaaatacataaacccccacgcacagtcctacacgtaaggacacgagtcacacaaagcaagacaagtgtattcataaacatcacacacatttaggtaggcacacttaggcactcacagacactggtagtcaccaccatttagtcacagtaaaaagatacaaatatatccacaatcataggcagaggctaagttccagccagacaactgtcagtgcgcacactcttgcctggacacactgcttctagcaggtgctacccttgctcccaaggctgctctcctcacaggccttgaggcagagagagagcctaatccagccaaactggcaaaatctttcttctctatctcctcctgtaggtggggtcaaccatcacccagaatctttttacatttgctaagggatatctcccttggcccagagactacttcctgacgctgaggtcacaagatatcttcagggtttttttttggttgttgttgtttgtttgtttttgagacagagtcttgctctgtcgcccaggctggagtacagtggcatgatcttggctcactgcaacctctgcctcctgggttcaagcgattctcctgcctcagcctcccgagtagctgggattacaggcgcctgccaccacgcctggctaatttttgtatttttagtagagatggagtttcaccatgttggccaggctggtcttgaactcctgacctcaggtgatccacccgccttggcctccaaaagtggtgggattacagacatgagccaccacgcccggccaatatcttcagttttctatcaggccagtagcccttttcaactgtcatttaacctgtgttgggggctcacactggagggctgagggtatacagaagaaagggagcaggggtactgactgactctgacctctgcaggctgcccttgggcttctttctttcagattctaccctggtggtcagattcctcagcatccactctaggcacaactacctgcaacggcatctgagaaaaatgtgcccttacatagtctaacagtacatattttaatagtaagaagcagcctccattgtccaaagtgagttcttcctatctaaattcccaggtggaagaagtcgatggaaaacattcttctaaggaccaaggctgggatatgccacttccatgagccagtgccctgaagcttcactctgagcataacaagcagagtccctctggtcccagacatcattcttacctggtccccaggacaaagtgtggccaggagtgtcaaactctgcaagcacacggataccccggagccgtgcgtattcaatgacctccttcacatcctgtgctgtgtagatgtgggtgacagggttgtaggacccctgaaaggcacaagacacccttcaggttcacacttcctgaaagctagcagagtagaagatactcaaaatgcccacaagactccccagatatcagaaaacctgcccatagccctttggtgtcagggactatcttcaaaaaacttgatcataatttcccagaagttatcacatctgttttatctgagtatcataatgccagtgagataatcatggtaggtattaatactatgtccatttaacagaatataaatacataaaaagggaataaggccagaagagattctctcctgaaggtcacaaggcaaattatcggcaaagttttggacttgaactcaagtctcctgactccaaatccagtgtccttcccctatattggtctaaaactggctggttaggatgagagaccctgttcttgccagcagggccacagccagattcagacattgacccataaacttggtctgagtgaaacgggaacatacctttctcatgagctctggaaaagtgaagctctcatatgggaaggaaggatcatctaccagatgccagtggaacacgttcaatttattgtacgccatgacatcctgtaggttaaagtgcacactgtgaacccatcacagtctctccggtttcagcctcaaacttgcgatgttgggcgagctctcaggccgctccacacacccctacaggcttgacctgcctcagctctcaattaagtatttatggggtctatcaaaccttcccatcagggagggatggcatggagggaaggcccagcacacttctacttttcccagaacacatccaaagatggatgatagaagtggtctttcctcttcttgaaataaattctggccacattaagaggagggctgcagctactgtggtagcctggaatcttccaaaagcctgaagatcaatacttcctcttgccatttgtgttcggttgtctgactgatgttaagcccaactgtgagacctcctgggaacttagtagcctcttaactcataatctcagaagcaaaggctggcagatgtgtggcctcctttggttccgtcacaggagcaaaggaaaaggcagacacaggaactggattgggaactgtcagataagactgcacattaaactcaagagagttaggaacttccccaggaaaggctttttttttttttttttttttttttgagacagagtcttgctgtgtcacccaggctggagtgcagtggcacaatctcagctcactgcaacctccacctcccaggttcaagtgcttctcatgcctcagcctccttccttccttcacttatttatttatttatttatttttgagacagggtctctgttgtccaggctggagtgcagtggtgcaatcacagttcatgcatccttgatctccccaggctcaggtgattctcccatcacagactcctgagtagctgggactacaggtttgcgccatcgcgcctggctaattttttgtattttcagtagagatggggtttcaccgtcttggccaggttagtctcaaactcctgagctcgggcaatccacccgccttggcctcccagagtgctaggattacaggtgtgagccactgcacctggccccaagttaaggctttgaacgtctctctcctatgaccttgttctaactaaagttagctctgccggccaggtgtagtgactcatgcctgtaattctaccactctggcaggccaaggtgggcagattgcttgagcccaggagttcaagaccagcctgggtaacatgacgaaaccccagctctacaaaaaatacaaaaaaaaaaaaaaaaaattgagacgctgtctcaaaaacaaatatagttagctctgccaatgaagccaattcccctaaacatttgtatccctggaaacagcctgaacattgatctacagtagcctgtaaggtagatttaagtcactctgttattttttgagtcttggagcagctcatcttctacatttttcccaggagctcatagaattacatacaatttttttttttttttttgagacagcgtctcactctttcacccaggctggagtgcagtggcgtgatctccacccactgcaacctctgcctcctgggttcatgcgattctcctgcctcagcctcccaggtagctgggattacaagcatgcaccaccatgcccagctaatttttgtatttttagtagagacagagtttcaccatgttggccaggctggccttgaacttctgacttcaggtgatccgcccacctcggcctcccaaagtgttgggattacaggcatgagccaccacacccagtccatacattccctctctaactctttaagaatttggaacttggtctgtccgttgctccatcaccctagaactcttaagtgtgaagaaggccttaaggcctggttaccagagtgtccaggatgctagagagtggcaggtaatggcgagatgtatccaacagcaagccccggtgaggaaagcggggaaagtcctcaatctcagtcttgttgataaagaactgtgcagaacaaacattgaacatgtcagtttcaaaggaagcttactatgggggcacagggagatgaagacaactctcccaggattcttaaaaagccaatctgtgactgttctcagggtcgctctctccctaaatgctccccacctctataaatgaccataagcagccaccttcccagagagcaattgtccaacgccagcctaatacaactgtcccaaacaccactcagcctacaaattctggattttcctgttaacatagtttattttcttcaaagcagtgtggcctcaaggtcattactaaatgatgactcagggggaccaaattacagtgattccaaacagaccaaatctaccaaaccagttttccactcacatctcctcttccatttctactggggctatctcaagccaccaggatcctaaggcaaaacaagatttttctaggattctcaatattgggatccaaccccagagatgaaaaaggagccctttttgagggtccacacttactgtgccctcagcagatttccaaacaagctggctaaaagtctccagacctaggaagatgtagagaggcagagtaaagactcagggagtggaaaaagagatgtctctatttggaaggttctcaatgtagcagagcataacatttgggtacacagggaaaatggatgtagtgtaggcttgacgatttttaacactgatgaaaaggggatattaggaagccactatccatctttacttctgtatttcattttgggagatgtcagagtaagggttttagtgcccttccttacaacatactaaccttcaaaacccacatacctcttatctatatttcctgtgccttcacaagaatattgagaagagaggccaagacatatactcatgaggacagacacagagacaactcagcctgcaagagttggacttttcatggataacccctatcaggagctaagagagctgagaaaaggggtcccagaataaattgtgagaaagtgatcataagcttgggtttccaaggagcctgggttcatggctggacctagaagataaaaaaaatcatccactcttcctcttcagagtctaagaagagacccagctatagggagctgaggtgtggtggacagcaactgccccagaaggactcccctagtccactgacactgtctcctagagtctagcaaggcccacacacaggtatgttgaacccagagtattgtatgttctcaacagctggggcccctcttctggaaaccctgcagaagccccatgaaaattatcagagtccccagtttcaaagtgaaagaatccatgagacctcagcagtcactcagcacctgatttgagcagactgctagtgtactgttttggcttctccccactctgactctgacacccagcattctggagttccaggtcctcccttacctctagcctgactcaccatcagcacctgcatgaaaggtacaagagggcaggaaggggaggcagcatgctgttgctccaagcatagaagtggagcaagggaatgaagacaaactaaagcaaggtgtggaattccgagagagtttcccacatcattcaccagcagagggtttaccaaaagtgggagagatatttggctaagtctgtatctaggcaccaaatgccttctcagtaaacccagaagaagggcaagggccaatagtttagccagtaaactcattttctccagaaataatgtagttctaaatatttcactactatttatctttttttttgcatgtatctatttcttttgttatagttttccttttaaaaaaacctttccaattacatgtctttagcaagagctggacagacagtgtctgtggtagcatcattccccctgcccccagctacctgtcccctgctggcacctagaacatcagcccacagactctcctactgcttcccagagcccctgactagggcagcagcagttgctgatgctgcacagggtaaaacctgtcaacttccagggacaattccacagagacgggaaaacacgccaattgttcccataaaaaaagcttcctggctgggcgcggtggcacacacctgtaatcccagaactttgggaggccgagatgggtggatcacttgaactcaggagttcaagactggcctgggcaatatggtgaaatcccatctctactaaaaatacaagaattagctgggcatggtggcaggcacctgtaatcccagctacttgggaggctaaagagggaagattgcttgagcctaggaggcagaggttgcagtgagcagggactgggccactgcactccaccaacaccaaccttcccacatcatcctttctctctctcttttaatcagccccaatttgttacctcggagagctccccagacagtctcagagaggagtaaacactggtcatcatttatggtcagggtatctgaaatgacagaaatgaactcatttagttggttaaggttttctattctcagattatagaccagatattctatataaatcactggactaaaaaaaaaaaacagtaagaccatatattttaaaaaatctttcaatgaggagatgtccccagagcaagacagctgtaggatggcctggtctggggccagagtgggagggtggtcaccacagtgactctgtagaccctggatgatgatgtacagcaagagtcaggctggagtggaggtctgtacaaagcaccacctacctcatgggtcagtttccacagcagaaagatgaaagaagtcttctcctggcaaagggaacagggatgcctgcaggggtgagtgcagcacgcgatgctcccaatgcctttgtaatcaccctcctttccccttcctctatgcttcagctacttcctccaagaatgtgaggaaggagccaaactcaactgttcactttggagactgagaagtccccaaatgctgctcagggaagacaggaggcagtcactggactaatgacttaacttcatctcagtataagtgaccagaacccctgctttccccagtgtagggtctattagagaaaagtagcaaagtatacactttcctaaaatagaaatgtattcagtacaccaggtagaagtcctgtgggactcagtgaagagccagtgtgatgttccacagccaacctttagcactggttaagtttctgcataggaaaaactcatcttccatggctctcagcacttggtgaccctcggtccccagggtcaagggggactccaggccgagcatcagcagtttaggccaggccatccagagttacagcttcagacaagtgtttgctcttctaagacagggaacaggatggtacttacaattctccactgactccaaagtaggaagctggttacatccaggtgtgactacagagacaaccaacacattcttctccagtgtatgccgtttccctaggaagacagggtaagcttggtgcggccaacctgccattagaagcaacaggcaaaaccaagaccctagctctagtccctcagctcacacgcctgtggtaaaggaaagggaggacatggcatttacccttggcataggcagtgcctgatcatctgttcagctgtctcactctcgttgtgcccctcttctcctcagtagctgccctgacccatgtctgaatgctctgggtgacagctcttcttaaccagggctctatatttctgactgcccttggcctgtaccaaacaaacaactccatgacctcaacaactgcttctgaatgaaaggcagctctagagcactgctactccaagtatggtctgcagattagctgccaatttgcaaactgtgttactggctggtcactatatagaaaacttatatgaagcctgaatgtaaatcaattatgtcagagtaaacacactgtctagttctaacattttttcatacaagattttcttgatgaagagatcagtcttacattctggtacatatgcttcttatctcattgaagattggcatattaagtagtactgctcttgagggctccagatgaagggtttccagttttgcaaaagcctaggagctaatggagcagatgacagaaggatcaggcagaggaggcctgagatgatgcaactgatacctcagagaagatcagggtcacccacccatcttgcttccttccttcctcttcccaaacaggttctctatccaaggtagattttaccctaatagtggagggttgaaccaacatagtatctaatatagctttacagacccttgtctatgcagaaaaaatgccaaagccaaaatatgaatacactgtctcttctcaccctcctgctggttcttccctgtgattttcagggtggctctggtgttatagccccaagccttaacttaatgaacccctctctattctattctttcctggagccatattcatcccactggcatcacaacatccatgacttcttatggcactacaatgtcagggataggatggcctggcagaaggcaatgagagaattcagaaccaaactggaatctcaaatgttacccatctccaggcagaaggaatccaagcgctcagatcatctcacggaagcctgctcagacctcttgagcactaccacatggctgtatctcagctctttggtctgccaagaagcaagccaataagggggcctttcctaccatcatgaacaacacattctttcccttaccagtaaataccctggatccccacaccaatacctgcctacattctgcaaagaggagggaatctgaggcaactctgggccaggtcaattcacagctccatacttgaaccctaaaactacattgttacaacacaaaaggacaagcagaccttcaaggcaaagaccacactcaaggcagaatctgcagggccatccaagcagacaggctacaaacccatctccacaggagactctacagggagaccaatgaggacttaacctaggagcaagggtgaggaaaaactataccccatcctctgacttcttgcccccactcccaaccccacacatcatggagccccaatatcattgtgtggagaattcatctgcatatctacccaggcagccatccaaaagacagccgaagtcctgagctttagttctaatcctctggggctcagcctgccacataaggagaaatcacaactaatccatatgcaactaccatggctcgctgccctcatgacaaaataagagaggccacacaaacaccaggtttatctgaactattacttggaagacagaaaaatacctaatctttcgatttttaaaaaatttatttttctaaaagacacctgcactgtactccctaaatctgtagtcttttggagagtcacagactcctttgcagatctgctgaataggaaaacactttttttcccagaacaatgcccctaatttaagggctgtttctccagaattacaattcttccactccctgccatcaatctcatggtgaagaatccctgtccgaagttctctcagtgactcatctgggtttgggctgaaagaagtagatacgggggcatggctgctgtttaaacaaattatgagagggatgtttgggggaggcagcaacatgagagctggcaaaacaggagggacactaggtcattgtaaaggatgtaaatagggtatcaccactgtggttttccgcctccaagttgctactttgcctggctatgaagagggcaggaaataggcaggggacagtagtacagccgcctctacacacacccgcccacaccctgaacactgagaagcaccaacgtgtgggaagcacagtatggcaaacagcccggtcagccagcaatgtcatgagcacatgtgccatgagtctggctggaacagcaggaaattgagaagcctccagggcttaggaggtagcatgaaaaacagaccagagggctgggaaatcaggacaggttgcttctggttctggttttgctgctgccaagctgagcaagtctcagggctcccatttccttccctgtaaacaatggcagggtgggaccagattccagctactcctcttcagatctaagaccttgtgattccatagacagataatacactccagggtcccattccaggaccacagcctgctacctctgcagctcactcatctccctgctttcatgtaaacctactcttctctttgggttcactgaaaactttgtatctttttttaaaatcaaaacagttgtataggcctggtgcggtggctcaggtccatgatctcagcactttgggaggctgaggcaggcggatcacttaaggtcgggagttagtgaccagcctggccaacacggtgagaccctgtctctactaaaaatacaaacaaattagctggtcatggtggtgggccctgtaatcccagctactcaggaggctgaggcaggagaatcacttgaacccaagagacggaggctacagtgagcagagactgcaccactgcaccccagcctgggcaatagagtgaaactgtctcaaaaaaaaaaaaaaaaaaaaaaaaaagagtagtacatactggttaaaaaaaaaatcaaacagtactaccaaacagtagaaaatatttacgattaaaaaaaaaaagtatctttggtacccttccttagtcccctcagtaaagagacaaacatcactggtagttttctacccctgtagtaccttatagagtaattttgccttattcatcacagacaggtcacctctggacatggaattctaataacaaggacgctctatcaccaaagtcctactgttgaaccttctccagactccagtactatgacccctccatttcccttctgttctcagtcttctctcattcttgcttccttccctgctggcctacatgtagtgattcatcacctcaaacgcaatctagccaatactcccaacgatctgtctcttttcttctgtcacaaccaatgggcaaaactttcaaccctggatcaatctaacatctgcctgctgtgcccctgaccccggctactgtaccctactggagggaagggagaaaaatcacaaaacagcaggactggaccactgcaaaataatggtctccatcttggctgggcccttgatgctaccctgaaaatcttctatctccatcattgcttcattctattctctacaccttcctcaagtctacttgatcaccacctcccttatgctcagcagacaatcagaagagaactttcaactatccctaccctcttcccctctcctcgctgacaaaaatatctgcaacacacacctgcctgtaccctctcctggacctccaccttgatggaaggggcttccttttacctgtgctctggagctcttctcagtctcctcttgtataaattatttccccttttcccaaagccttcaaattatttctttcaactctcatcagcattaaaatgtttgcaatcttcctggcctcacttactctttcttttgccttcctgccacaaagactccctagaggaaatgtagcctgggcagctaaggacctgaactccaaaggaagacagatctggattcaaatcttggttctaacactttctagctgcaggccttctctaggcaagttatttaccctctctaagctgcagtttcctcaactgtaaaatagggatcataatacctatataattgggctgctgggaaggttaaatgagttaatacatgtaaagtgcttagctcagtgcctggtacctcctatgtgctcatgatgttggtcatacttagtattttgtagctgcttccttacaacctatctattcctcaatccactataatctggcttccttcaccaccacttctctcaaaatggcttcaccaaagtcctgtggttctgtaaccaaattcaagggactcttttcaattcattcattcattcaacagtaatttactgaatgcttactatgtgccagggtgttgtaagtgctggggatacagcagtggtcaaaacagacaaaaatcccagctgtcagagagctaatagaaaccactcactccttctgggacctcttgacagcatcagacatctctgaccttcttgaaactaaactcccttagcttaggggacattgctctcttggttttccttctaactccttgaatatgcttcttcattcaacttctcctttaccaatcccaatgtactaatgttacccagggtatccaaggttccaaacttctctttttcccttcgcttacactctccctagacaatgtcatccactcccacagcaggccaatgactcccaaatctatctttccaagccaactcttcttctggagctctagacttgtacacctccactcaaatgtctcaaaagccacttgaatcttaaacataaaactaatctaactcttcattcctcctcctggctgatcctctctctcactttgataacagccccatctattcacctataccagaaatctccttcttctacaccttccatctaactgagtagatcacaagttcatcaactcaaaataacatttacagactgtctgatatctcaaacattgtgttaagcactgagattacaacagtaaaaatactttttaaaagtcttacaattacacaatccttataatctcttaacacatcgccattttcccagccccactgggccaaagccttaattcagcctcttgtaatttctcacctggatgactataaaaaatctcccaggcagtcttcccctgcctccaggaatacccatgtcaatctactatcctcagagatattagaatatgaagataagagcatgacagtctccgcttaaaatcttccaatggctcccatagctttcagaatacagtccagaattcactgggtaatcataagaaaatgccttgtctttttctgctcctgtgcaggaactctcacaatgaacaatgaactcttaacagaaccctgaaaatgccatattttctccatatttttctttgcacatattgcttcctccaattgaaacaaactttgccttcccgccacatctcccctaattaagaaacagctctattttccttttaggaaacttttctgttattccccccctctttcctaagaaaccctcctatgtgatcatgcagcaatgtatacatacatttttcaaaacacttttcttaagatatgctgtttatttgtctatctcctcacctaggttgtgagttcctcaacaggagggaccaatctcagtgtctttgtattcccagtgcctgacacacagcagtcattcagtacatgtttgctgaaaaaatgaatgatgttggaattcaaaaaatgcatattttatgattgtgctatgtgataatcaggcataaatagcaagtagttaatgtagagattacttttatatccccaaacctagtatttctgaaatcctgagactggggtgggcgatgctaagaagacgcccagacttacacaaagtgccttttcagacactgctctgaagacctctggatccataaattctaagatttaggtctttccacttctctgagaggaagaactcgttgctgtattagggtcactaataactattagggtaacctggaaactatcaatctttacctcagtgcacaatagcctttccctctaccacccgttccctcctgaatcaaaacacttccatcgtatcaatgtgtttgattcacagaatcccagcactatggaaaaaaaacacattggtttcggttataaagtggtagctgattttgcttctggattgaaaactaagaaaggcaacccagactttgccaccttcccactctttaatgtctactctgctcccatatcccctggtaccctcctaggctggtgccaaagtttgttcccatgcccactttcttctcttccccctcccacctttatacacatcatatccaggtttcatctcccccatattctgcctaataaaagcccattatatcattcatttcccactcatttcttcattccaaccaagatatattgtgcatttaatgtgcatcaggaactgtgctaggtgctggggcagttaaaaagaaaaacaaaccctggtccctgcccttgaggagatcacagtctagcaggagagatgaacacaaacaataattacaaacattgtgataagggctatggtagatttaatagccacgtccaggaaaggtggaaggcttgacgttgaaggggacctctgagtgggatcttgaaccctgaattggtgttcaccaagctaccaagaggagaaaaggtattccaagcctgggaagtgaattggtgtagctaggagagaagtcaaggccaaccttgtcaaacttcttatcccagtaaagtgggagtctgtgaagccgactgccctgagctggggccttctccttagtgctgctgaatttagtctagatcatggtacctcctcctgtaagttccaagattcttcaccctccacagactattaatacctacttggaagtatcactctctccagcccacagatgaatcctgaatgttcttccttcctctcattcccatcccatattttttgggtaaaagttgtacccatctttttttgggaaaagctgtagttaaaaattttctattttcccctacttttaaaactgatctgtccctcccaaccctatccccactggaaagagaacatctccctaaaattctagatctcaagggataactttagttataacattttgcacaattttccaatttttttgtaaatacataaatttattaatttttaaaataaaaatgggcccaggctaggtggctcatacctgcaaccccagcactttgggaggctgaggcaggtggatcacttgagttcaagagttcgagcccagcgaacgacttcaaggttcgccagtcaacatggcgaaaccttgtctctactaaaaatacaaaaattagctgggcgtggtagcaggcgcctgtaaacccagctacttgggaggctgcggcaggagaatcacttgaacctgggaggtggcagctgcagtgagccaagcgaccacgccactgcactctagccttggtgacagagcgagactgtctcaaaaaaaccccaaaacaaaaaacaaaaacagaaaaaaaaaatgggatcctaatactattagtttgtaacatttttccccttaccaaaatgagctgtagatctgttaatgtcaatatatatagatttacatccttcttgtaaatgttgaatataattccaatgatgagatatacattaacttacctaacttctcttctgtttgtagacattcggtaatgtttataagtttttagtattataaacaacactctagtaaacaaatattcatatatatgtatataagcaattgtgaaagatatctgtaggataaattcttggaggtggaaatgctaggccacaggtaagaaaagttttggttttgatactgccaaattcctcttccaagttactgtactgacttacacccaaatccacatatatgggcccatctctccacatctttccaacactagaacatctcaattctttttcaccattgccagctggatttaaaaaaacacatacattgtttcaatttcaatttgtatttctttttaagttttaatttaattttttttttttttttttttagagacagggtcttgctctgtcacccaggctggagtgcagtggcacaatcatagctcactgcagcctcaacctcctaggctcaagtgatcctcctgcctcagcctcccaaacagctaagactacaagcgtgcaccagcatgtcaggctaatttttatttttattttttgtagagacagggtctcactatgctgcccaggctggtcttgaactcttggcctcaagcatttctttgcatttactagccaaattttttttactcttttttttgagacggagtctcgctctgtcgcccaggctggagtgcaatggcgcgatctcggctcaccgcaagctccgcctcccaggttcatgccattctcctgcctcagcctcctgagtagctgggaccacaggcgcacgccaccgtgcccggctaattttttattattattattatttttagtagagacgatgtttcaccatgttagccaggatggtctagatctcctgacctcatgatccacccgccttggcctcccaaagtgctgggactacaggcgtgagccacggcacccagccattctttttactttttaaagttacttttcttttattgacttgttgcaaatatctgcctcattttatcccttattttttaaccttatgctttcttttgctttaatttttatgtagtcaaagctatgactcttttcctttacggtctctttatttgcttacttagaaaggcctcctctacccctaaaattataataatagtttccttcatttctgtctaacacttcaatggtcttttatcttcagatctttaatctccctggaatttacttttgagtttgatatgaggtaaggatttatttttttcccaattggataaccagtcatccttaggtatttattgactaatacatcttttcacatttgatcagaaatacttctttgatcatatattaaattcccacatatatacacatgcttgcttgtctctggaatctattttcttggtaatcttattgtcagggaaatccgccatgtcatatctctaccatattttgtcactttgcccaatatataaccccctttgctcacttctggtcctgcacttctatttttatacatgttgcttcctcttctccaccagaccacctgtgtactacatatcattcaccttgtaaaccctctgagatcttgttgtgtagttacttaattactcagcctcttctacttcctccctaactgaagcctggctctccccaggaataccacacaccacttcccctacaacatgctctgagaggcagccacttcccacatcatagggttgagatatggggctgcttctgggtcatccattccaccaccaccaagtaataaaacacctttcttctgtggttcatgtcatccagctgttaaatcttcagctctccttgttacaacactctgtagcttcctgatcacttctttattcacttaatttttttttttttttgagatggagtcctcctctgttgcccaggctggggtgcagtggcgcgatctcagctcactgcaatctccgcctcccaggctcaagtgatcctcctacctcagcctcctaagtagctgggattacaggtgtgcaccaccacacctggctaatttttctatttttacaaattagacggggtttcaccacattagccaagctggtctcgaactcctgacctcaagtgatcccacagcctcagcctcccaaagtgctgggattacaggtgtgagccaccatgcccaaccttatttacttaatactttggatcctgttgcccagtattcctctccacctcaaggctggctattatcctagatgattttcacacccaagaggaagaactaacccatgttctggcttagcagtcatccaacaacatcctcctcctcctcctcaaccaccctcctgtggttgccttttggaccttcttctcctcggaagtgttcaaactcattctcccaagctctagtactacatagctaactgtttgcttgatacctcatagtcaacacgtcaaaatcaaatttacttttcatgattctcactctacctctcaacctcttaatttcactgttttttttttgttttgttttttgagatggagtttcactcctgttgcccaggctggagtgcagtggcgcactctcggctcactgcaacctccacctcctggattcaagcgattctgctgcctcagcctccagagtagctgggattacaggaatgcaccactatgcccagctaattttgtattttcagtagagatggggtttctccatgttggtcagactggtctcgaactctcgacctcaggtaatccacctgcctcagcctcccaaagtgctgggattacaggtgtgagccaccacgaccaccaatttagctctttttactccttcccttcctctcctactattttccctatctttgttaatggcagcacgagtgaatgagagccaacattcaaactgctaagtcagaaatctgggagtcatcctcagcaccctttccctccaacctaactcccacttccaagcagccacctcctaaatctctcttcagtctttctagttttctctgtccttacagccatcaacccaacttcagccactactctctcttatctagaccactgttggcagccttttaactgggtttcctgcctctaatcccactctacagcaagccccaatgtagctagagtttagtcacatcacttatcctgttgactggactttactggccttctttgaccttaggataaagctccattccttaccagggcttattaggccatttcatgacctttccatctatcacctctttagcttcagaacttgctgatccaccctagagttgtgtacttcagctagacaccttgagttccttgaatatggcatgaaggcttctcgcctgtaggccttttccacgcgcagttctttctatgcggaatactatcttcacccccactaacttctacttttagatctccttcaacagctctctaggaaagccttttcaatgtgcactttctccttttccccccatacacttaggtcaggtgttcctcttctgcactcccaaagtaccttgtgcttcagttatcatagaaaaatatcacactctgtctgtatccccacttccagaaactgtaaattctttaaggacggggaagttcaatttaatattccttggacctagtactattgacaattaaagttacttaataaatactacctgtactaagaatagatgggaggaaggaagaaatgctactggaatctggtaacaatgggccagggatcaaaatattcataacctgagtgcttatgagtaactagatgttagaagttactacctatttgaagtaattaacactaagatgtgattagagcttaatcctgccagaggccagtagttttccaaattgctaactggactgacaaagacgtgtatgagtatattacaagactgtacagtgacaaaagcaaaatttatgcatgactggaatttctgctccatccctacaagctgtgtaaccctgggcatgttacttagcctctatgtctccattctcaaagattgggataacactgacctcacagagctgtttatgaagattaaagggcaataacatacatcaagtgccagacaataaatgctagtttccttccgtgttctacttcccttttcccaataagacagttttgccccagcaaacctcgactctctcatttggccagaggagtcctggggcagggtctcctatggcaaagccacactctaggagcagcttccctgaagggtttttcatgagcctcttataggagactgaaggcttcactactgtgagatgccattctgtatatgaacaggctgacacttcaaaatacaagagggacatggccttagaactctgaatctcccccaacctaggactgcagctccaggcaaaacaacaaagccactaatgtggaatcctagttacaacaaggacaaggttgaacaaacagtaagtagttaaacttttcatgcataacagtgtacctagtaaggcatctctcttaccccctcaatcccaagagctttacaaaagaaggggaaggctgcttaatgacagctgacaaacacccatacgtcctgtatttttgagtatacgcttccacagaaaggagctctacaccacacccaagcctaaccagcctcaagatgtggacacaacaatagcatacagcagttggctggggatcagggctgagtgtgtggccaggaagcttaagcaaatgccacagcttgaaacaggaacaaaggacaagaagagagaagactcaagttcctgacccaataatgggttttattcattacagccaggaatacagaagaaaatataatccatttctgtattacaatggactgtaaacatgtaaaccttgagacagctcacaccacagaaaactcttcacacatacacctctctgacccctacagacccaacctcctttcttcagctgactttgttgtcagtggctccaaaaaggtcatggaacctcttgaggatgatgcaaattgactctattttatcacttattttcaggaccagtagaagaaatttaggaaactgcagaaacataagagtgatccctttcttttgtttttgtttctaggtttttgtttgtttgtttgtttgtttgagacaaggtctggctctgttgtccaggctggagtgcaatgacacgatctcagctaactgcaacctccacctcctgagctcaagccatcctcccacctcagcctctggagtagctgggactataggcatgagacaccatgcccagctttatttcttaaaagaagtactggtaaggctgtaaaactcctttccctctatataacaacaggaaagggattgaggcttatgccttgaacaggctaagaaacagacaacatgccctagcatgagacggttaaaaacaaacaacaacaaaacgacaaggtatccattgtcaaaaaccttccaatgctatgcttctcgctcctgtttggaggtaaggaactggggtagaaggaaatggaaggaaaggcatctctggggcttggacttttaatttttattgttttatttttaaaatcaccaagttcttcccactattataccctcccttaaagactgaaaaaacattcataactattttcttgttatcctcggaaatgtctggaaggcaggcagagttaaaaaaaaaaaaaaaaaaaaggaagtagcagcaacagcttggaaattaggcaattagtctgaaggcacagagttaaggggttaataaacactttctcagctgactcctgaatgaatcatgttccacatcctgagtcctccaatgtatactgtgttcaaacagaatatccaaagcaggggaacacctacagctcacagaaataaaactcaaatttttcataaaccaggcccaggctacccacatacaccttgatcaagtttagcttcttggactcagtactatacagggatactagaaaagtatcatgctttaggtaataaatggtggctcacacctgtaatctcagcactcggggaggccgagacaagaggatcgcttgaagccaggggttcaagaccagcctgggcaacacagtaagacccccatctctacaaaatgcaaaaaataaaaaaattagctgggtgcggtggcatgcgtctgtagtcctagctactcatcagtgaggcgggaagactgcttgagtcctggagttcgaggttgctgtaagccgtgatcacaccactgcactccagtctgaatgacagagaaagacctgtttcttaaaaaaaaaaagaaagaaaagaaaagaaaaaaacagggctgtgagaagagaggctggtggaagactgcaggccaagctaatctaggccctgggattcaaaatgaaatatgacacttattttgcccttcaactaaaaactgtgcttctgccatcaccttctttctaaagacaatttattcatcactgtatttctcctatgtatccctcgttctccagaaaccccttcatgagaaaaagtaattctactacaaaaccttcttcccgtgttgttttcttcctctttgcttttaaaacaataaacttagtggcaatcatctttggcaggaatatgccttgtctttgccgtgggaaaggttaaagtatagttagccgctagcccaattaaagtggagagaactaatcggccttattctttctccccagcccagctgcttgaccttatctgtttccctcctagatgcaatcccaatgcatctctcactgcatgctgagttaagagcagcacgagttgggatcacacaataagcagcatagtgtgattatcctttgcctggaatcacacacttacactccaaattggtaacctgaaaggaaaggtaatcctcaatgaaaacctgcaaatcatatctttttgatgatcttctcagacctgtaatcccaacactttgggtggctgaagcaggcagagtggttgagcccaggggttcgagaccagctggggcaacatggtggtactccatctctacaaaaattagctatgcacctgtagtcccagctactcaagaggctgagatgggaggacagcttgagcctcggaggtcgaggctgcagtgggctgtgtttgtgccactgcactccagactgggtgacaaaataagaccctgtctctaaaagaaaaaaaaaaaaaaaaaaaaaagaaaacaaaacccaaacccataaagccttcttacaaatgtttacacaaagtagctctttaacgttaatatattttacaaataattactacatatctacaacgttccagatacagaagaaatggccaaagaaggtattttaggagatccagattataatgaactatgccatttattaatttagtcacttctttaatatctgaggatgagcaaatcaaatactgataatggctgcagaaggacacaggctcttatataataatcttacttccattccagaataaaagggctggagaaggggggcaggattattctgttgaaggacaatggcatcctcagcaactcacagggatgtgcaggtgaacatcagaccaggatgggaaccttataatatctatgatatactatggcttctatcaaccagtttcaggaaaagcaaagaagaatgcagtcatggccaggtgcagtggctcacacctgtaatcttgaggtgggcagatcacatgaggccaggagttcgagaccagtctggccaacgtggtgaaaccccatcgctactaaaccccgtctctactaaaaaataaaaaattagccaggcatggtggtgggtgcctgaattcccagctacttgggaggctgaggcaggataatcacttgaacccaggaggtggaggttgcagtgagtcaaaatcacaccactgcattccagcctgggcaacagagcaagactccatctcaaaaaaaaaaaaaaaatgcagtctaatggcagaattagacttagccactttacttggaaaaatttggactttatcagctccatcaagcaccatgctccacaccatgcttattaaatgtctggagcaacattagatgggtgccattccaaattccaaataatcacatctttgctttgcaaacaggatgtggcttaataatcaaacagggaactagattcattcaagtatctagttcctaaaataagtctatttaacaggttcaacaacatgcaacacacaccctccaattggtagaaacacctctcaatgacaaagaaaggtggcaaatactaaacaccttcacagaccatttagcaactggtgggactaacccttgaaggtgaattcaaaatagaactgaacctcaataccagacttctttttcagaaaagggagtatgaattcttagtttcaggttcagacaaaaaccagaagttgtattgcattaggaaaaacactgggctggtcaggtggctcattccaccctgtaatcccaggactttggtaggccaaagcagggggatcacttgagctcaggaattggagaccagcttgggcaacatggcgaaaccccatctacagaaaatacaaaaattagccaggtgtggtggcatgctcctgtggtcccagctactcaggaggctgaggtgggagaattgcttgagaccgggaggcagaggttgcagtgagccaagattgtgccactgaactccagcctaggtgactaagcaagattctgtctcaaaaaaacaaaaacaaacaaacaaacaaaacctactggcccagagcctacaaataagttgtttggaggaagaggatggaaatctgttagttaagatttaacctgcatatgttgccttctttactaaaatcagactcataaagaaatgtattctggcttcagccttgttggtattgctctacctctatttgtttcccatgctattgcttcatccttgtttctgcagaactaggattttagctcaaagtcacctaaaagcctccacaggaaactacattccaaagggaagactccatgggaagagcaatagagaaagaagttacttttaagtctttggtaatgttcacccaacccagttttcattttctctcaatggacaagaaccctcaactaataaagctaatgaacttacaggaaggtaatatatggaaataaacatcttattgaatttatctggctctaaatctcttttgttagggaatttatagtattccattatcttacaatctctccatttctatctacttgattaaactatggtgctatagcaatggaggtgaaggcctaatttagaagtataggaattaggtatggcgcggtggctcatgcctgtaatctcagcactttgggaggctgaggtgggtggatcacttgaggccaggagtttgagaccagcctggccaacatggtgaaaccccatctctactaaaaatacaaaaattagctgggcgtggtggcaagcacgtgtagtcccacctactcgggaggctgaggcaggagaatcgcttgaacccaggaggcggaggctgcagtgagccaagatcgtatcactgcactcagcctcagtgtaggctgagtgataaagcgagactccgtctcaaaaaaaaaaaaaaaaaggaaaggaattattctcatgtatacaatagtaggaaacaacctataaagcttttgagaatcttataattcactgtgtacctccctctgtttcatattttcgcaattgaactatagagcctaggcctaggtcttaagacttttcttgtaaccttcagagtgcccagcactgggattgacatataccagttagacggatttttttttccataaaccaggctcaaactcttctaaaccaaaatcaacatattctgagtgccaatcttgggtaaggcactctattatttgtcatgaaggattcagaggaaaatgtgatctaccacactcaacagcaggcctcttatcctctccagcttaatgcattttaccagttaaggactaccctgatgctgagattgtgtttctttccccaaatcaaatgtcactctctaagggtcatctgtataattaaatgcttttaattctatatatcaaatgataacttttgtgaaagtaatttaaacacacttgaaacatcatataaaatattactacaagacttaaccgtaaatgtggctcccacccccataacatctatacaatataaccaaagagctagattccagattatcaagaaacttctaaattttgaacccatgcagcagaattgtattcctttacattgttggctcgacttacaaatgtgctgtggaataattatcctcaaatacaattttcagtactgattacatagctgcctaaaagaaaactgttagccccttccattttatgtgaaaccaatgtctaaagcgctcttgactcttcaaccccacattttccccaccctcatccctcctcaatccccagcccccactcatcacatccactagacctgaactttgaactcaatcataattctttgtgcctctgctcaagcccttcttcctgcctggaataccctcttttcagtcccggctaattacatctaccatcccattccaagtggccgctggaaactcacttccttatgttctatgatttctttcacaatttacactttttttgttttgttttgttttgtttgggggggggggttgtttttctgagagggagtcttgctctgttgcccaggctggagtgcagtggcgcgatctcagctcaccacaacctccacctcatgggttcaaccgattctcctgcctcagcatcccgagtagctgggactacaggcgcgcgccgccacgcctggctaattttttgtgtttttggtagagacggggtttcactatgttggccgggctggtctcgaactcctgacctcgtgatccgcccgccaaacattctatgtgccagaaacttgtatgtaactttgcatagttcttgtattatgtctccccaattttgagtgttttctctggtctctactcagcccttgctcacagtctcactaggaccctggctagcttgaacacggtcagaaggatcaccttagatttctgctggcacagtattttccataaattaatctcctgattgaaccgtagtcctatagtagttatctttggatgaaaacctaatgcagctcgaggaggaagtggagtgcctgtgatcagagggctggacaaaagcccatagggcgtctctggagccctgggggaactgtccccaggcaggcactctcagggcccaggaacagggcgggacaagtccgactcacctgtgaggtaaggacggggccaagacccggaaccgaaaagcaggtcacgatagcgctggaaggcctcgtcgaggactgagcagccgggctgcgcggccgagctgacatcgtactggaattgaaagttgttcgggtaaaggacgtagcgctggtcggaggtttggaagttctgaggccagggccagagggccgtcgcccgtcctgcgaacgctgccgccagcagcagcgaaaaccaaagcctggagcttgtcatggcccgctggtctcccctctcggagggggctggccacgtgagaccctggtcaggtgagcggcgcccccgtgacttatcggcgaatcacgtgaccagaggcggctctgcgcctgcgaccccaggaggacccacaccctgccctttcacttccggcctggacctgaggctcctgctacgtgcagcggattgtgccgggcgtcggcaact

SEQ ID NO: 344 - DNA, 42207 bp, Homo sapiens
acaaaccttcctgcgcaggcctcgggctgcctgcctgcctgcctgcctggcccggcccgagctccagcctgcctcttccactggccactgcctcccacccagggctggcatccctgctccctgccctgggtcccagactgtgtcctccatcaccgcagggtcggtgaggggctgggctggacaccagggcccgccctcccatcactgagctccactccttcctcattttgctgctgattctagccccaaacaaaacaggttgagctttttcctcccctcagaagctcctctctggctcgtggctgccttctgagtgttgcagacggcgccggccgggaaggggggcctgggccagccctgccaggactgggacgctgctgctggcgcctggccctccatcaggccagcctgtggcaggagagtgagctttgccgcggcagacgcctgaggatgatgccccagctgcagttcaaagatgccttttgggtgagtgaggatggttgggggcactgaacaagtggagggggcagagctaggctgaaatctccatgcaggtgatgggatgcggctccgagaggggagctttctcataaaatagtggttgattcttggtcttaattgtcatggaggtggcccaggcccccaccccttctggactggaacgcaagtggactccgtgaatgagcgtcctcctctctgctgccccgtgtgttttctcctctgggagacctctccccacagcaggagctcctcagaagagggtaacacatgggtgggggcttgaggaggatgtgtggggcagcaaaggaggggtcacagatttagagaccagacaaacttgagttcaggtcttggctctgttacaggctgggcaagtcatttctgtctccaagcctcagtctctccatctatataatggtgataaaatagaaatcaacacaccaactaaagcattggatcagcaaggggatccaaggcactaaagcccccagcaccttgcctcactccaaatggtaattctgttcccctcacccagccccttgtcccttgcagaccttaggggtccttcaaggaggcagccaggtgggcaatggcttgcttactttcttaaattcaacacgggcttaaatcaagtcatttcccccatgaaataagggcgcccagccagtggtagaggtaaagtggcttggcccgggccacgtagcctgcagcccagcttggacccctggtcatctcagcacttttccagctgtccttcaactacccctctgcccctcagctctggctgtgcccagggctctggggaaaaactgagacctctctggttggagctggggaatgtggctgtcccggggtgctgcctccaaccccgaagaggacgctctggccctcggctcagccggctgagccccagccaacagccctgccctccccgggccttttcctggggctgcagccaggaggatgagagctatggagccaggccttccttcccttccggccggctccacttggggcctgtggccagcgtgtgagtgttctgcttcctctgctctgactgtacagtaggcaaaggaccccacgtggggagggcaccttgtgcctttctgggcctcagtttccccatctctacaaagacagggtgggcccagcccagagaagccaatggaggcagagctgcctcagcccatccggaggaccaggcaccaggatgctcagggcccaggctggcagctggagccctgggggatgggggatgtgagtcaccacctagctgccctgccttggtgtgcaaagttgggggaaggggtagggcctggaaacccaggccactctgtagcccagggcaggccaggaccccttgactattttatcactgagacctctgtccagtcctagagcccctgggcctgccttccctagggcagagctgggcaaggagcagcctccatggcaggatctgggcacaggtaggggtggcgtataagggagcagggtatggcagccgcagcagaagcaagcagccagcccctgtggagcttcctgagcggcatcctgcccacactctgtgctcgtcgcacctctgggcttcctggcctccaagtgccttgtctcctctgtgtctggctccctgagcctggggcgggcatatagtttccctagggaaggccagagcaggaaggggagagaagtagccagtgggaacctctcacactgagtctgggccgatgccccgaaaggtcactgtaggcatcacctgccccagggctctggattctaatacctcttcctgatgctcagcccatcccagtgcataacaactaacatttgctgagcacgaaagatgtgccaggcgctgttctcaagatgtatgcatattcactcattcaatccttcaaacacatgctactgttatctctcttattcagatgaggaaattgaggcacggagatattaagagacttgcgcaaggtcacactgctgggattaaacccctggcaggctggctttagcacttgtgttgttgcaggatccctctgtctatctgacatatcactggatcttttggcttcggggtaagataagaggtaacccctcttatctcccagaggggtaagaaaatcagacaaggtggctagaacaatattctgaagcttcatttgtagacaaatctgtaaaacagaaaaggcacactactctggccacaggtgttatattaggaacagcccagccagcttggcccatgtctgggccttcccccaccccagcccaaggcactgtcattaaacccttcagcctgccagcacactgtttagaaatgactggtttttaggcggggtgcagtggttcacgcctgtaatcccagcactctgggaggccaaggtggatggatcacttgaggtcaggagttcaagaccagcctggccaacatggtgaaaccctgtctctactaaaaatacaaaaattagccaggcgtgatggcatgctcctgtaatcccagctacttgggaggctgaggcaggagaacagcttgaacccaagaggcagaggttgcagtgagctgagattgtgccactgtactctagcctgggtgacagagctgacagagtggagggaccctactttggctaaactggaaagatcatgtttgatatcacagcccctcagttattgggcaacctcacccatacagaacacggggcggaggaggggagccagccctgctgtttctggctttagctcacagtaagggaggaagcaaaagtggtttctcaggagccaaagatgatttccctaagagctttccttaaagctcatatactacactcctaggagatgtcccctagcttttactcaggtcctatgaactctaatttcacccacaattttaatgagcttggtcatggggtcttttagcctatagatgtagcaattagtggcagtctgcacagtacctgatatacagttggcgatggataaatgctgatggacctggactacgaaaggacgtttcacaggcagctagcagcctgattgcaaggaaggagacagaaacagtctgaaaagcagctgtagtggcacagaagtagtggggacactcagcatgggagcagacacagtcctgtccctcagtcggcctgtttttgcaattttgtcagtgtggccacacagtatttatttatagcctgattttagctgcagccgagtgttcagatgcacgctgctgtaggagtgaggcagggcggaccagccacagagggagggaagggataatgtgatttctgtgatacacacagatgataaagagcatcacaccttggcaggaagtttgtaaatgagcctcagagtgggacctgtcagtgagacaaggttgaatctgagaataccagctgtctgagcggagagggcactggcctagcactgagtctaaggcgctgggaagcccagagaaggaagggtcctccccctgcccccagtttgtcgtggctccactcccagcaggtggccaaattattgcaagaaatgtctgtctgtatcctctgcacagggctgacaagtggggtactggctgaggacgtgttcatagaataaatgaatggacagtgaatgtctccatggtccatctcccttcctgaacccattttttacttcatttcacttttttttttttttgagaaagaatcttactctgtcacccaggctggagggcagtggcacaatctcagctcactgcaacctccgcctcctggggtcaggtgattctcctgtctcagcctcccgagtagctgggattacagacgtgcgccgccacgtctgtctaatttttgtatttttagtacagatgagatttcaccatgttggcctggctggtctcgaactcctgacctcagatgatccacccgcctcagccttccaaagtgctgggattacaggcgtgagccgccgcgcccagcactacatttcacttttgttatattctgcaaatatttggtgagtagggctgtctactaggtggtccacgctggacccctgagcttcttcaccctgcaacatctaatcagatgaatgaaactgtcttgacctgaaggaagccatagttcagtgccggggctggaggaataactgggtcaggcaaggagtgctctgagaggagcagtatctcaactgtgccatcctctcccaggtcccccatcccccgcaacctgtatgtctatccaatggcctttgcaaagatgtcattagatattgttttaagagggaaaatctagttctggaccagattctattgagatccacatcctattccttttagggtagttaaaaggaaaagtaaggacctggggaggctgggtcacatgcactgcagtgactgtcacccaccctttgggtgggaaccaccaagggggtatggggacaataggcctgaactttccccttgacatgtgggtgtatctctcctttgaggctgggctctggctctatctagaaacccctgtgccacactgggaggagctgagcctccccaagcccatttaacaggtgacagcaccgctgccgagtggggcagtgactcaccagcttcacacagtgggaccagctgggctggtctgccccttccctatgtggcactcagccactggtgccttttcccttcccagttctgagatgctgaggtgcccatttatgaggctacagagaaggggactgaggggccctactctgatctgtcataaagctgcctgtccctacccccagacctgtctaccatggcccaggggcatcaggagagcctgacatttgctgggcacctgttccatcctgggcatttaaagagagatatatatatatatatacacacacacacacacacacacacacatacacacacacactttctaaagaaacaaaatcaactaatataagatcctaaaaggaaagtggggaaatggagaaaaataggaaaagaagaagcacctttagtctcatcacacaactgctaatattatgctgtgtttgcataagattgccttacataggtgcaagcatattgtgtacataattttgtattttccctttcttttacaaattttttatttttgcagagatgaggtctccctgtgttgcccaggctggtctcaaactcttgggctcaagcaatcctcctgccttggcttccagagtgctgggattacaggcgtgagccaccatgcacggccctccctcctttttttttctagtattttaaattttattttaaattgtagcgaaatacacataaaatgtaccatcttaaccatttttgtggtgtatggttcagtagcgctaggtttgttcacactttgccaccctcccctttttttagcgtaactcactccatcgggaacacctgtgggtgtggacatgggttcctcattttcagcaacaccactgttcatggctgcacagttctctagcttgtgaatttggtgaccatgctgtgattttttttgcccagtcctccactgctgaacatttaggttactgccaattatttattattctggacagtgacaccatgggtagatctttgactataaaggtttttcacttggggattatttctttgggcagaggaggctaatggctattttccagggaaggaggcatttctgggtgaaagagtggggccagttctccagccatgggtactagcagtcactttgggatcccccatagtcctctggttgggcaggagctttttcacacaggaaggagggaccccagaatggcctggaagggtcagggcctgtggatggggccctgctggaaaccagagcctgcactgactttgtggaaggccttgcagcccagcaaactgctgtggctttgagggccaaggaggccagtggctgaggagtggccctggtgcactcagagcttgcagacagtgcaggaggtgggagagagaggccctggccatcctgcctttgctgccaccaagtaccttcccggcacctgcctggctgcatctgtcagaagcagtgaggacggaggctctccctttcctgattgggaaagctctttaagacctggtgttccctgtaaaaagcagagagcctggcagtgcacctggtcggcaacccgttgtgaaaagtggggaaataagcatttatactggcgcaggcttgtagtattaacaacaaaaatctgtggacggatgcacagggagctaattaaagtggttgcctgttgggagaatgagagaaaggagatggatgagggatgaggctgagcggctgtgaacgttttcaggattgatgtttttatactgtttgatttttgaaccatatgaatgtattaattattcaaaaattaaatcaaacaattaaaaatgaaaaagaggacatttatttcaagtcccatgaagaatttttccctgaatcccagctacttacatcatcccctgaggagcagcaatgctgccatttgctgagtgcctgttccatgccaggcatgctgccattcagtccacatgcccccaaacgcattgtcagtgtcttcctgactctgtgatgggacctaaggcacggcaggtctaggcccagacgagggtcacctgtgcagggtagagcagggactcccacctaggtctgtcgaactctattgccctctgccctgaattctagagagtttgttcttgcttctactttaatttgtgtaggatgaaaggatgcttccctacatgttaacactggtgtctatggatttggaagtaggattctctccatcccccatctaattttctgcaagtcaatacagagtacctttgtcattaaaaagaaaatatttaaaaagaaaactaagcaattcctgctttcaagaatgagttggtgtttctaggccaaatttgtggtttgctagcatgcccttttccacatgctcggtgcatattttgtggtacgtgggcctctggggaccaagaacttcgttcatctgtgcccattccacaggacgtggccggctgctcaggtgttagaagattgcagaggtttgtggtcatgcttgctttgcttttgcgatgcctgcagatggtcactgccaggatttgctggctgcagggttctgggtcgatttggtgttctgaattcaattttattcttgataaaaaacaagatctgcttcttgatgacccactttgtgctccagtcccctggaacccacatgcttttcctggctgctcctgacatctacacagaactagggcagcccctgggatggagaaggagggccttgctttgggctttgaagggtgggtgaggatttgagacatgtcaggaggacaaacggcactcaaggtgggaggtacggcatgggcaaaggtgtggaagggggtttggaagacagttttctggcccagagcattgtgcaaggtgactggtaggaagggaaggcacgagctggattgtgaaaggtctctgccctaagtggtggcagagatactttcttctgcctctctgcaccctctctggtggtggctgtttcctctcatgcaaaagaggacagaggctgcgggctgtgagtgggatgcccttcctcctcacccagagcctggctgacgctgcaaaccacatgatggagggaactttgggtggaaaccaagactgcctctgcttccagctagagagcatgatgccctgggccctgggctgcccacaccaggactctcctctgggttggctctggaaggttcctccctcacagactcagtcatgctccatcctccaggcttagaaggaaatcggcttcttgggaggccgaggcgggtggatcatctgaggtcaggggttcgagaccagcctggccaccatggtgaaaccctgtctctactaaaactacaaaaaaattagcggggcatggtggcgcatgcctgtaatcccagctactcaggaggctgaggcaggagaatcgcttgaacccaggaggtggaggttgcagtgagctgaggtttcacaattgcactccagcctgggcaaaagaacgaaactccgtctcaaaaaaaaaaaaagaagaagaaggaagcgggcttctttgaagcctcacccaaccctcacccacacttgctaggtggccttggagaatcattttccctttctgaacctcagtttcctcatctgcaggatgtcagggtcgtcatcacttaagataagggctttgaggttggggcggctcagggcagtgctaagggaccacctcctgctcaccacagtggagtagcagaccaggaacagttcccaggggacccagatttataattggatatgcacccatagggtgagccttatacatagatcttgctgtttcagaatgcctcctccaatcatgttcaccattgcatgttatactccaccattagagaatcattcctttggtttcaagtaacaagatgatctatgttatctcacttaattccaacaatagtcctgtgaggtcagtattcttattcctgttttacagagaggaaactgagcctcttggaaggaatgtgggcctgggggatgccacacagatggatcggactgggctgggcctggatgccaccttcccaggtctgggtcagagagccctttgcagttaatgggagggtgtgttggtttgctgaggcctggcacactgagcaatgggtgatggaacaggcaggagagcgacagctccttccactggtgttgacaggccacccaccattgggcaacaggaagtgccagctggagccctggagaccagcagccagtgtggggatgtggtggccagatggaactcagggcttcccagctgtggaaacaggaacgggaaacagccacactggggaggaagtcagggggtgatgggctgaggcaagagcatgcctgcgtggctagagagagtgaccaaggtggagagtagttggagataaggtaagaaatagaacagtggccaggcgtggtggctcacacctgtaatcccagcactttgggaggctgaggtgggaagatcacttgaacccaggagttcaagaccagtctgggcaacatggtgaaaccacttcttaaaaaaaaaaaaaagtacaaaaattagctgtacctggtggtgcacacctgtagtctcagctacttgggaagctggagtggaagggtcacttgagcccaggagttggaaactgtagtgactgtatgatcgcaccactgcactccagcctgggcaacagagcaagactgtctcaaaacaaacaaacaaacaaacaaaaaaaacaaagaaagaaaagagaagcagagagccagatcttgtaggactgtcattctaaaaaatcccaatgcccaggccacaccccaggtcaattacaccccgatttctgagggtaggacctggacatcagtatttttcaaagttccccagtgcctccatgtggaactttagcttgagaggcatcaacatagataattgtggtaattaattaccattgctggccaagcatggtggctcatgcctataatcccagcagtttgggaggccaaggtgggcagatcacctgaggtcgggagttcaagaccagcctggccaacatggtgaaaccctgtctctactaaaaatacaaaaaatgtagccaggtatggtggtgcatgcctgtaatcccagctacttgagaggcagaggcaggagaattgcttgaacctgggaggcagaggttgcagtgagccaagattgtgccactgcactccagcctgggcaacaagagcaaacactcaatatcaaaacaaaacaaaacaaaaattaccattgctgacaataggcatacatctggtttttaccattttcctgacctcatttgactcacctgagtgagcagaggttagaagttttgggggtggtggtaattatatgtaacataaaattgaccattttaacaatttttaagtatatgattcagaggcattaagaacattcactatttcctgaactgcttcatcatcctgaacagaaattgtacccatcaaacaataactccccaccccttcaccgcataccttgttctacctcgattctactttctagctctatggatttgcctattctaggcatctcctgtaagtagaatcagataatatttgtccttttgtgtctggcttatttcagttagcataatgtcttcaaggctcatccatgtcatagcatatgtcagaattttcttcctctttatgacaaaatactattccattctacgtatatactttattttgtatatccattgatccattgatgaccactgggctgtttctttgagctactgtgaataatgctgccatgaacattggtgtacaagtacctgtttgaaaccctgctttcaattcttttagattatacctaggagtggaattgctggatcatatggtaatcctatgtttaactttttgagtaaccgccaaacagttttacattcccatcagcaatgcaaaagggatccaattgctccatatctttgccaactcttgttaatttctgttttttttttaaatcatagccaccttaggaggcatgaagtaatatctcatcgtagttttgatttgcatttctctaataattaatgatgttgagcatcttttcatgtgtttattggccatttgtgtaccttctttggagaaagtctatttaagacctttgcccacttttgaattggttgtctttttattgttgagttgaaggagttctttatattttctagatactcatcctttatcagatatatgatttgtaaatattttctcccactctggagtgtcttttcactgttttgatatacaaaagtttttcattttgatgaattcaatgtgtctactctttgttttgttgcctatgattttaatatcatatcagagaaataattgccaaattaaatatcatgaagctttccctatgttttccttttaaaattttgtagctttaggtcttacatctaggtgttcacttcatcttgagttaatttttgcatatggtataaagtaagggtccagcttaattcttttgcatgtggatatccagttttcccagcgccatttgttgaagtctgtccttttctcatagaatggtcttggcacccttgtcaaaaatcaattgaccatatatgttagggcttatttctgagctcactatttccattctattggttatatgtctgtccttatgacactaccgcactacttcaattactgtagctttgtagtaagctttgaaatcaagaagtgtgagtcctccaaacttattcttctttttcaagattgttttggctctttgggggcccgagtagagctgcttttgttgttccctttttataggtgaggagactgaggcctggaccctcctgagtttgcccagcctggactggccacgagtccgtgacaaactcctcatcatactctcaccctgggcatgtgtagggagacacttgctttagagggcccctgggttgtgggctcctccctgcgattgctctgccttacagctccccaagaaggtccatctatgacatctcggcttccttgaggccccacctgctctcactcttcttcaaggagggtctggagggaaggcctggaggctgggtcaccaacttcctcagtggatcaagataagaccctgcaaggaattaatgtctgtcccggcctcagcttgcctggataaaaatcagacttctggccctgtgcagtggctcatgcctgtaattccagcactctggaaagctgaggcaggtggattgctcgagcccaggagttcaagactagcctaggaagcatggcaaaacccaatctctacaaaaaatacaaaaattagctggggcgtggtggtgcacacctgtggtcccagctacctggggggctgaggtgggaggatcacttgagcccaggaggtcgaggttgcagtgagctgtaatcatgccactgcactccagcctgggcaacagaacactttttttttttttttgagatggactctcgctctgctgcccaagctggagtgcagtggcacaatctcagctcactgcaagctccgcctcctgggttcacgccattctcctgcctcagcctcccgagtagctgggactacaggcacccaccaccatgcccagctaatttttttgtatttttagtagagacggggtttcactggttagccaggatggtctcgatctcctgacctcgtgatctgcccgtctaggcctcccaaagtgctgggattacaagtgtgagccaccgcgcccgactggcaatagaacactttgaggactgcagtcactgaagcagaagggattcccttcttggtcacctcctgaacaattgcccattgacctggaccagctctgagcccactctcctaggcatcaggacatcagactacaggtggtaggaagacccagaacagctgaggatggttcaggcaagcagagctgggggtggagggcgggagatcagcacagaagtctggatcagtgtccctggagctgcagtgaatactaaacgcagccaggtgtgaggtctgcacagcacagggaagcacagggtgtgggtggggtgtttggggatatctgtgaggattctcactgaccctgaaaccaaagaaacaggtgtggctggtgccaggaccaagggaagaccagcagctgagcctgggtctagggtcagagcaggagccgctctgaagctgcagaaatttcatccccgtcctcagataactcccagtcctcaagggaaggagcttgcactcagggtctggcagtctttttgttttgtttgttttttgagacagagtcccactctgttgaccaggctggagtgcagtggcaccgtgtcggctcactgcaacctccgtctcctgggctcaagcaattatcctgcctcagcctcccgagtagctgggattacaggtgcccgccaccacacccggctaatttttgtatttttagtagagatggggtttcatcatgttgaccaggcttgtctcgcactcctgacctcaggtaatccacccgcctcggctttccaaagtgctgggattacaggcgtgagccactgcgcccagcattcttgatctgagtcctacctctgtgtaggctgagagtaaaacgttaaatagtgagtggtcccagagagcactaggctcctcacacagcccccaggcctggggtagggggagcatctgactctaagtagagtcgtgtttctccaccatgcggctgtgtgtaacatgtacactggctgtgttgggcagagcagggcgatttcccagactccaacatagaagcctttacttggcaggcgccatctttgtctctcactctgaccttggagcccagtggcccgcttcgatcctactacactcatgggtggtcctggggagcccctcaactctctgagccttggttccttgtttgtaaatattgtagtagtaaactaactttggtggttagaggattgagagtggagacatgcaggttaatggccaagcaaggataaggagccccacgtgccatcccctgcaggtgtggagtccaactagccccccaggcacggaaggcctcaggctcagctccgaggccctgaacctgctgaggatggcagagagagccaaagggcctccagaggctgcaggggtccctgccttcaaggaagggcacgggcataggagtggagctcctctgaagctctaggggcccatctctgtctcttgagcaagtcccaagcccaggggagcctgccagccctcacacctacagcaaatcacagccgcaaagcaggcacctcatatcagccctataagggcttaggagtccacgtattctccccaatttacagatgaaaaaattgaggccagagagtgggagccactagtctagagaagtgtcccagctaggatcaaacccagttctccttgtaaacgccccttccctgggctcctctcagttaacatgcatgaatcccctcggctgcccttccaggagcccggtgagcgtcaaatgccctgcatgaggctcctgcaggtgttgtccattcagtcctcagagcccctggaagtgggtgatgctctcatcccgatctcacagaggaggaatctgggctcaggaggtttgtgactcatgcagactgtgtggaactggccagaaccagaacccagtgcctgagccctgtcacgccccactgcctggactcgctgtgggcctgtcctcccctgggacatccctggcaggcgtaggtggtgtgggagggcaatgcctggggacggggatgtgcaatgacagtgcctggaccactggtgcccctggctggtcactcacaggcgggagtccattcggcaaggagccgtgctcttcctgtgaagacgcctggacccctcctggctggctacagggtcagtgcctcctccagggcttggggtctggggtggctcagctccatcctcccctgcatcagtcacccccaagggcccacggcctcccttcctcacttgccctcactgtcggcctccttcctcgcccactgctggatcctagtgagcctccaactgccaaatcagcttggcaggggcggtacagagctgtgtaacctggacaagtcactgttatcctcacttccttgtctgcctgtaagatggaacagtaacagcacagtactaacttgacggggttccctgaggactggaggggatcatgcgtgagagccccaccaggcaccgcacactcaatcccttcccctgaacctggaacctggtcctggttcctatgacctcctgggaaggtcctgccctttgctgtgtgtgacttggctctcctcagtctggcctcaggccaccttacagacacctgctccatctccctgcacctgtctctgctgccttgaagcaggttgcacaggaacagcactagcactggacttccaggcagctgagtctgaggggcgtgtctccatctacctctggccgccttgtgtttgctccttgcctcctctctcacttttcttctcttttctatttctttttcttttgagacagggtcttactctgtcacccaggctggagtgcaatggctcaatctcggctcactgcagcctctgcctcccaggttaaagtgattctcctgcctcaccctccgagtagcggggattacatgtgcccgccactacgcccagctaattttgtatttttagtagagacagggtttcaccatgttggccaggctggtctcaaactcctgagctcaagtgatccacccctctcagcctcccaaagtgctgggatttcagttgtgagccaccacgtccagccctctctctcttttctgcatgttttggtttcatgacacaggagaaagaagtggggattgggctggccccatgagagtgaaggaggggaagcaggcggggaactcaggcagtggggtgctttcctgcctcatcattgagaaggcctatttaaaagaacaaagctttcaagccagacagaccttggtcaaaagccagacgccccacaacattagagagagtcacctctcttgtcttcaccttcctcatcttcatgacagacagtagctgcctcgtggtcagtattgctgagggcaggtaccacactcatgcacagtgtgtccttgtccagtgcctgtgttgtcccttcagtgggacccctgggagtccctggaagctcacagggctctgatggggtccctgtcagccacgggcctgtgggcctcccagcacagtggagcccagcccaggcatctctgggactcggccagctgggctgctcaggtgaggggccctgtaaggcccggcagaggccatcagactgggactcggaggagaactgtggcactctggaaactcatttctaatctcaaggtcctgtcagcccaggtgaacaaagagtcgctcatctgacattaatgcacatttgttctctaaaaactaaaagtctgtctttgccttcttggccctctgtcttcaacacttaccctgggccatctcagacagctgtaagtcatcttcatcccatatttatttgcttatacatggatcgcagcagtacttgagtcaggggacccctagacaccaagtccctagtttaacaggccatctgaggcttgagtcctctctgtggaaccagacctgcttacagactgtagtgatgggcgctcctcacctgtcaaagccccccaccctctttccatacctacagccattcaggctcctgggaagcctttccttgcattgtcctggagttggcctccctgtctctgcccccatgagtcctggcttgggctgggaaatgccagccactagtgctccctctgcttctgatggccccacagagatctccaggtgagacttttcctaggccattccctcacagctttggcttggaactctcccttccctccctatcacctcctcccaaatactctgggtaagcaaccgccttgtttactgagggctctggccatccatccatccatccatccatccatccatccatccatccatccacccacccacccacccacccattcacccatccacctgtccatccatccatccgtccacccatctgtccatccatccatccacccactcatccatctacctacccatccactcatccacccatccacccacccatctacccatccatgcatccacccactcacccatccctccatttgtccacctgtccaccagtccacccatccacccacccacctatccacccatccatccatccacccacccacccatctacccatccacccatccatccacccacccatctacccatccacccatccatccacccacccatctacccatccacccatccatccacccacccatccatccatccttccatccatccattcatccatccatccatccatcaagttgtacctgagtgtttggtcctttgcctgcctcactttgccaaccagtaatggtggagaggagtcccactgtggggtactgactgtagggcggtggaaggagcctggttgctacccattgacttagcatccctgtgcctctgtttccgtatctatacaatggggatgataattcctgtctcagaggactgttgtaagaagtagaggggaccagtgtgactggcttctttaaaggtgctgggtaatgggtcattgaatctgcaagcaaatgatctggtcccctccatggggcacctcaggaagcagccgtcataaggccttgtcctcttgaaggcctcactgaggcgcttctccagcccatcactcagcatgtctgtgagcagagctgtgtgtaggcaccaggtgccgggatccagtggggaacctgaaagacccccctctgcctccatggagctcagcccttcctacctcaggttttcagtccacagaagacaagcaacaggaaactaggtgctagcaaacccacagtgtcagccacactggctgcagatgtcactgctggtgtgagggaggagagcaccccagcaccatgcagctccgtgcagctaccttccaaagctgctgctacgtcttgcttccccacctgtggcccatgctggagctttcccagtcatcttcaggtgtaacccaatccagtccaagctagtatcacaatttcactctcattcaatttaaagctccccagttccccgactttcactggaagcctctgatggggaaaagagaacagggtcagtttcctcccttgccatggggtacccacactgcactgccagctgcctctggggtctccatgggggggtggtggggcacaggccgtgactgtaaaggggagaaacatctcattgccctggtactgttgtaactggtgacagtgaatgcacacaggtcagccctttctctccctggcacctgggcaggttttttggtgaccctgcccccctggagtccctgaccactccgttccctacagccttccacttccaacctctcccgttgcacccaatagtctgctccactcagcttctcctaggggctcctctctccctgtcaggctattctcatggacagaattaccaggcagctcttcctggctaccttccacggcccccacttggttcccagggaagattttggtgccagttcttggacatagcaggtaggaactcggaccaaaacccaggtgtccccctccaaggttggaggcttagctgtcctctgatagatgctgtattctggagtgccaggcaagggagcatttgaaaaaggctctgctcccctttaaatggaacctctggtggaggaaggtgtgtagggcgagaggggaggtgatgaggtgactcatttcttccagcctggccccagctgagggaaggtgtttctggtcggggaggtggcaggcaggcggggagggctcggggagctgctgcttgctgaactgcccctgggtgacaggccctgagtgtggggctttgcagagaggcaaagtaatgggaagttaacagccaagatcgtggcttgggatatctgggttatatcccagctgcacccggcaggtccctgggcagattgggtaacctctctgggttaccttttcctcatccataaaatggtagtcatcacccctagcccagtatctgccttgtggtgagccctgatcttgagtccactgttctcacctatgcgcacgatttcacttgcttctcgggtcacctctaggcggtgagaactattaggcccattttcacagggaaggaaacaggctgagaagggccagggtcacgggaggtgtgaacccacatctagtcagtcagacccttcccagcctctcaaacaggcccgagtaccctctctgacctgtggcctacactaacaggactgtgccctagaggggcgggctgtcagggcccgaaagggggttagcctcctgcccccactttcccaatgaggaaaccaggtcctgagaagtaaagtggcttgcttcaggccctggtgtctgtggtctcgcccctgcagccaccaagagttatgggcgtgaaaagggggaagtggcggtagttacagagggtgcttctccactcaagccgtgggggtgtggagggccctggccggctcacaggcctgggccgtggctcacaccaacacccaccagagaatgaagccagtaggctgtccctgacagaacagggcacccaggccttggccacactgcctcaaggcagaggcaggaatatgtttcctcccaagagcctcctcctggagttctgggatgccgcctgaggccgatggccacacaccatggacggcgagggctgggtcccacatctggctcaagtgagcctcccagaggaagagactgtgcccgctccccacctggcacccctaatccaggacgggttatcctgggtgccacatggctgggccgtgaccactggctgttcatgggttacccagagccgcactcctctgacccagcctgggccccaggctagcctctgtgaatccacagtaactgaattatagcccaaaatacagctttgatttgaggtggagataatttgagtaatcattttcaagagttattttttcaaatcatgtttggatgttccaaaatagaaaatggttcctgggctgtctactaaatggctgatgtaggtatatggctttggggacaggttgacctgcattcagatcccaaactctgccctttacccattgagtggctttgggcagtctctttccctgtttgggcctcctgtccccatcttcgcctcccgagatctgtgttgtggtcaggaagataacgctatgatacccttggtgcagtgtgtgccaggtagacttgataaatagagatttcacaaagggcagggccacaggcagcattcggatgacagaggttggacaggatgaggggagatggaggtaagaggagtgggggacaactagggtaggtcccctgggggtgatgctgatgctgggtcttgggtggcagacccacatgactgattaagttacaggatgattggttcattcatttcctaaacacatcctgagcctgactgtcccagctcagagcacggagtcagacccatgccctcgaggaagtggcaggggtgggggtgaaggaggagggcgcgggctgggggaaggggtgcagggctgggaggcatcgtgagcagcccctggagagtcaggcacttcctcggaacatcccagtccttgtgacagtagctcactcggccacagcccctgccagcagcccaaagctctgagcgggggactgggcgggatcctggagcctgcagcctctggggacttgagcacggcggtcacagcctgcagggcctctcgctgctttctgactcctcccgaatggccagcgtaggttcggtttgcttctctttccactctgggggcctccataaggacaggagaagggttcccttggcgtcagggctgggtgtggggctgggctccaggtggcctctccagaggtatcaggaaggaatgacaggtcccctgagagtccggattcttgtcctgactctgcagcgtcaagcaagccatttccttctctggcctcagtttcctgaggagtgagggaagccgcacaaggtggttcccagttctcagggcgggggggtctgtggcattctgacatgaatgctggtgtccctccgggcaggtgcaggaggctgaggccccagatttgtttttcttcccagccgccaggagctctgacctgagggtctggagtgagggcagaggctgaggggtgggaaggggagggctgctggctgcaagcagctgcccaccaaaaccacagaaatggaagcctggtccaagctaacccagtgatgtcaacctggacatgggggtgggcgcctgcctctgaggctggggggacagcttctggccttccaggctagacacgctgcttgttgctctgtggacagctgagcctggaccaggccctcctcaggaatttctagggatgcttatggagggggtaggagcttggggtcctaagtgtcctacaggccaggagagtccacctgctgagggtgggctggagtttgtggggagggggggcactgttggggcaatttatgccattgctacccctacttcagattcttcttagaccttggagaataccttctccttccagcacctgactcaaatgcctcttcctgcagagagctctcctggatttcgactccatccctgttcccctcacacccctaaggtggcatttgaggggagacatgggtcaggggaaggagtaccaggctttacctgagtcatgtgtgtgcgaccctggagtgtgcgtgaccttggagactgtaatgtgtgtggtcaggggagctgggacttcttcctccagtctctgaggctttaggggtcctcagggatagaaaggaagacagactaggtgcggaatgtcaggcctgccttggtgcagttggtgacaaaaatcctgtctccccagcacctctcaagctcccctggagtaagcctgcgtgcagtgcctgggagagctcagggggttgtggcggggatcctggccccgggacccactccccaagcctgggaatgtcctgggagacctctgttccttcatagtccttaaagactacctccctcccccaacttctcacacccagcttcccacaccagcagctcagacacacacctggaatccactgcacagtgagaaaggagaattgggttggccaggaacaacagccagggcaagcagggcaagtgccaggcagcagagggtagctgtccctggagagttctctgaggctccccaccccaccccagtccagaggtgaatgtagggtgtgcttgcgcatgctctgacctggactgaagtcaccctccatgcccacctccctggatctccgtgagggggggtttcctgagcccacagagagcccagcgcagcatctggcacatggctggtgcccaagaaaccgcaattgctgtgatggtcatggagactgcacagtgctgaggtgaagggcagggaccccagccagacagcctggggttcaaggccaggccagccactttccagctgggccgctctggatacgatcacatgtcaccctcctacacctcggtttccccacttagctgagatagggatattggaagggtggcactgtgagtgagtgaatttcaggcctggctgtcatcagggggacttaagggtggctcttcccatctgctatctcatgctgatgtgtgtcctgtcctgtgagctctccagatgccaggcccggcacccccggccctgtcagctgggtggggctcacttatgtacctgtcacctctgcagatgtgaggggacctcctgtgtgcctgtgtaaagccaggtctggagtcccaagagcttgccctgagcaggggagatggaggcaggagggaggctgttcccagagatggtgggagggtccccacagggctgtgctcagtgtcgcctggtcgtggccctcatgtgtccttctgtcctgtgtcacagtgcagggacttcacagcccacacgggctacgaggtgctgctgcagcggcttctggatggcaggaagatgtgcaaagacatggaggagctactgaggcagaggtgagctgctgggcaggccatggggagcgcaggcaggaagcaggtggcttccgctcggctcctgggacagtggacgaggcccccatcccagccaaactctgtcagaacacgccctgctttaaaaaactcttctgtgttccctcaaacctgggcctcccccagaggtggcaagtcactgatgatctttcaaatgcccttttttttgcagggcccaggcggaggagcggtacgggaaggagctggtgcagatcgcacggaaggcaggtggccagacggagatcaagtaagatctcccgggccctggggctcactcctctcctctgctggcagtttctgggcctttagatgaggtttaggtcttcctggcatgggggaggctgggcagaaccagggtaggtctggattgctccttggtgcctggttattgggcattcagggtgaggccaggttctgtgagggaggaagcccgagggtctgagttctggaaagggtctgggcaggggagacaggaggccatccatcctcagtcatttgcagcgcagtctgcaccagcctgggtggcctccactgaagtcctgaggggcaggtgacaggcgtctccactggtggctcaagtcccctgcagcactggctcagcatgggcttcaaggatggagatgtagccagagacaggggtccaggaggggacacacctgggttccggtgtcagctcctcaccccccagctgtctgaccatgggctggctgctgacacactctgtggctccgtttcctcatcagtgatgggaaagtaacgcagccctcctcaaaggaagaagtgggcccatgggcttagctgaggcctggttagagggcaggccgtcagggaagtggctctgatgaagcgggagtctccagccccacaggtctctgcacgcagactgctggggtgggaggccaggtgaggagatgaaggtgagttcaggacacagccaccctaacagtggagtggaggggctgctctgggaaggcccagactgtccccctgggtgaggacagagccaggccaaggggcagacagaccaccggcctccaacttcttgaaagggctctgcagagtcctcctgccgaggggccctgagcctgaccctgcagctgctgtggaaccccttcccttcctgccttctcccccgagagaggaactgaatgtgccatactctgaaggtcccccaaagacaccaggcaccctggcggctcctgcttccaaccaggagccagagatcacaggaaggcttagatgtggcatgagccgtgtgtgaggccagaaagttgcacacagccctgggaggacggagggctctgaggagcccttggagctctggtcccggctcggccaatctgagctgtgggactgtgggccagtcgcctagcctctccaagtttgtttctcacctcccactccagcgagctgccgtgcaaatcaacaagaacatggtctgagggcctcccaagggaagggctgagggccgggtgcaggctgggcacagaggagggctcaggacatggtgaggagtgaatggacgtatgcagggaggtgttttctgcaggaagcagtgcccagagctctcagccaggggaggagcagctgtgggggcctggcagcatgaccaggggagcccctcctggtctcctggcctcccagcctccaggccagctggaagagaactttcccagaaagagagggtacctcatggggagaactcagagactcaggagaggtggagagggtggccccagcagggcacaatgggagccaggctggagtgggtctgtgtgatgcaggctcaggggattgtgagtcacaggggatttacagcagggaaagagaagctacccacagaaaatacaatgggggtggggagcagggtgggcctcaggaagcaggaggtacgcaacatcttgctccatttgtagaactaggaaggggccaggtggaggctctgggcggccctgattgcgccatggttattcaaggccaggtggggcagggtctgccctgacttatcctttgtgtggccctggatggtcctccctgtctctgagtccagggtctgtacctatggaaggggatggtcacttggagaggtgttctgggcagtcacaaggacaagcagagagtgccaagccacaggggttcactgcacacagtggggctccatagtgttgctcttgacccatgtggcatgaagtactgttgatgaggccatgcagctgttcctttcggtgtaggccaagcatccatcctccatccatttagtcaccatttaattgaggacctactatgtgccatgccctggatgggtcaggaggattcactaatttaaaataaaataaagggctttgccattccttagccagagtccagcacagtgagggtgacttccttctccttcctagtcctttgcattagggcccatttatgcgccacctcctccaggaagccctcccagacaccttgccttgccttactgtcagagtcttggcttagacccaattacccctccccatgccaacctgaagggcttttggtggggaagtgtgagcagtggccgtggacctgtttcctcatcttagactcctgtggggggggggggtgtgtgtgttggccctcaggaaaggtgacccggctcttcaacatcggggctggtggcccaccctccagggcccatccctgagtaggggaagcccctggcctccctgaggcccacagctgccccccaggtctatgggatgctcattccctgccccttgcagaacgggcaggggactgggggatgggaaggctaggaacagggtgcagaacgaggacaaaagccaggtggttaagtgaccctataaatagcctagtgagccctgagggcagaactgctgcctgaaggtactgcatttctgcagtcccctgacctcaaaccagccgggagccaccctcaggcctggaggctcgggccactgaaattaacaggaggttacatcttaagtgatttttgacatgtacctccttcacatgttaactcagcaaacatccgtggggcagtggcaatggaggatggacaagtaagacccagtccccaaactccagggatccccaccagcgctttcagtgcattttaaagacagcattagggccaggcgccgtgcctcacgcctataatcccatcactttgggaggctgacctgaggtcaggagttcgagaccagcctggccaacatggtgaaaccccgtctctatcaacaatataaaaattagttgggcatggtgacgcgagcctgcagtcccagctactcaggaggctgaagcaggagaatcacttgaacctgggagacggaggttgcagtgagcccagattgcaccactgcactccagcctgggctgcagagcgagactccatcttaaaaaaaaagatagtgttagtatttgcagggggcttaccaacattgctgacatcacatgtccagccctgcagagactttgcctgactctcctttccagcctctgggcctttgctcctgctgttgccctgttgctcccctgcccagtcccacccatccctcaaggcctgcctgaaatgtcacctccctcagaaagctgtcacctccactcccctattgctcatcctgcgtcaggtaaggtgctgggggtgctgcatgcccccagaagctgcacagggcaggggtttgggaaacaaaggaaaaccaaggcaaggccagcttcctgtagcccctctgtggttaccagtgggcaggtacagcccccaaggggtgcaagtttgaatcctcacgtccctgcctcacccccagttgtcacaaaccaaaaatgctgtggttttcctgtcagagagatttttaaaatttttttcatggtctctcttcctctgaactcagagagaatgacgacattgctgaggatattggcgggagagagccaggccctgttcctgtcagatgtcccctgacgctggctcatcgtgggcacagcctcagcacagggagccgagagggctactcctgtcagctggtgggcaggcagcagggacacagtggggtcagagcaggaaacacactggaaatctggactgtatttgagcacagaatttcagactgagcttcctgagagccgagtcaaaaagggcaatgggatgagttacacatgaaggcactggtgacagatggcagtaggcagaggcctgtgcaggaccctgtcttcaacatgcgatggagacacagtagaggtgctcagggagatcttgacagtttccctgcacagacggtgggaggaagcaggaatttcatggggcagagaatgactttatgtggcccccagatcctccccaagatcagagctcaaggctgttcactttgggggttctggggcaaagctgggctcctcctctcatccacagagctgaggctgcctccttgaaatttcatctggggccaagaaagggaggagtgttctgggccttgttgtgtgagctgaactagggtggcctgatggttccagcaacggggacaggggacctggggcaggaaggcctgcagcccaggggacaggaagaggggcctggaggggccaaagcctgcctgcccaggtaccccagacagaggtagcaccagtatctatgcagtacccaaggcctagccaggtcatggggacaaatgggagttcaaggtgagcacagaccatcactgtcaagactgtcccaggggtgggacagaggctgaatgtccacctggcagtgctgtacgttcaggcaggctcccagctttcaggtgggggctgggaaaagggccagcagctcccagaacctgcgattccttacagcacccctcagcctgagaccatgaaccggggtggcccacaggtgggtttggggttgagaaaatttagattatgagcctggggacaatgaggaggagagccaggcattgcccctgtcctcaagggctcatggttcagctgcgtgacagacatccgctgggccagcccaaagtgacatcagtgctcagaaaggacaaaagaggatgccaggcaaagatgcagcaatggagatgggcacgtgcaaaggccctgaggcaagatggagcctggcacctggaagcaacgggcggaggggcagagagcagggctgacaggtgggaggtggaggtggtgcggcaggggctgcagcggtggtggcagctagcgtaggacagtcacgagatttaggagataaaatagaaggtggcggcaaggaagggagaggacagagcctggtgtgactcctgggtttctggtgtgtatagctggtggacagtggtgtctttgccaagaggggagccctggaagaggagaggtttgcagggcaggtgctgagtccggttttggacacgctgaatttgaggtatctgtcagatatgagacccaaaaggtgagggcggggaagtggatgtgcaggccctgagctctgggaggggtctgggtatgctgtggtcatgaaggaggcggggctggagggtggtgtgcgtaagggctgggttgggggtgcggggaccacgctgtgcctggaggcctctaactgaatgagtgggactgagctgaggggtgaactgacaggaagcagagggattggaggtgccactgctggtgaggagtcagagaagagtcctgagccccacaagggaaggtggggtcaccacacagccacccctctccttcttcctctccctggttccgcctcttaccgcagggtggccacgggcgcagctccttcactcctctgacccttggcttctcatctgtgaaatgggataataaaggcacctgtgctggcagagttgtgagcagttctgacgtctggatgggcatcagcagcgcttggggccgggccccaccccgaagcctcagcctcaggaggtcggggaggagcctgagaatctgtatttctaacaggctccgcggatgctgatgccgctggtctgtggacctcactttgggatccacgagtttagggcgaggggcctggcccccaccgatctcccccaggcctggatccccaggctcctgccaggctactgctcctccttggcctctgcttccccaggtgtctactgagaggagaagccccctgagaagcctgcctggtgcgctgccccctccacccagggctgtccggtgggcgtcatgaggccatatggccgccagggggcagccgagctgctccacagagaggctgcagggagagccagataaaatactggatgcccaggtgaacgtgaatttcagataaacaacaaatactttaaaaataaaagtccgttttaaatactacaaggggcatactatactcaaaaagtgctcgttcatctgagattcacattgcactgggtgtcctgtttttatgtgttcattctggcagcccccgcccatcattccctgcctcctatgcgcagtgctgggcccttccctccctccctccctccctccctccctggcagacagtgcccacctctcaactcctgcgccctgccctgctagcctctcccacggccatccaacctcctccaaacatcccccgggccacctgctgagagcccatctgaacactgtcccctcccctgtagcctcaccctggggccatttggtacctgccgaggagagagggctgtgaatgtgggagaggagttcaggggagggagggagggtcctgaagacaatcccctcttctctaagaatgcagctaggagcacagatggtgggggccttcggtacctcctccttctgccacattgcagagggttgattgctttaatttgcagagagctttgtcttccagaaatcagtctggggccccagtggatggtcaccatctggctaaagggtcccttggttctagagtgacccagggtcttcccaccaaaataaaagtcctccccactgcccaccccgccgggaggcagcctggactgtaggttcccgctgtgctctcctcctcctgacctggacccatctgttttgcagctccctgagggcctcctttgactccttgaagcagcgtaagtcccctaccctggggcaatgggatcttttgggactgcgaggctggtggagggtttggggggacagaagatgaggtgttggggctggggctgggctggcccacacgggtgagttgtgggtggctgaggcccatcagatctgacactggggaccagtatccatgctctgcccccagaaatggagaatgtgggcagctcacacatccagctggccctgaccctgcgtgaggagctgcggagtctcgaggagtttcgtgagaggcagaaggagcagaggaagaaggtgaggcaggtgcagggggcgggggagctgctcccccattgccagcctctcagttgctgtgggggtagggggctgaccttcctggtagagccagtggagggcggcaggggtggtggtgggacagcactccaggctttggggcttgagggtgatctgaagtgggtagggagggcagaggcctggccgctggcactaaggccaactcttagtcccagagccccatggaaggtccttcctgtcgagctgcctcacgcctaggaggatcctactacagcagactctagagggtctgtggcaacttggcagtgtccagaggaggcagtctgagttgtgggggtcactggaaactggtcttgagtccaaggatcagggctgattgtcctggaaaaaggcagacttgcagccagtcaccccacaggactgcccaaggctgaggggtcagacacagactggggtgggagagttgtatggcattgcttagcatccaaaggtacttctcacccatatgtagggcatggctgtcccgagacagagtgactgcatggaagtgaagtccccatcatgggaggtgtgtaagcagaggctggcagatgcttgtcagggaggctgcagggctgaagttggatataggttccctggagggcaggcaggacgcagactggcctggaggctgggcttgggcctgtgaggatgggggctgagcctctcagggccttagtgatgagggtggtgccctgcacagggtggcagggcagcacacagatccgcttcttgcctggggaggaaggatcgttgtgaagtggccaaagaattgaaaatgaaaagtcacaactgagccttgaaggggaagaagctgtacctgaggctggggccaggctaggcctgggtgtcctggccataccacttcccatctctgtgcctcagtttccctctcacaggatgggacacatatgtctacctcccaagtgctgggagctcagcccaagccatgcgcccctcagtctccacagacagggctccagctctggttagcagctctgctggcagaaatgtagcgtggctgcccgtgccacctgcccatctgccagctgggctttcaggattctaaatgtggggttctgagcagacagggggtccccagaagccagcccaggcttgaggtgccggagcaggcaccctctctgagctgggacgtgcccgcagagcctgcagagaacctgccaggaaggagggaccccggccctgctattttgggccctcctgtggccagaggagctgcactggctgcaaaggctgttttggacagagcattctttctccaagtggccagggccccgcaggcagagcgctgtgttgtagtgtgtgccatgtgtgtctgagcctgtgtgtgtatgtgcgtgtgccacagagcaaggacatgtgcttacaggatggtgcacacgtgcctacgctcccctgcatatgcctgtgagcatgtgtccttgtccagccctgtgcacttgggtgttttgtgctgtgtgtgtgtgagtgcctgtgcctcgctggtctcccagctggcacagaacccctcccctgagaccccaggcacaaactggctcagttctcctcctacctcataacccagtcgctgtcctggctgttttgccttctctatcagaacaggaagcctgggaggtgaggggaggctttggccccagacctcggcacaggggcccagtggccactgtgcctgcatgtggcctgtggttgtgtgtgggtgactgtgggagtgtgtacttgtgagtggcatctgtgggtgtgcacaggaatgcctgtgatcatgcgtgtgggcagctagggatggggcctgtgtgcctccgagttaatgtggaactctgcatgtatgtgtgtgccagagtgtacacacacgtgtgagcgactgtgatgcctgcagaggctcagggatgcaggatgaacgactgtgtgcgcacgtgtgttggggtgggaactccccagctggagacgaagctctggccaaggtctgcagcaaggacctcacggcacacccatgccctgtgattctctgtggccttccattgtgagggtcactgtgaagcagcaggctctgggggagggagggcagcctgtcaccctctctccagagccaggagaggtgctgcgcctcatcccagggacactccgtcctcttggcctaggggagcctcccgaggccgcggccctcggctcagaacctcgtgtcccctgcagtatgaggccgtcatggaccgggtccagaagagcaagctgtcgctctacaagaaggccatggaggtgagcgccagggcctggggccgcggccttccctcgaggagcagcgcaggtctcagggtgcgatcctgggctgtggccccgggcagggcatttggaacaggctgacctcagccttggtcctcggacctcggccttgggcgcaccagcctgcggggcgcttgggcccgtgctgggcgctatggccccgtggggatggtcccgggcccttcccttgtggggctcgtgaatgaagggcagatgaagtcagctggggactccaggggtggagggaggagggacccctgagcttgatcctgcgagacgctggacaggaagggagaggggctcctaagagggcgcggcgtggcgaggggcgtggcgaggggcgtgccctcgccgaagagcacagcccaggaggcggggcccggggcaggccgcgctgtcctcagtggggagggcctgagagcaggactaccagcagcccccacgccttctctatctccttccggacccccagatccctgtccctggtgaggatgcccccactccacccgcaaccctcgccagggaaaaagggaggctgggctaagggagcctcactcccggggaccacagaacagggctgtgcagcccccaagtcacgcccctccacacccccagtccaagaagacatacgagcagaagtgccgggacgcggacgacgcggagcaggccttcgagcgcattagcgccaacggccaccagaagcaggtggagaaggtgcgctgggctgctgggccgtgtgggtcgcccagggctgggggcagtgggggaggcaaggaaggggtgccgtagacacccccaggcaagatctgcatctggggatgctgcttagccctctctgacccccaatctccccatctgtgaaatgggtttcctggagagaacctcaggccatggacaggcaggtcagctggatcccctttgccaccgtcaggcggcactcagggacccattcctcggtgcaggcccactgaggcccacagggtgatgagagcagacgccaaccctcacacaaccttggagaagggctcagtaggcccatgtcacagagaggaaactgaggctcacagtaagtgacttgtctaaggtctcagagccaggaagcagcagaaaagggacccccaactcaggtggtctagagcccatgctcctgatgctgtggcccctaggccagagtgggggtatcagagctcccagagcccaggaaacacatcactcattgcacagacaggaaggctgaggcccagagagggaagtggcctgagggtgagctgggggcagtcagtcaggggccagagcccaagtcccagccagggggctcagcagtagttgcacctctcctgtgggttgtggtctcactcttcacaggcatcctcctgggctcggttcctgtcttcgttctctttccatggagctagcctgtggtcctctgtgggcggaggttgcttgtggatgatggcatctgcccatagttggctcctgaatgttccccccagggtggccggggaagcttgacagtcacttcaggtctgctggggtgggccctggctcctggggcaggggcttagcgctgcttcccctctgtttcctcagagtcagaacaaagccaggcagtgcaaggactcggccaccgaggcaggtatgtgggcctggctgccccgtccgaccagggcggaggcctgggcggtactccccacacacacctcctcaccctggggacacacacactccccctggctgcacaatcatgggcgcggcgctctcattccagatatgtgccgtcaaagtaaacgctgtgttcccccattcgccagcccttcttggcgcttcatgtgttcagtcctcacagctgccctccgaggtggctgctgttactgttccctttcttaacagatgaggaaacagaggcactaaaaggtccagtacttgccccaggttacagctgcatttgaacccaggccatcgggcttcagagcccaggacttgtgcacatagccttctctgggcctctgtccttcacttgatgcccgaatcctaccaacactcttgtccctgctggtgccccacccaccagacacagcacccaccctcctcccttcccctgggaaggcctctcccttctgctctgcctttactgggactcagctactccctcggctgggggacaggtgacctccagagatctgggcacagaagttgtgacccaagcctgtgggactccacccctcctccagcgccctctcagctgccttctctgaacctcagtttcccctctggaaagtgaggtggggcgcccagagatgcccagaggccaatactctggacttgcatatatgaggctccactccagccctcaggcagctcagagcacagttggggagcagcagcagcaccagcgtgggtggccctgacgggcattcagatgaggccccgccatctgctagggcaggtcccatgggggaggcggggctcccagtgggaggaggcatccaggatgggacctgctggagtacaggggtggaggagctcgtgtcagggccctccctgaggctgcctgcgctttcagagcgggtatacaggcagagcattgcgcagctggagaaggtccgggctgagtgggagcaggagcaccggaccacctgtgaggtgagtggcccacgtggagcctcgttttccccagctgggaagtgtgagacgcccatccctactccagctgcttaaaggggcccaagtgaggcagttggggaaggtacctgttactcactcgtttattcagcctcctgctcacaggcctgtgctgggccctggccctgttgcttgtcgcctggccttgagtcctgggccccttcgttgcaggcaggcattcttccaccctctttgttgaagccaaaactgggacttggactaaacccacagcctctctgggtgctgccgatggacagggcctggggaacagggctcaggactcccgtccgaggtccctctcactacccttctgcctcggtgtggtgcagcctgaagggaggctggggcagggaccccctgggcatctccacctccctccctgcagcctcagggctggcccggagtcgggatggggaccccagggcactctctcctttggactgggcttccagcagagagggctggcctggtcagctccggctgagctgtgaatggggcccagcctggccgggccctgcagccgcctcctcactgctcacctccctcccactgcccccaggcctttcagctgcaagagtttgaccggctgaccattctccgcaacgccctgtgggtgcacagcaaccagctctccatgcagtgtgtcaaggatgatgaggtgggggctgagggccttggtgtggggtaaggtagggcagcctctaggcagcaaagcacccaggtccatctgagccggtcaacaagcacctggtcctctgtgatccaagcctggccccaggggtctcaggcctcagcagctcagcctttgcccccagaaccccaagacaggagctcagtaccacacagggccatggcttctctgcctggaagatgatgactctgtggttcccctgacttcctccttatgcctcagagccacagagcacctgccccctctgccggggatgggaggggaggtggacacagctgtcagaggttggcagaagctggaggaccgtggctgctctgctctaggcctggtgcttgcaggagccgaggcgcagtccttcctctgctccccacatctccagggtgtcctggttccccttactgagcccaacctgctgggtgggtcctccccagcagagagggcccccagccagggtccctgagctctgtggatggatgcagcccagcacacggctctcccgggcagccctggcccccttgcctgctgtgtttcctgcctgacgctcctgtccggggctgtgggggttgattttcttgttgtttttgcccaagtgactcgagccccctgctgcctcctcgcctccttgaggtagaagggcgagctctggacccactctcctagccccaaggcctggctgtgctgcattctcgctgtgaccttgggcaagtcactctcctctgagtttcctcatctatccaatgggaaaagtggggtctaccttagaggacaggtgtgagttaagtcccttgcacagggccttgcacacagaaggtgttcaggaaacaggaagctgtcagccagggccgtgacccctcaggatcaaagaccccgagccgcgcacaatggcctgtgaggaggccggtgggtgggggccgctggtcagagttcaggcccacagaggggcagagtgggcatcgggctgcggcctctgctctttcctgccccagctctacgaggaagtgcggctgacgctggaaggctgcagcatagacgccgacatcgacagtttcatccaggccaagagcacgggcacagagccccccggtgaggtccggcttgcggacagcgcagcctctaggtgcattgagcccctgggaaggcccggccctgagcctcaagtgccaggaccgggctggggtagctcacagctcccttcagggcagagaagccctagcaggggttgtggggagttgggtcccaggcctgctgcctcctctcaggcaaagctaagggcatgatggcactcagaggaagaggtggggatggggattgaggtgaggagctcccacggcccccactccccgcctgtttggttccactggatcacgggtccagaatattaggtcttgatggtacctacggtggggtctctcatgggagcaagacaggcacctcctcaggcaccaggatgggccagggccagattgggaatgtagggccccagctgagtctggcagggccagaatggggtgttgggggccgccctggggctcacggcttgctgtctgcagctccggtgccctaccagaactattacgatcgggaggtcaccccgctgaccagcagccctggcatacagccgtcctgcggcatgataaagaggtgaggccccgacagacggagggagggcctaaggctgggccaggaagtgggtcgagcccctcctctgcacctggcccttcctcgttcactgagcacctactatgtgtctgtatctggtgcccagtttaggtgctgggcactctgtggagacaagataggctcagttcagcctatggaaccctcagcccaagggacccagacactagaataatcacaccccaattattcactaggggaggtgctccgagctctggggaggcccctatgctggcttccttgtccctggggcctcatgtgagcctggtgccctgtcaggctgcagtggcaacgctgtctggctggagcaggactggggcatctggagaattctccaggcttttccagggctccttccccggcctggctgcagtcaagtgccaaggtcctagtgctgggcctcaatgtgtgacctgggcaagtcattcacactctctaaggccagggccctgagtgttggggtcagattcagaatctaaggactctcctggttcaggccttgagtgacgaaggtgacagcccattgggagcactatagccagcttagggagccctcgtagccaggcctttgagggaggccatgtgccctgtgagcatccacaagggtctgtgggtttcacatggtgcctgtgcccccaccgccatgccaccactcttcagccacccttcaaccaagaaggccctgcctctgggaggtagtggactgtggggagaggctgatgcagttcccggcccttcccaaggaccagctcattccagggcctcaggagcccctggaacttcctactcctgggaggcagaggctcgtgggaaccacccgtgcttagagagggcacacacacaccctctttgagaatcttgtgcaagcagtgaccccaggaggcagcacacccgcagcctcacatgctacaaaagcttgtgagacaggcttccctgtgcctggtgaggacctggatcccagcaaaggtggtcatttaagcaactggacaaaagagctcacctgaagcagtatcaggaaggggcagaaaggagtggccccagagaggattagagagagagagagagatgtcctgcagggccgagggaggcctggctgctggagggggctggtcaggcctctggatggggcatctagaagccaggcaggactgggaagaggcgggggtcagtgactgggagtcagaagtgtagacagtctggggaaaagaggtgtgggggcacgcagcacaatggctcagcaagccctgcacccctttccccctgccctggccgcttcctccacctgtccccagcccctgctggcttgcaccctgtcctttgctgcctggggagctggcacgtgtgtctgcccgcctgtgttggtgtcaggccctcccatgtgctgggtccacgcatgtccaccctgcgcatgtgtgtgcactcctggggccttggccctcggcgcctcatgtgggaaaggccccccacatgccaccttgaattgcagggctgccccccacaggcccctgagtcatggctcagcccctcacctgcattcaagatccctcagggtctggtccagtctctatttcagtcctgtcccccacacacccaaattggtccactccactccacaaaccccacctgtgccatgcctcctcccctgcacctgagccctccctctcctggtcacctgcagtgcctcgctcccccttctctcctagtaaagcttcactcatctttgaagactcagccccaccccactaagaagccctcttgccttggaggcagtgtcagcctctacttgttgagccctcactactgcccacttcagggggtgcccccagcatctgccgcatctgcctcttctgttttattttcctttattcagtaaaccttcatgaccccagctcagtccaggcctaagcctggtgcaggggcaggggtaaagtagcccagcgctgtcccggaactcctgtgaacagggtggctgagctggcctgatcaccgtgggcccacagggaggagggctggctcggcccaggcagtggaggcctcagcagggcacgtgagccaggctttgtgtggcagtgcaccccccacccctacccatgggggaagctgctagggcaagctagagcaggggcctggagggtgaggactgggcatcttcccacgaggcctcagtgcggaggtcctagaacccccaaagggccatgggagtcttccaatgaagctacagcttcgggggttctaggatcctcccaagggccctgcagggagcaggtgctgagatggcctgcagagggcgccagtggagggcgtagctggggaaggaggagccaccaggactactttctggggagccctcctgcctgaggggcacctcataaatgacatccatgcctggaggctaggggcagtcccagccctggcagagcgcgtgcagctctgagacctctccctgtctaaaccctccctcctggtgggtccctgagtgtggggcggggacactcaccctctttcctccctgttcccaggttctctggactgctgcacggaagtcccaagaccacttcgttggcagcttctgctggtaaagggggtcaggaggggacccccaaacacactgatcctgggggggaggagaggtctcccacatggcacagatggggccactgaggccctcaagaggaagtgtgtgtcccccaacagcaagtgtggacagcagaaggaagaggcagggcccagcatggagaaaccccattctagtaggacttccaggggccagtgtccccagaaggggaggggtctatgtctcaccctgctcttagcgtccacagagaccctgacccccacccccgagcggaatgagggtgtctacacagccatcgcagtgcaggagatacagggaaacccggcctcaccagcccaggagtaccgggcgctctacgattatacagcgcaggtgaggcctctataccccaaacccacctgtgccacctcccctgcacctgagagctccctctcccatccagtgccttgcgtcctcatctctcctcatggtttcactcatcttcgagcatcctctcctcctcaggagggcacgtgtgcccgagtgtgtccacactagcaagggtacctgggagtgtgcttggatgtgagctctgagaacagcacccagggcttgcggggcctcagtgtgcatgtactgactggaagctggtgtgcagcaggcctgtgtctgcccgggcctgtacacagcacacacgtggagcacatgtacctatgccgtccacacaggctgggcgctgagtggtgcacacgtgcggggagctggcagagcctggagctgcctgcaggtcatagcttgagggccaggctctgtgcctttgggtcagggccctgtccttcgtggccatgggtgtggaaaactgtggccagaatgagtcttgctatcgtgccaggattgattttctgatgtccatagggtgaggatgaaccaaggcagccacagggcagctatgagagtcctttctgctccctgcttgaggggaagaatgcatagccagacctcacatccacctggactgaggccaagcacccccacatagccaggcaggctgggtgtggactccactgatgaggccagggctcggggaggcagggaagccaggccaggagagtgatggggtacttggatggcagtggctagctggggctggggaccgcaaaggggaggcttgtggtaagcttaggcatgagtgtgccctgggcttggggtatgatgagcacccgtgacccctgacatgctccagtcactgcgtctccagaatgggagaggggaggtgaggctgggaagaaacccaggttgggggagaactatgatgacaaactgagggggatgggaggcccggtccgttgggttacccccatcctgtgtccccaaggggctgcccctgcccaccctgggagacatgccgcatttactgctgggtgggggaacgccaggcccctccctgcaggcccttccctgcaggcccttccaacgtcatgcgctttcaatctcttggccagaacccagatgagctggacctgtccgcgggagacatcctggaggtgatcctggaaggggaggatggctggtggactgtggagaggaacgggcagcgtggcttcgtccctggttcctacctggagaagctttgaggaagggccaggagccccttcggacctgccctgccagtggagccagcagtgcccccagcactgtccccaccttgctagggcccagaaccaagcgtcccccagccccgagagggagcctgtcgtctcccagggaataaaggagtgcgttctgttc

SEQ ID NO: 345 - DNA, 1694209 bp, Homo sapiens
tccggctctcctttgtttattttctaatctatatttttactggaagatttcctctttattctctcccgccctcctacaagcgctcttgctggccgtctgggtgcacacaccgctccctcgatcaccccagcccccttcctggtctcccgagcgcggggtttgaaggtcacctcctttccagtccccgtgcgagccgcgctgccgccgcctcctccagccagagtcggtgggactggctgcgctgccctgaagtggttctccaagcagcgcggagggtggcggacggcggacggagcccaggggccgcgtcgggtggggaaacccgaactcgcggaggggaatccctccccctccgccccagccccccagcagcacccgcggtggggcgggggcgctctgccagccccgggaacagcagaggcggcggcactggctggacccacgcgcgcgcctccggggctgaagaaggaaggagtgagccgagccgagcaccccacatctggaggggacagccagccgtgggccccgccccggcgtccggagcaggagaactccgagcttcttgcccaggcagagagagcaggagcggaccgcgcgcccgggattgagagtccttgcgctccagacccccacccagtggccgccagggtccccgcctgtccggaccctcgccgcgcccaggcaggcgcgccagggcggggctgacctgcccgcgaagttgcggacagtgcgtgagaaaccagcacccccttccgccgcctccagcttatggtgagtgtggctgggggtgcagagagcgcacgggaattcgggggtctggggccgagaacgtgaccgcagccgggctcgccgggagttctaggtaagtccaggcggagtcattgcctctgcacccaccctgacctggtgggtcaggtccagaaggtctcatggagggaagcgctaggtccccgagaactggcctcctcctagcgccagtctgggcgctctggacgggaactttttcagggtgtgtggaaagatctcgaggcgtgtccccccctacccccaggaggccgagaccctgagcccccttgtgcgtcgcttccagaagcacgtccttccttgccccagagcgcccctccgaagcatccaggctacctcgtccgtcctcctgggagcgagtcctaggtgccaggagcagcgggagcctgcctgcgcactttgattagtctccctggccggctgcaagcgtgcactcagcgcgcccccggaccgctgcctccgcccgcagggtgtgcaggaggaggcatcttagtgacccgggagggtgtttaggtgccccgaaccccttgtgggaggaggggaagagaaggctcacttatgtggagaaagcgccgctgtgtttactggcactggaatcgatgccccgcggtgccacctcgaccccaggggagggggccagccgggaaacctgcgaatgggaaactcctactgtgcccctggttcctgggagccttagagaaccttcaccccagagaaggaaacacaggggtagcagatcttagccctgtgttgttgtgcaggccaggggggggcttgtcagctccaatcaaccaattgtccagctatggaagcgagggcggggctagtggggcgccgctcccatctccccaccgcccaggaggccacttggctgtgagctcctggagcctccctggcgccagctgcggggaccaggtgtcacgcggagcccggaagctgtccactcagcaagggaggggaagaccccgatctaaccttgtcctggagcccccagctccattccttgctgccagggaatggtcagggggctgggagagctcatcgctcctgtgtgggccagagctggggtgcacctgctggcactggaacatctggggtgcggctactgaagagcttggaaatcctggtcaggcagtccgggcaattggcaccccaaaggcggatcttttcagttgaacttgaaaagaagtgggggagtgtggtgaaatagctttgttgagttgaaacatcatgtctcctaacttgggttttcctttattagaataatgattgtttatttttatttttaaactccgttgtgcagagaggcctggccttgacagcccaagtttaggacatgccccagcctgccatcccttccctgccccctgtcctagttcatctcccctccatttatcattttatctttgttacaaaagagagaaaaaaaagatgagagggcctggattctttcaatttttaagtgaccacagaggccccggctggagctactggcagatttatttttagctaagatcttttatgttcagaagcaaaggacctggggcctgtgaagggtaaaggtggtgctggcagtggctgtgctggtaaaaagtggggctgactcaaaacctgtgtcctctttgagctcgtcagggaggccctccgtttggaagaatcccctgggctttccttaagttagcttatggttgcctcgggttaggaagaaaagtcatcattcctcgcggtagtggaagtgacaccttaggggtccagagagtggagctttatggctcagaagagcacagggcttctggatccgttatctgccagctgtgtgaccttgggcaagttgctttacctctctgagcttcgggttgtcacctgtaaaatcagagtttcagtcgtagttctgtcctcagagggtttgggggtaaattacttaaagcactaaacatttagaacagtttggcacatggtaagtgcctgaattctatgagttttgtttctttattctttcaagtagattcctctaatttttgagccttgtagcaccgagtggtacaggaaaggcaggtggcttgccttatacacacacgttttcttttaagtaaggaacagaagcctcaagctctcccattctgctctctgcatgttccaaggaggatcacggacaagctgcccacccactggccaagatataggttggtggcatttgacttgctgtcttgacaagcacctgaaattaagtttttgcagcagttgtacatttcttctgacccactgaaaggacttgatctccttggccccctgggatgaaagtattaccttagcaaatctgtttttttttttttaattagaacatcatttatttaatacatagaatattttgaaaacacaagaatcgaagaatattagaagtggctttatcattcctcctgggattcacacattgcaattagtatgtttagatataaaattttgtggccaggtgcagtggctcatgcctgtaatcccatcactctgggaggctgaggtgggcgtattgcttgagtccaggagttcaagaccagcctggacaacttagcaaaaccctgtctgtactaaaaatacaaacaattagatgggtgtggtggtgcacacatgtaatcccagctaccctggaggctgaagtgggagaatcacctgagcctgagaaggttgaggctgcagtgagccgatatcacgccactgcactccagcctgggtgaccagaatgagaccctgcctcaaaaacaaaacaaaacaaacaaacaaacaaaaaacaatttgtgatagtatctaaacaatttgtgatagtatttaattgtataaacatataaacatctgtggcacacatttgcccataaatgaactgaatgcacaaataccttgatccagtttttagaaagaattttagttttgttgtggcaagaacacaacatgggctgtaccctgtgaaaagatttctaagtatatcatacatgactgttttaaggatagtattgtataggagatgtcaaggagttatttacctttactgcatgagggattcggggatctaaaatcgtcaaactcatagaagcagagagtagaaggttgtggccagggtctcaggggccagggaaatgaggatttgctgatctaatcaacaggtataaagtttcagtaatgttgtaataaatcttgctgtccgtagaacgtacagttttttacatcaccctgaagctacagagttttccactcagaaatgaagctgaaacatgggtctgagcgggtttctcctcctggaattgacccactctgccctatttttcttctcattataattgaagctatatatatatatatatatagaacctgctcctgtaaggtttgagcacaggtcttctagacatcctcatgtctctgatgattttagaaaaaaattaagcttagtccttttagctcgaaccatcccaagctattatattttatcaaagtcctttctgatagtacatattttttgtatccagaaaattgggtctgccctgtataggaatctgacatttcacctttccaaaaattagaccatttcgtttgcatcctttaagctgatgtgtggagtaatgaacacattccaagagggaaatcgtatttgacacagaaaatactttggagacgcagcgatttcccagtggcgtgtaaggagactattgaaatcctagcacgtttgctctgaaggacagagggcagctcgtcctgcctttgccacccagcatgggagttacacagtaagcatcatccacaaattaatactggctgactttcctaaaatcatcctttaatctgtcgctttcacatttacccacagtgtcgtgccggagacctcaaacaccgaggcgacgtttttaaagaagccacgaggctcttcccaatgtctacctccattatttaaaatactgcctcgaggcacaggtataaatattaaaactttaattaaagaatcaatcagtgatggagcttcaaaacaaggggatctagcactttcagatgatgtcaactgtgaacacagttagactcggtcgtagggctaggagtttttatgaaaaatgacgcgtggagttatatacacaggcaactgtcctcattttttgaatctgtagtcattgtgagcactgtcactcattaccactggtttgtcattgttcgctagtcaaagagacatgggtgactgtggcctgctgctacagaagagtgtgttgtcttaggggaaggagtggctaatgcaagaaatatttatttggaatgtaccacatgttagaccctgtgcttggtgaataaggcagacgagaactttcctttcttgtagcttatattgtcgtgggggaagccgcgtcataagcaagacgttgaaatatattttcataaggataatgaaaagggttccaaaaattatagtgtgatagtgacttggggggacattccagagaggagagatttgacctgagaagtacatgaaaagaagtagctgatctgtatggatccatacatttatccaatgagtattctactcatctccgctttcttttttttgaaacagagcctcacgttgtatcccaggctgtagtacagtggtgtgatctcatctcactgccacctccacctcctgggtacaagtgattattatgcttcagcctcctgagtagctgggattacaggtgtgctctgccacgcctggctagtgtttgtatttttagtagggatggagtttccccatgactggtcttaaacgcctgacctcaagtgatccacccgcctcctcggcctctcaaagtgctaggattacaggcgtgagccaccacgcccagcctcattcacccctactttctatgaattcctgagtgttcatcaggcacccactgtgtgccaagcactattgaaagcacttcaagtgcagagtgatcaatacatgcagataccttgtcctaaaagacttccgttctaggatagttgtctgcatggagggcgtttcagagaaggggaccaacaagcacaacgatccagaggctggaatagtgacaaaatcatacagttgaaggttggtcctataggcccttgtggcctgggaagggaccctggctgttattctaatgggaaaccattgggggattttatgcagagagataccaggatatatttatgtcttaaacattatgggaaaattgttaggtgtttttgagatgagtgaataaacaagcatgccttcctggccggccggctctattttttcaaagtttcaattcatttctatgaccagatttggtctgtggacgtagtgacatctgaaaaggtaagccttgcaacgtctgagaaattaaactcgattccccaccaccacctacttcgtagggcttacactaaaatctttcattcaagaagagggattactttatagggaaaaagaacctcattttccagtaatgttctttgtgtgagggtggaagaccctgggaggatacatctgtatacattagcctacttagattttctttctctggggcctcccttcaaagaggcaacatcatgtgttcttgtgtgcctgcatgagcagccgcaccctcccaccaccacatccttttgatggcttgactgacaagtctcctgggagtaccctgagaacagttgcactcagatgccctttattgatcgtctgtccgggtaggttccctttcagagtatggccacagattctcccattggtaggtgtgggccagggtaataacagatattgacagtgcaaagtgggttgcttatggagagctctgagtgcagccgacgttgtccatcttcagaggctaccctgcccttagaaggttgaggtgcaatttgttggagggtttggacacctggacaattcagttttcctcccacattgactgtctctttatccacaatactggaactgcattattgcctattatatgtgacatgaacatcagaataagtgtacatggattgaactcttcctatgtagcacaagctgagccaagcactgtaccttcatggctgtgtgttgtgctatgtgtttcaggcatgtgatcgcctcccccacccacccagcagttcaccttattcgattcctgctcatccttcaggttacaactcaaaagccccaggcttagagaaactgtccctgtttgcctgtgtcgattctcgttttttacagccatcccaggggcatcttatattttattgagtgactctgttttatcctttttctcttactccactccatggtcaactgcaggtggaccatgcatacacctgtttggacatcactgtctccttagcatctagcgtggtgcaaggcacacagcagaagccccatatggaaataatgaattattccatttgatgcttctcacacactttgaggttagtgcttttcagatccccattttgcagatagagagtggggtgtaggcaggcgttaagcaatttgtccaaggacacaacagcaggtaagaggcacttccaagattttgaacctgacagtctgagtccacagcccctgatgctcatcactgtgcacatggcctcttttgctgcctttgcaagatacaagggagggtgggaggcaatgtgtgcagtggttagggagctcttgctgcatagcttgagttgctctgagaagtgatgctgagcccattagagccacaaaaggaaaacaaggcacttgtttctatttattgcagtattactttatcgttgtgtaagagcctcgctagatttctgcactggtgcaatctggctcttgttttgttgtttgtctccttggagtctcaaggccctgggttgcccagggcatctctggcctctttatctaggctcacgctctgagtatgattttgagggagcggttggaccacctgcctggttacaggcagtccttgggcatcatgcagtcacagctggagctgctctgatagccactcaaaatgtggtgtgcaaaccactgctcactccatctaatcaccgtcatctgaatcagcttccctcttcatttcttctgagaacaaaattagatctttgccagcataatggatgaacttgtgcaatcaccttgttcattgctagttctgcatttccccaagatgttgatgtctcttttctgtgaattttagaatatagagtgtcagagatgagggtgaggacttgaggttttcaaaattgtcttctttgtaccatggttgggaccctaatagctatgacactcactggaagctccttctgtgctagggcttcctgtgtgtcatttcattaactcttcatggcaaaccctttattataccacttgacagatgaaggaactgaggcccagtgactaaatggcaaaccgagattgcagactcaagcagttctcttcccctgctgtgtgtggagagggcatgcttgggatgcagggaatagcagaggcaccatgataaggtactaggaaggaggcagtgcaggtatttcactgagattccagaatcagtgtgtctggcttgagatcccagctccatcactttctaagtccataacctttcactttcttcaatttctctgaacctcagtccatccctacaaatggagattatcactacattgtacagtccgtctgaggattaatcagcctggtaaattattttagcaaagtgcctggcacctagtgtgtgtttagtgcaagtaggagtcatagggctgactatgataatcatgacgattactattatccattgataataatgatatcattattaaccttgtttttgttgctagaatttcacaatccctttgggcagcaaattggtcccagaatgtgcttcgtatattttcctcttgactgtaactgaggtgacaaattgagagtgaagggggaagaacccagcgtagctgcaaatgtacggttgagatcgttgacagacttgaggccctgtgtggagttccgcctgcagaggatgctgacagcagccatatgcatgggctctgattgattggcagagagaaacactaatttattagactcgttatgaaaagtgacggagcaggggattgagagggctgattcagcaacagtagccctggctagatcccaggggtattggcttggtgtctgtttcccttgggaccagccccctgtcttgattctgggtcactgcctgtgttctcaagtgagtctcctgaagatgtccatggcatggctcacttttaccacgttgtaaatgtcatacctatttcttcagtatccttagaaagctgagtccagttcaggttgctgttgattgcaaaggctgataagaggagggagggagtgtgtgcatgcagaaattccccagtggagggaaaatagtccttttcacaggttagagaaagtgcagtagtttccttgagggagaataaagggcatggttgatacctctctttaagaacatgatgaccgggcatggtggctcctgcctgcaatcccaacactttgggaggctgaggcaggaagattgcttgagccaggagttggagaccagcctaggcaacataatgagaccctgtctctgttaaaaaaaaaaaaaaaaaaaaaaaaattagctgggtgtggtagctcatgcctgtagtcctagctactcaggaggctgggacaggattgcttggctctgggagtttaaggctgctatgagctgtaattgtgccactgcactccatccttggcaacagagcaagaccctatctgtaaaaaaaaagaacatgaagctctttgtagaaagatttctcatttctgatttggagagattgttcagtctgaattacagcaggtaggatgctggttaaagaagtgtcttgccttcaaggtgataaggcactgaatggggctatgttggagtcagaaaagctttgagaagactgaattccctgagcgccaaggtgcgaaaggacaaagtcatggcagccaggtacacttaacttgtggatccagattctgccacttcctggctgtgtgagcttgggccagttactgcacctctctgagcctccatttacttgtctattaaaaggcaaatgattctgtctccaaggatggctacctgggagtgagttaagtcaagcagcaatcacacagacttccgagctagtcacttcttatttttttttaccttgtggtattcagacaatagcctctcaccccatgactctttgatacaaaaggttccctagttagtgtgctgtgatttgtggaaagatattttgtttcctagtgaatttcattcattttgctcaggaaactttattggttttgtctgtgtaaacctaaaataatcttcaaaagttcataacaagaacaaggaaccatccaccccattctataaacttatttctactgaattgtgcttcgctggtgtcagtttataatgagaaatagtataagaaagccgattagccacaaattttaaaaacttgacattatatatgcacactgaaagaggatagactatttaaagtttgagaatttttacagttgaatctagcatttgaaagaaaaacatggccgggcgtggtggctcacgcctgtaatcccagcactttgggaggctgaggcgggtggatcacgaggtcaggagatcgagaccatcctggctaacatggtgaaaccccgtctctactaaaaatacaaaaaattagccgggcgtggtggcgggtgcctgtagtcccagctactcggaaggctgaggcaggagaacggcgtgaacatggggagcggagtttgcagtgagccgagatcgcgccactgtactccagcctgggcgacagatcgagactccgtctcaaaaaaaaaaaaaaaaaaaggggaaagaaaaacatgttattgaatgtaggtgagggataagaaccaagaacttctggtaagaacccagcaggacaagcgagctatgaagaattcaactctctaatgttatttgctatgattattattgttatttttttgagacagagagtctcatttgttgcccaggctggagtgcagtgatgcaatcatgtctcacttcaacctctgcctcctggactcaagtgatcccacctcagcctcttgagtagccaggaccacaggcatgtgccaccaagcctggctaattttcgtgtttttaaatttttgtatttttttgtagagttgtgatttcaccatgttgcccaggctggtcttgaactcctggggtcaagcaatcttcccttacaaagtgctgggattacaggcatgagccactatgcccagccctatgatgatatttttgaggactctgttggctattactgtgttagctttggtttcaggatcagaaagagtttgtcctttcttcaggttctgattggtatttatgtaccagacacttctaagtggaatacctgtccatgttcccttttcacaaagcctgccaggaatctcagagctgattttatagttcagtcacagtagtaaatagaatttgatagcatggattttgcgtattaacctcacttttgactcagttttatttctctacccttccattttaattttctctttttattgtgatgtatgttactgtatcaaaagaatacctttgcaaggtacctaatgtgaacatattcaaatattgaataagaaagcaatataaaggtatataaggtaggtgaacattgaaaggtatacataaattacagccctttaaaacaccaggaaccctggaaaataggaccatatagtgcagtgcttggtatcttgagctagacctgaagttagagaaatgcaattttgagtcccaacagtgcaaatggttactctttcttattttctccttttaaaaaacattttcctggagcactatttatgctatataaattcacttttattgggccatttattgcctttttcatgcattcagcaaacatttttgagcccatgctctgggccaggcactgttaggcactggggatactgtatggggtgggtatattgaccaatattgacatcatctctgcctagtgaaacttatgctgtagtgagagagactgacacgaaacatgaatgcaggtaaaaagacaatagaattacccgttatcataagtattaaaacggcaacagaatggagcattcatgtaataaaagagtgagtgaccctgttcggtaggaacatcagggaaatgtctccaaggagaggtattgggccacatttaagctacggcctgaagactgagaagggccaagctgtgaccagtggggagaagagaagagaggagaccatggtgagcagaggtggcagtgtgttcagaagcccgggggaggaaggagagggctctgcacatcctgagaacagcaaggtggccagcgtgcctggggtggtgagagcaagggaagggatgtggctggcaaagcctgcagaggccagaacaggcagccttgctctcaggagcctgtgccctgtgttatttttgagatggggaagatcttaactagtaccatcctttataagcatattcaagataggtgcgagaataaggtacaaggagcaccatgccagaaaagcaatgtgtgtgcctctgtgtgtgcatgtgtagatgtgtacacttgtatgtgcacatgagtggatgtgcacacacatctctgtatgtgtgcaaacgtgcatttttgtgtacatttctgcacgtgtgtgtatgtatgtacatgcatgtatgtggcatgcgcatacgtgcatgtattgcagcaggaagagaaggagccacgaacagtatgacagtggggagattgctgacttcagagcccagcagaatgagggtcagtgttgctgggcacgctgcttacagcatgtgcagagcatagctctgttttgcctcacatccctcctggactgatccctttctgtttgtatggtacattcagtgagtgacagcatcacaggaggcagaccccagccttatgaacatatcttcataacaccatacagtctcacgagaaaggggaggtcatttgttcactgtagtccacccctgaattgttccctcactggctctgtgtcactttcagagatttttttaaattctgggaaatgctttggggacttcggcattttggagtgtgttttcaaggattgtattagcaccacagagacccttagcctctttcttaaaggttctgtttttagacatcctcctcttttatccgtgctttcaattctgctgcttccttccttctgagattccttcttccttgctggtcttggaacaagaaacatttagctgtattttcctcgttctcgcctaggtagggtgtggtccccctgtgtcctcatttgttcaacattttgagacaaagattggtggaattgccacttaaaaaaataaaaccagggaaagcagctcagagaatttaatttgcctctaacccaactcttctacttattaaaaaaatatacaattattcattccgtagcactccagattgcttcactgaaagaaagaaagaaagggatccactccagggagaaagaggctcttgagctttttgttccttgatgatcctgtctttacgtaatttggtggagcctactggggaatcatcattttgggagactatggatgtgcctcattgcagaagaataagtagagagcagtgtctggaacaaatgcttgtcttaaaaaaagtttatgaaatgccagcagatgtcagtgtgcccttgccatttgattttttttttaaagcaacattaattattttcggtagtaaaaacaacacaagtatattctgctacagttataaatgaaaagatcatgaggcaacgttttttaggtttggagaaggaccagcagaatttatgtcataaggtaaaatcctctaaattatctgtgtaatataatttgtcttttcccagaaaagtggtttcaaaatgcaaaacctagtgtaagttttttttttttttttccctctctcccagccattgttcaggtgccaataatagcttaggatccagcttagcttctgagaagctactggctctgctaattgataacagctccttatttcaaagctggagtttgcaaaggaaggtagtgtagggttgggtatggccttgtcgtttgtcatctgagttgtgatgagaaactcttgcagtttacgttgttaccgtgagcacagcaaattgcgtgctaatagttagttcctccgcagacattgtttggatcaaaaatgagggcctctatacaggaaaaagattcactcaaataattaaaaactattcattttaagcaagggataatttgccagcatgtagtgcaagagaggtagggtcgtttctaggcagggaatgatgtatgttacagggcatatttgatgctttgctttatttatttaatagttttgattaaatggtacaatattcaaaaatgcaggagtatgcagagaaaaataaatctctcttgcacttgccttgcagtttattagagacaactatttttatagtttctcatgcaccctttcatatatattttatgcgaatacaaacatttacacagatatttataccaacaaaagatagcatatgaaatgcatagttccactgtttgctctttttaaaaaaattaagaataccttttaaggattattccctctcattgtgtgtgtgtgtgtgcacacgcacgtgtattttttctgctccacctttgttaatggatatatagtattccattgcacatgcttacattatttaattggcctccttttgatggatatttatgttgtttccatttttgaagcgctacatggaatatcttcaaccgccaccacttcccacacatgtctgtaggatacattcttagaggtgaaattgttaggtcaaaggaaacatgcctttcattttgacagacactgccaaacctgatgctctggctgagctgcacccttacatgttggtggatgaatggggtttagaaccaaatgaagccatgtggtgattctggtctgacttggctaccgtgatgactgtcatgaattatgtccctattggaagtgtcttagtctagttctgctgctataacaaaatgcttatccagggtgatttagaaagaataggaatcgttggccaggcgcggtggctcatgcccgtaatcccagccctttgggaggccgaggtgggcggatcacctgaggtcgggagttcaagacctgcctggccaacttagtgaaaccatgtctctactaaaaatacaaaaattagctgggggtggtggtgggtgcctgtaatcccagctacttgggaggctgaggcagaagaattgcttgaatggagtcggaggttgcagtgagctgagattgcgccactgcactccagcctgggtgacagagcgagactgttgcgcaaaaaaaaaaaaaaaaaaaaaaaaaagaaaagaaaagaaaagaaaggaatagaagagaagttgttttctcatagttttggaggctgggaagtccatgatcaaggtgtggcaagttcaatgtctagtgagggatgcccgctctgcatccaagatggtgcttcctggctgcatcttcatatggtggaaggtagaagtgctgaagagtctgactagttctctccaacctttgggtaaggttcccatctaagcatgaaggcagagtcttcatggtctaaacagtccttaatagtgttgcattggagaataagtttgaacgtgaattttggcggggacacaaaccttcataccgtaacagaatgttttgcagttcttgtcattgctgtttttttgctaacactttccatctgccaagtagtttgttaagatctttaattccacgttcacatctttgtcctcataacaaccctgtggagtagaccctgctctcatcctgtttcaggatggggatgtgggggctgagagacctcaggtgctttgcttagggttacagggtggatggtcagctcaggagtcacactcagggcctctaggcttaaccattgagctgggaagctgtggtgggttttaagcagcagagagcatactattgagttacaatgagtttaatgtcaacccgattgtgctgttgaccttttggattgcataattatctgttgtgcaggctgtcctgtacactgtaggatgtttaatagcatccctggcctctacctgctagatgttagtagcacccccttcacccatccatgacaaccaaagacgtctccagattttgccaaacgtccctggggtagaaccttgccccactaactcagacaaagagcaaaatatgccgtgggcatctgtagcataacaccagagacatgtatttgaggacacacatggtggctgatgtcagggcatcttccattcagccgtctcagccaagggacactcatttagttcttccccaaggatggagcagatgggctgccccttgtggcagatgccagtctaggaagaaacaagacggtattactcaaaccatttcatcctccattcgatcacagtagcactgcccaacaagactttgtcttttaaaatgtagtttagaaacgtccttgaaaaattgcctggtaaagtagacttataaaaaattatgttcccaactatagtccagcttatatattatacagcttttctattcctgcattttcctttggtgttcagtaatgctctacatcaaaatggcaagcgggaggcatcagccctcccagctccctgcacgtggcagacattgataatcaattcttttcccccctcatcagcgtcaccttcttagaatcctcagtgcatctctctaggcatagactgtcaaccaattggaattactatgtgaaatgaaatgtatttgccacccctgttacatggtgcctttttggctgagaagaaggattacgctttccaaagaggcaagcttatcatgaggtattagcttatttttcagttactctgagaaaagtgcttgatagatgggaagaaatgtctattcttaaagcatttggaattacgatcttattttgtaacagtaattgggtgcctgaagaatactcctctttcctgaggtgctttacatatactatcatcctatgtattattgtttttctgtagtaacatctctctcccctccaccaccaaaaatcagtcccctcccttcaaagcctggtggaggcagccacctgagggtgacacaaaacgctttgtgtacaatgggaactgagacaattccctcagcaaagaacattgagaagctgcaggacgttactggaactgtgtcacttctcagcacagggcatgtgagggagctttaaagagatggggaactgaaccatccaagatttccagaagtaacttctgatgtataaaggcatggaggccaggctgctctgggaaggcaacacaggtttcagagttgaaaatgcttttaggtggcatcatagaaccatccattctagcataatgttttgtgttttttttttgccattgcttttttggggaggggtggaaaaactcccatggaattgtgtggtaacttggtaatttggtttagtaacttgatgaacctatatgcaaatacctatcacttagatagtttttaagtcatctcctgtttctgattctaagaaaatagagaaaaataatcttggaaagaaaaggccctgggtcagacagtgtctgtctctttttatttttcagactggtgggaatgttttcctttctccacttttagatgttttagtctgtgagagatagggacaaatacaacacgtctcctatttcctcttctgagaaaggaatttttaacttagatgggaggcaccagtgaacttcaagggcttgaaattgcatttaaaatttaaagaataaacatttttatctgggcagaaggctcatagctttttaaaaatcacattctcaaagtgctatatgggacacacaaaaaagtaagagcccatctttttcagaacaataactttcagactcttttaccatgaccctagtaggcaaggaaaaaggatactacagcccaaccacttcacctgttttaaccttctggtgggactgtgtgtgttggaggtggggggagacagggaggtcacagaaagctcagtagtgatgaaggattggggtgcaactgtatttggtgggagagatacttacctcttacttagcagtaggaatatgcatttatttgagtcacaatctctgtatgtcttaaagtccaattatttagaaattatcagaaaaaagtgcagttaatgctaaagtgttagcattaaccaaaccccataaaaccacaacagtaatgttttcttaaaacattgaattgagtcccgcttaacaactttgataatagcatgagatcagaaagtccttcctgaaaattccaagaatgaaagccgtgtgcatgagtttttgcgggagaatatttgcaacatttctgtgaagttcttgatagctagacttcctggtacaacatttaattgtagtccttagtaaacttttgtaataatttatgttgatttttcaataatactttcaagttttcaattttactaactcagtggaatactactgttggtatctattggtcacttacaaaaaaaaaaaaaacagtccgttgaatgcattttctttcttttttttcttttttttgttttgttttgttttattttttgtttttggagacggaatctcgctctgtcgcccaagctggagtgcagtggtgcaatctcggctcactgcaacctccgcctcctggattcaatcgattctcctgcctcagcctcctgtgtagctgggactacaggtgcccgccaccacgccaggctaattttttatattttagtagagacagggtttcaccgtgttgcccaggctggtctcaaactcctgaactcagacaatctgcccacctcggcctcccaaagtgctaggattacaggtgtgagccaccacacctggcctgtagaatgcatttcaatgtgcataacgctaatgaaaagacttgcagttttggttcagttaatggcccattgtgaggactctttaggtctgtatacttaggcatgatacattattgctgtaggaagttagagaagatgggaagcacagggcttccattctacagatatccctatattttttggcgggggattgactccgcaaaccatattttctaaactttttcatatatacttgcttatgaatatattggaagcaagcctatatttatttattattttattttattagttttttttttttgagatggcatctaactcaccctgtcatccaggctggagtgcagtggtgcaatcttggcccactgcagcctccgcctcctggactcaaatgattctcctgcctgagcctcctgagtaggtgggattacaggcgtgcaccatcacacccagctaatttttgtatttttggtagagacagggttttaccatgttggtcaagctggtctcgaactcctgacctcaagggatctgcccacctcagcctgccaaagtgctggaattacaggtgtgagccactgcaccctgccccaagctatatgtacactgtacctcaatatccatatatatatccgtggagatatatatatatatatatatcatccatatatatatatcatccatatatatatataaaatccatatatatatatatatctccatggagatatatatatatatgtgtatgaatgaagcacttagtaggagcttttgtgacccattattaagcaaaatgaataaagttcattaaaatgaaactgtatttgattgctttagagctttgattttttttttttttcttgaacaaattctgcagaaaagctaagtggaattatttaccacttgggttggatttttggttatccttcctatttaaggccacacccagcaatcctaatagagttgaatggctgtgtttttaaatacgcagtgattctattggactcatgccaagcagcatcctggattttctgtgcatcagtgtctatgtgtggattagcactgacatattacataccagccaatgtcctctgctctcttcatgtatgctggtttgcaaaaaaaaaaaaaaaaaaaaaaaaagtagaaaaattaaaaatgctgaatcccgcagaaagtttccactccccagaccaaactgtgtgcatagcggggagaagggaccagatggccagtgggttgaaatcagtggaaaaccagctgggatgcatgagagggcatttcctcttccacttccctggaagcctggtcggggcaagtcctggaggtctgagcaggacaagaggtgtcaatgtcatggcctctgtctggctttctggatccttagatgaattgcagttggattggaatttggcacaaaaatctgaggataagctgttagttttctgctttctggaaaaaaaaaaaaaaaaaacagaacaaaacatgccagcttgacagaaggttggagggtaaaatgctgatgaacaggaaagaaccatatttccctgcgttagcaccagcttggagaccgaagttctatgaggagggcacatgatttgggtagttttgaatcctaaaggcaggatttttttcccctctcatttaaagcaaaacctttcattgccactgaataattatgcatttcttagactgccagcttctgcaacagtgattcctaggccccagtttgacactgagtgtgttcagttattttgaggaaagttacaaacgtttcaaattctctcacctctaataaaggtttaaaatctgccttttatggtgcctttttctgggttaacatattagttatctatagctgcataacaaattaatgcaaaacataccaatgaaaacagctatcttttgaggtctctcctgatgttgcagctgagatgttggctggcgctgtgtcacctgaaggctcagccggggctggaggatgtctccaggctcacctgtgtgtgttgagaggcctgagcccttcagtggttactgatcagaagcttcaattccctgccacatgtgccatgatagagaggtgcttacagcatggcagcttttgtcctttagagcaagaggtagggagagagagagagtccatgacttttttgagatagcttctcctattaacatctgatctcagtgtggtgtatttgttacaattcatgaacacacgttattacattacatttttattaaagcccatagtttacatattaattcactctgttgcatgattctatatttttaatgttttattgtaaaatacacataaaataaatgttaccgtcttaaccattttgaagtgtatggttcagtaacattgaatacattcatattgttgcgcaagcaacactatcacccgtctccagaactcctttcatcttgcaaaactgaaactctgtacccattaaaaagtaactcctcattccttccttccctagtccctggcaaccaacattctactttctgtgtttatgattttaactactcttaagtatctcaaataagtggaatcatgcagcatatgtccttttgtggctggtttcttttgcttagcatcttgtcctcagggtttatctgcgtggaagcaagtgtgagggtgtgaattaatcattctttctttctttctttctttctctctctctctctttctttcttatttatttatttatttattttgagacagtcttactctgttgcctagctggagtgctgtggtgcagtcttgactcattgcaaactctgcctcctgagttcaagtgattctcctgccttagactcctgagtagctgggattacaggcacccaccaccatgcctggcaaattttttgtattttcagtagagactgggtttccttatgtggcagtctggtctcaaactcctgacctcaattgatctgcgtgccttggcctcccaaagtgctgggattacaggcttgagccaccacaccccacccctttttaaggctgaatgctattccattgtatgtatataccacagttggcatatccattcatcttttgatgggcccttgttgggttgcttccgtgttttagctattatgacagttttatgggtttggacaaatacataatgttacccatccaccattacaatatcatagagaatagtttccctgctgtaaaagtctcctgtacttcacttattcttccctccctgctctccccctgcaggttcctggcaaccactcatctttttcctgttttgccttttccagaatgttatatagttagaatcacatgatatgcagccccagtaggttttatgacctagtctcagagtcaaacagtattatttctgccttattctgtttgttagaagcaatttcatccttctttcagggggagggtaattgtgcttcactacttaaaaagctggggtggtggggagaggagatatcaaagaattttcagacatgttttaaacaaccatagttaagatgacaagactagaagtccaagcattcactgggcatctattctgtgttgggcactgttctttcttagtgttttatatgtactattcattcaacccttacactaatgccatgaggtcactctcatatttatcatccacattttacggatgaggaaactcctcatccgtatgtgactccctgaagccacatacctcataagtggcagagccaggatgcaaactcaggtcagcctgaaaccaaagcctaagtcttgaaattatatcacgctgttcccttttagtgtaaggggaagtcttagtctaaggcttagattcaggggacaaggtctgaccaaatacatcagaagacatcaatgggcgatgatgctaaacatcttccagttgcctctccaaagacattctttgtccttcctcagtgtgtagtttccattgctgctggaacaaatcatcacaaacttaatattgatttcctgttttaaagttctatagctcaggaacccagtgtgttctcacttgcaatcatcagggtgtcagcagagcttcttaccttctggaggccctaggaaagaatccctttccttacttgttccaacttcctgagactgtcggcattccttggcttgtggcccctcctccatcttcaaagccagcaatacgggcatttctggtcatctccacagtctcatctcctggactctctcctacttttttttttttttttgagacagagtctcccactgtcgccagagctggagtgcagtggtgccatctcggctgactgcaacttctgcctcccaagttcaagtggttctcctgcctcagcctcccgagtagctgggactacaggcacacaccaccatgcccagttaatttttgtatttttagtagagacagggtttcaccgtgttggccaggatggtctcgatctcttaacattgggatttgtccacctcggtctcccaaagtgctgggattacaggcatgagccaccgtgcctggccctttctcttccatttctaaggttctccgtgattatactggacctatccagatagttcggaatcatctccctatctttaggtcagctgcttagcaaccgcaatccatctgcaaacttaatttacacatttaatttacagatatttacaggtttttgggaataggaggtagagatctttgggaatgttgattaaaaaaagaaactctggaagatatttaaagaggtttgttctgtgccgatatgagtgaccatggcctgggaaacagtctctggtggtcctaagaaagcgtgtctaagatgactgggttatagtttggttttgtacgttttagggagacagaagttataggcaaagacaaatcagtacatgaaaggtatacattggttcagcaaagaaaggcaggacatcttgaaatgggggtaagtagcctgcggcttacagatcatagttggattcaaagattttctgattgacagttgattgaaagagttaagctttatctaaagacttgaagctggtagaaagaaatgcttgatttaagataaggggggttgtgaaaaataaaatgcttagccaggcttggtggcatgcacctgtagtcccaggtacttgggaggctaaggcaccaagaatcgcttgaacctgggaggcagaggttgtgttgagccgagatcacatcattatactgcagcctgggcgacagagcaagattgtgtttccagaaaaaaaaaaaaaaaaaaaaaaaaaaaaaaaaaaaaaaaaaagataaggggcgttgtggaaaccaacatcttgttacgtaggttaagctttcagatagcaggcttcagagggaatagatggtagatgtcttgttttcagatcttaaaaggtgtccgtctcccaccgaatctgtgctagatccagggaagtcctggctgcattcatggaggttcttcatagattcagaaaagacagctttgcagggtcatttcaaaatatgtcaaagaaacattttgggatacaatattttgatttccttcagagtctgctatctgtcatgcgatgctatatcagagtcaggttggaattgggtatcttattcccaaagagtctgttttgtcagtctaatgatttctatttgaatgctaatgctgaagtcagttgtgcctaaactcaaaaagggaaagggcataaggaggtgtgtctgacctcccttttggcgatggccagaaatttcatgtttcaggtttcccttggcccagggggagtctgttcagtcagttgaagagacataggattttattttaggtctcctgcctttcctgctcttttcccaggaagccagtatggaaggagaactccaggggctcttctgccctttgattgtcagctgagttctgcttatggggagttttggtgggagattggagggaggtggttaaatgataccaaggcttctattgtcctgtgtccttcctgagtagcagagaggaccggcctctgcttgctgtcactaagcagccagcctcctttccttctgggaccctctaacttttccttcacctcagccattttggcccagggaaaataattttgctgctactaattctaggttgctgcatagcctgtgtggtttcccggtgctctgcctacacctttgaaaacagtattctgtaagtaagatctccttaactaatcctaatttgagtatgccatctgtttcttatctagaccttgactgatacagtgactgagggtagtcatatttgaagttaaaacagaaaaaaacaaaacaaaacaggtatgtcttgaattaggctaggctaaatctttcaaagcgtgggacttaaccccttgccagagatgttgatgtgaaccccgaatcctaaggtgctgtgttgttttcagaagccaagtgaaatttccacatgaaagcaaagctttgtgcgttcttaaccaagaaggtccttaggatgtatacagtgttctctctttgagttcctcctggtgtctgttacaacagatgaggaattcaagaacactgccccttccatattcgcaagatgtgacaggctattgcccttgtcttagaagacctgttttaggttaaaaaaaaaaaaaaaaattcaaacaattccacaggtgagctaatgagctaattacagagagtggtttcaaaacattggcattccacaagtaaacagcatctgcctttgattaaggtgtgaaattttaaaaaggtatggaaagatggctagtatcttcaggtggcttcctttatattttttattttttgattgtgcggaaactattatataatggccttctgtgcattctcctgtgagaaccaggaaaaccaaataacacataccaagatcctacagtggcatgaggcgtgaactctgaactgcctgtctgggacacagcctggtccattgtctgcagagctagggctttctcattgttccctcatgtttctgtactgttcgctgttttacctttagaatgagagttccctctgcatacatgtagaccaactttgtaaaattttgagctatttgtgctatgtcagtggctctcactattgactgctcattagaatacaggaagaagttttaaaaatagccatgatgcctgggctgtggccctagggactctgatttgattggtcttggatggggctgttcttaagcatccagggttcagaccaacggaactaaagcagggcttctcaaattttaatgagcgtgcaaatcacccaagactcttgttaaaatgcagatgctgattcagtaagtctagggtgggacctgagattctgaatttatgataaactcccgagcgatgctactgctgctgacctgtggaacacacattgagtagtaaggagatagaacatttgggtgggtacagataccttttaaggatgggtgaatgttaatgcttgggtgtttggtgatttgaatcatgactccgagagttgagagttctctaggaagtaggaaatttgtagtctaatttggatgatcgaattacagactcagtggggtcttgagtagcaaaacacagccagacctcttcatatgccatcattgccacattaatgatgagtctgtttattcattcatgcattcattcattcatttgttcattcattcattcagtgaatatgtattgaatacctgtcagacaccaggcatcttttcggtgctgagaataaatcaatgacaaagataaatgaggttcttgaccttggctattccagtgaatggagtagaaatagattaactcaactaaataaatatgagtcaacaagagccataccgatggtgatatgtaccatcaatgaaatcaagtacactgtgtttccttaggtggaaggtgtggctacagagtttaatttgctatgtcaatggagcggccaatggaagtttcttggaagaaatgatgttttagttaagacacacacacatacacaaaaccccagggaaagaccattccaggaaaacagaaaagcagggcaaaggccctgaagtaggaaaaagattgatttattggggaacagagaagggatcagtgtagccttggtgtcatgagtgaggagatgagttgtgtggagaggtaggaagggaacgtctcatgcagaggataaggactttgagtgcttttctaagcaccataggaaggcgtctgatggttttacacaaggaagaggaacattctgatttttgtgttaaaatgattactttggctgctatgtggcagatatattagagatgaagatgtcaaaagtggacacagggaaactgcttagtaaactcacagagtaacccaactgaatgatgatgatgcctggtcctagaaaagtggcagtaggaatggatatactttttgtgataacactgacagatagggggatgaggaaaagggaggaagcatgaatgacttctagcaaatgcagaaatagtaatgatttactcacatggggaggatagctgaagatctaatttgtagggtttgacaagaccccagggctccattttagacaagtttgagatgcctgttaaactttcaagtgcggatttaagaatacaatgtatactcgagtctagagcttagggaagaattcaggtctaaaagtaggatttgaggggctattcctatattcatattaaacattaccgtattaaatgagttctcaaggacagagaaaagtagataccaagggaatattggggtttgaagaaaaattggcccaaggttagggaggcaactttggatccttcttgaaatccatcttggctttggattctcagatcttagactcaaggtaaccttgcagagatttcaataataattagtatgtaaactttcagtaaacattatttcccagacatggaacatctggccaaagtcagtgtgatttgaaatgaagtcggctttatctagatgtctctcccagagggacacattgtgaggaaacagatattacattgggtgattatggagggtggggaaataagcttgttggttccttggccagatgtctaagtatatggtaacggagttaatggatgttggggaagaaagacatgtgcagagttggcatcctttcagccaagccaggcaaggttgctgatgaaggacgcctgctgctgccatggagctgaagatatattctcggacccaaggaagaaacacagaggatgcattatcatatggaatgattagttggctaatgagccttgaggggcaggaaaaaatggactataaaacaaattaaaccagtacctgacatcctaatgttctttgtaaacacatgatgatgtcagtgtgtgtgtatgtgcgtgtgtttcctcctgccagcccatgaggttagccaaccccacacaaatactcagaattaggctgaccatctccccattccccaagtctgattcctgggcaggatgccgtgcatgaggaaggtgatttggcttttagagagatcctttccctgtggttgttcttggtagaggatgaaagatgagatttctctgaaaagctcatccctttgaattgtgttcccgaggaaagaggccagatgctatgtgaccaaagctttagaaaactccaggattttgggtgatgagcatgcaatgcctggctgtcttccatctgcagcaagggcagagccagcagggaatggacaacaatacagagaagaaaaggaagcagggggtgagggatgacttgctcacagaccagattatttcatccccaaatggaatggttcagagtgaatgaaatcaccctgatacggagcaggggatgctgatttagctaccatgacagtgccatagccactcttcctgtattgactacttactacgttcagacttgttttaaaggtttttcactcattgactaattccacaccaatcagagcagcatggagggtataccatggctgtgcctattttatgcatgaaaaaaataagtgtttagagagataaagtgattttcttacggtttcacagaccgtaaagcttggactctaggattggaactcaggcagtgacatgtctgcatgttggaggcacattttgctacgttatcaaggaaatactcagttattaaaaagagagaaggaaatgcctcatgggaacaaaggccaggatctaaaatggttttaatttaaaataaatacagccatttgtgttatgtttaatatgtgcgcagcattttacggtaaaattgccatatctgatttgatttaatctatataacagctccatggggtaggtattatgatcctcattgtacatttgttgaagctggctcaggaaggatccttggccagggtcaggcagttcagcttggctgagcgataggatttgagttcagacctttgtctattacacatgcccttcaaatagtattctagtcagatttctttccaattatcagtgcttctgcattatctataatctgggatgtttatttttacttcaagaatctctcataaagactggataccagaaaccttccaaattgtgatttctcctgttctgcccctgaaacttcattatttaatgttcccggtaataataatggacacccatttctggattaaagtacgtgccttttcaaatgatgcatcgtggaaaggttattattaataaaggtagcattaaaacaccacaaataactctgtaaccttgcttgggctcaataaattccctgcagaaaattttatttccagcaaacccttaaaatttagctcgcttttaatatactgtgaccttcagtggcccttatcattcattatatacgagtgacctttccaaagttgagaaggatagttgcaacagcttttggatattaaaacctataagaggtaggtatggttttcgttcattcctactgataattaattcatgtactttaaagacatagcgttattccttttatgacacaggtggtgatggtttcataagggcatggaatataaatggttatcttggctaaagtgggtttctgtcctttttagatgctgagttctagctatagcatgactcagactggggtttcccttggaaggagcaatgtcaagctgttggagacttgatcatcattttgatgatcatccttgtgccattttgacgatcgaccccttacatcttctaacagctttttttttttttttttttttccttttttgagacagtctcactctgtcgcccaggctggagtgcaatggcatgatctcagctcactgcaacctcggctttctggggttcaagtgattctcctgcctcagcctcccaagtagctgggattacaggtgcccaccaccatgcctggctaatttttgtatttttagtagagatggggtttcaccatattggtcaggctggtctcaaactcctgacttcgggtgatccacccacctcagtctcctttaaaaaaaaaattctttattaaataaaacttaaagcatatttaaaagtagagagaatagcctgaagaatcaccttctttgaatcacccagattaaataattatcaaggtattgctaatcttactttacatatgccctggccactctccctctctagtctcatgctactagtcttaagcaaataccagatatcatatcattgttttcttaaatatttcaggttgcatctctaaaggataagaaggtttttttcctaacacctgtaatatctactaacaattaacagtgattttatgaatctcaccactattaaatagtggtttaattttccaattttttcaaaaatgtcattgttttcttatttccaattctaaaaatagtctttatttttttacagcagtttcaggttcagagcaaaattgagcagaaggcactgagaatttgcatttccccttgccccacatttgcatagcttcctcctttaggaacacccttcccagtggtacacttcctatgattgattttatgatagtttgtttatttgaaacaggatccaaataaaggcagtacactgtgattgattgatatatctttaaaaggccattttactctgttaaaaaaaagcttaaaacgtttttttttttttttgagagtggaagtcttgctctgtcgttcaggctggggtacagcggcgtgatctcaaaggctcactgcagcctctgactcctggattcaagcaattctcctccctcagcttcctgagtagctggaactgcaggtgtatgccacgacgcctgactaatttttgtactttttaatagagatggggtttcaccataatggccaggctggtttcaaactcctgacctcaagtgatctgcccaccttggccttccaaagtgctgggattacagctgtgagccaccgtacccagcctgtattaagcatcttttaatcagtctttctcccatatttttgtgtgtttgttttaacatttttctttgtggtgattgttgaccttgttgaagaaaacagattgtttgtcctgcagtatttctcacagtctggtgtttgctgattgcatccctgtggtgtgatttcacatgttcctgtgtcctttgtattcttttaaattagtctaggtcagatgcaagttccatttctttggtcatttcttcttccaagaagaggtacattgatcgattgtctccctttttgtggtgctatttaatctccatgggctaggtattattagctttattctacatgtgatgaagcatccattgaccatggatgctcaatgcatttttcaggggttgcaatttagtgacactgtaattttacccttccttcttcatggagttaccggagtacttcttaaagagaaatttcccagtctactattaggatagtcagggggtatagtttatacaggaaatacaggaaaaatgcttgattttctctttgtgatttcaaatatatgagcttgtttatttgcatactctagtgactggaatttttggttttactacaaatgcagggatggaagttattatctttgttgatgctcagattattcaatcatcaaccggtgagagcttcctccttcctcaagtttctgcagaagtcattttgacatgactctgcttgtctttggtggctttcttactatctagtatgacttgatattctagattcatcttgtatatttgctaccccacacctgaaataatccatttccccgaggagatctgttaggttggtacaaaagtaattgcagttttttcccattaaaagtggtgacaaaactgcaattacttttgcagtaatctaatagttcctaagggtatttcaggatcataacctgggtactagaggtgtcccatgaatcttaaaagagtcttatcatctgttcccccaaaaaccacctcctccagttaccatcatcttgataatcggcctctccatccatcctggtactcaggcaagagagttcagagttttctttctttccttttttttgagacagagtcttgctctgttgcccaggctggagtacagcagcatgatattggcttactgcaacctctgcctcctgggttcaagcgattctcatgcctccaccttacaagtagctggaattacaggtgccttccaccacacccaggtaatttttgtattttttagtagaggcggggtttcgccatgttggccaggttggtcttgaactcctgacctcaagtgatctaggtctcccaaagtgctgagtctctgtcacccagactgctggggtgcaatggcacaatcttggctcatggcaacctctgcctctcaggttcaagcaatgttcctgcctcagcctcccaagtagctgagattacaggctcctgccaccatgcccagctaatttttgtacttttagtagagacagggtttcatcatattagtcaggctgatcttgaacccctgacctcaggtgatccacccaccctggcctcccaaactgctgggattacaggcatgagccaccatacctaaccagcaagttttcttttatttatctttcttccttccagtccatcctttgatttttctttccagttccactgccagagtcagagccctacactccctcacctggaccgacaagtttgacgcctaataaaatggacttctagtcttgctctctctagtccagtccccatcatgccaaacaagcctgttttatgaaaaacaaaacagaacaggaaagcaaaataaaaccaaaactggtcctgccatgcccttgttcagaaatgttctgtggctttctgctccctagagaacaattcaacgctgctccggttcttggtgtccctccgtttccagtcccataacctgcttcttccttccatttccttcatagtagggatttatccctaactcttcttacttcgttcctgctgctcccatgcctgatgtccctgtattcctcttcccccattttgcccaaggtcacgcagaaatttatgccaaggctctcttcagatgattcttttttgtgatgacttccactgaccttggccagaactgcttattcccttgattttatttctttaacgcacagtttgcttagtcaacctctatacgccttggtatcctaatctgtaaagtggggaacataattataataatgcctaggccgggcgcggtggctcacacctgtaatcccagcactttgggaggccgaggcgggcggatcacgaggtcaggagatcgacaccatcctggctaacttggtgaaactctgtctctactaaaaatacaaaaaattagactggcgcggtggcgggcgcctgtagtcccagctactcgggaggctgaggcaggagaatggcgtgaacccgggaggcggagcttgcagtgagccgagatcgcgccactgcactccagcctgggagacagagcgagactccgtctcaaaaaataaataaaataaaatataataataataataataataataataataatattaatgcctatggcctggggttgtgcaggtattagatgagatcgctcaagtaaaatccctaggagtagggttgggctcctttgtgagctcttcataaatattagttcatcatcttactgttgttagcagtaataatgtttgcagtggtaacatttctttacatctctattaatatcaccacatctcagtaattttacctggatcttgcattttctttaaattgggaagtttttcaggggaagggtctcatcttagcaattcttccttttaacacttggggctgagcggtaccttacacacagtgaggcctccgctattatttgcaaatttttgtgccatggatgtagcagaaattatccgagggctcctgatgtaactcctgcccccaatcttgcatcttagctggaaacaataaataacggaataatattgtctggtaccaaagggtgtcccagagcaggaattgcgcagagagcttgatgaagcagaaagaaggaagagtggctaacacaattagtgagtgtctggccctgaagaatggattgtattggacagaggggagaaaggggattgttctaggaggagagagagtgataaggtaagtatagaagtaagaggcagctgtcactgcagtggctgaatgtaaacaaagaaaatcatttagttgaatattagtgagtcaaatcaagaaaattcccatgtaatataacaagttttaggaaatgactattagtcacagttttatctaatggggaaaaatactgtgttgcgtaaatagtcataatcaccactattccagataaagttaaataaataaaacatttttctgcttgtaatctttccctacgtacataagagatcttcaggtcttaaatggcatttccagtgtcttagtctgtgcctcacttgtacaatcttaatgggacccccttaggctgggcacagtggcctgccccatacctataattctagcactttgggaggctgaggcaggaggatcgcttgagcacaggagttcaagaccagcctggccaacatggtgaaaccctgtctctgcaaaaagtgcacaaaaattaagcatggtggcatgtacctgtagttccagctactcaggaggctcaggtgggaggatcgcttgagcccaggaggttgaggttacagtgttggtgccactgtactccagcctgcgcaacagaatgagaccctgtttcaaaaaagaaaaaaagaaattaaatttaaagaaagaaataaatggcaccccttgagtgatggctgtaattgaggaaactgtcagtttgaagcagtggaggaagctaaagttatagtatctttcctaatagggtaaatttttgtttcatattttatttcatcctgctctgcttattaggaaacataatataatatgtttttttggggaggcagggaagaattataataattatggataatatttcaatttatgtaaataatagttcaacataaataatatataagtaatattctaattctgtaattacagcagtgggtggtatgttttgaggttttattaagtatcaaccattgatttaaacacattttgttgaatcccctaagatctccagcgtcaggtttcctgtctttcccacttgacagactaactccggctttgagagtaaatgcgaagtatatcaggtcaaattaagtctcaggtgagatctgtctcctgaaagataaacactgggttgacaccctgaccatgattcatattgggtctatggaggtgcaaactggagaaaaaaatcatgagtttcttcttgttgtcgttggtttagaataagtcactgtaatgaaaatccttcttcaaattttgtgtttctgtatgctgttgaagggaaactcacagatttgcacacatcttcacataagattcatcggtggatgttatgctatattggctactttttttattattattattatttttgagacagagtctcactctgttacctgggctggagtgcagtgacacaatcttggttcactgcaacctctgcctcttgggttcaagtgattctcctgcctcagcctcccaagtagctgggactgcaggtgtgtgccactatgcttggctaattttttgtatttttagtagagacggggtttcaccatgttggccaggattgtcttgatttaatttttagtaaatattgtcaggtgtccaatgcagaatcatgtcatgtgaggctgttcctttgcaggggacttcatgtgagggtagagtgtttcttgtggcatcttttttgggatgcaaaacttatcctacaggtcatttatagtattttggaatgagtaaaggctttttgctgtccaacggaattattaaaaagcacttattatctttctcattaaacgagtcatctgttcttctttcaatgcacttgtgtcaagtgagtatgacatgcaaggatttggagatacagaagtgaacaggcattgctgggcgcggtggctcacacttataatcccagcagttttcaaggctgaggagggaagatcacttgaggtcaggagttctagacccgcctggccaatatggtgagaccccatctctactaaaaatacaaaaattagcgaggtgttgtggtgcgtgcctttaatcccagctattcgggaggctgaggcaggagaatggcatgaacccaggaggcattggttgcagtgagccaagatcgcaccactgcactccagcttgggcaacagagtgagactccgtcaaaaaaaaaaaaaaaaaaaaaaaaggacgacgaattggacaggcacagttcctactctcatggaagtttgcagtctgagaagcgagacaaaaaaaagtgaaatcattgcgataaggaagtgtgaagacttcagaaggagcgatcacccagcacaaagctggagcaagggaatgaccaaagtaagatgagtacagtaaaataaatctaattttagtttattatagaacacttggcaaacacagaaaagtacaaggatgcaaattcctcagaatcccatggttacagtcaccttgagcattttactggatgtttgattttactaatcccctcttgatgagcacttaggttatttctttcctaatatatgaaatatctcctaattttgaaaatgtttcctctgtctactatgtgatagaatttgtttcatttctttgcactcaatgagggttcttggggtgggatagaggggcaaagtgggtagtttgggtggagctaaacaaatctaagtgatgccagtataaacggcgggaaaatatctgtccatagctgcttgtcatttttgtgtcagctccccaaggtgtttgtcagtgtctctaatctccttacactgtggtctcgcctgaggatttgcatattatggacaaagtgaatgtgggggagtgtagggataaagcaaggaaatttgacatttagctgtcaacgatattgtctttcaagtgaggttttggaatctggtaagcaaaagattctaatgagtttgaatgaactgatgagtgtaatacctgttttcctttctcttttcctcgatctctcattctgtctcctccctttcttcccctaccccttttctctttctgctttacccatttgtgtttgaatactggatctttatcaaggtcacattcatatatctcaagcaagggaaaataaaaaccttgtaatttatttatgcatgtaattgcctggcctcattccttttttatttctcctctgcttacttcctaattcctggtgggtctatagctgttaccaggagaggagactggcgtggtcgctgaccaaatcaatgaagatactcctttagagacaaagtttacagttcttagttgtgataagcattatgaaaatctaaatgaaattgtctaggagaggtacattatgaaatcacactcccttttgagtgttaatatggatcaacagtgataaatatttgagacactggttgactggacatgtgatgaagacttaagacttttttttttttttcttttttactctggaagtgagctgcatacagaaagaacaaagacggagtgcagattaataaccaaagtcctgatgtggcaattgattaaactctctttttatgatacctttcctctagagtgaaaagtgagtttgtgttcgtgaatgccctggtgacaagagtctctttttccccgaagaaagagattcacgtatggctgaaatttcccggagaacacaggaggggggggaatattgcaataaatcaagtgagtttttgtgatccctataagcaaaaacatacttcagttatgatggattgtgttagagagtaaattagattgcatggaggctaagtactaatgttgatatttacagtgcttaaatatattgtctgcctcctctaaatgcagctcattcattggctttatgttgtggaggaaatatcagaataatgacctgggttttttttttctgtctttatagtttaatatcatgcaactgtttattaataagctccaaaccccaaaggatccttctaatcctattctaatatcagactaaatttaataagatgcattcttctccccactgcttatgcctcattcattcatttattcaaccaatatttattgagggcttcccaaagtgacaggcctgggttaggctttgggaatacaatgttgaaacacgacaggcttggtctctgccaacaaatggggacagaccaaaagggaaaaagaaaaaaaaagaccaaagacactgagccaagaatgccgccaggcgtttaaggatgtatattgtttctctaatgtaatgacttcgagatttttgggagagatgagagtttagaatgcttgaagatgttggtgtccttggagtgcaaggattatctcctgggataatggaggggaaatttcttgcaattttctcattttgccaagcccccacccctggcactgttgaaattttatgagggtttgctatgggtttttttttttttttttttttttgaggcaaacataactttgttcaggttaccagaagtaggcaaccgctcagttgaattccagattcaggacaagatgtcttgctgatggtgaggtcaaagatgaggggaaatcttcagagagaaagcaagcctgaaggctgcacttcagacaaaggcctgacccgggttcttcacacttgaaaggatggcagagttcaaaggaggcagtgccaaaggagcaaacgcagacacacgggaaggcttgtgaaaagggtttttatttgaagtagagtttttgagcacgtgatggggtcgggggtggaatggagaaatgcaagtaacatgcttctttatcacagaaattctcatcaaagtcatttcctatcagaaatatgagtgtttattggttttcattaatccctgcccctattctctttctagccttcctttcctccttctttccctgccttcctccctcctcttcttcctccctcctctccttcctccctcctctccttcctccctctccttctcagatgtgaatgtgttaaagatccaacctttgctaacttcttgcactggcctagaaccatcttttagaccgtgtcattgtttatgctggtttagatctttaaagatacatctttataaaaagttataacattcttgatgacatcgaagcatttccagaaaatatcgagatccgtcttatatatctgtttattcatccatgcatccaccatccatgtattcatccatctatctacccacccatccacccatccatccacccatccatctacccacccatccacccatccatccacccatccatccatccacccaccatccaccaatccattcactcatccatacattcacccacccatccacccacccatccaccaatccatccacctatccattcactcatccattcattcacccacccacccaccaactaattatttacccatccatccacccacttacccactcatttatttatccatccatccatccatccatccatccatccatccatccatccatccagctatcatgtatacagtaattaaaacagcaccattttgcagagttgcttcactctagctttcttttctgtgaatctggaacaactaactcagactctgtagctggaaaaccaagaaaaatgaatgtgaaagaatgccacatctttgcaaaagcaaacaccaccacatgcactactattaatagactgctttctcttttcatattcttcctgtgacagtcataatttgcatatatagggttaggtttggcagaaaggaaggtagaagaggtgaataattcatctggacttggagtaaaggttttaattttctcttgaattcaagatgtcttttggaaatgaaggtggctctgaaggaagatcaaaacaaaaggtgagcaattctgatttcttccctaagcagtggccattataaaaataaattaaacctggagaactgaacaggagtgcgtggtatctcttgtgcaagagactagaatagggtgatttatatagagatgacctaatcaaaatctctttaatattattgcacgcaatataaacatttatataataatttatactaaagaaaatacatataacatgtatctcatattttgtttcactttaaccttctatttactctgtatatttaaatgtatttttaagtgaaaattagtgttttaaagggaactattcaaagttcattttcgtctatagggaggaatgcatgtgtttaaatgggttctctgagtaaatatatttttgacacttgaggttattcaaactgagcatctctcagttttaggtcttaagtttcttccttcttctatatactttgttttacttttagaagctgaaacagggcctctaccatctgtttatctatttcagccaaattcaccattcagataatgtacatttcacaactgaagcccactcagagatcaattttcaccacttaaagagcatttagccatgattccaggaatagaaaatgtatcctgagacccataatgacttgatgagagaataaaggatcatttgttatgcagcaagtataaaattataacaacatccccctatgtttacagatgaaggacattctggctcaggaagtggggaggattctccaactttctgacataaatgattggatgctgttctttcccactctgtttgttgtcttggaaacaaatataggatacattgtttaaaaaaataggtaactggcatcatttggccctaaaattaggattagggttttttttttttttttttttttttttttttttttttacgtataacaagaatggagaaacatcttgcttactaattggaaggaataagtttgttgctacaacgtactgagttttggctctcaaattctcctcttcttagccacaatttggctcagaggatttgcaccatttgttcatctgtaaaatggtgataataatagcagatactgtctaagtcttacagtgagatttaaatgagttaatagatataaaacacttacagcaatgcctagcacacagtaaatgttctagaagggttagctgtaatttttggttattatactcttaggagaagcttcctacaataaccttatgagacctgctctccttgtcatgcttttggttgacctttcacagagtgtattttcaggttcgacctctacgtcagcagttccatatactttgatgcttgcttcatgctttgcctatggtgttgtaaacaggagttctccacatgcatgtgttgctaagcaacacagaatcctttggctgcaagtaacttcaaaccactcgtactaccttaagacaacaaaatatcctagaaggactcagagctgtttcccaggattcaggggcagagagttcagtcatagaacccaagaggaggaagttcacacagttaccccagaagaactgaaaccaggaagggaacatctacaggagcagagattacactgtttttccagggctgcctggggttggtgtctccttctgtctgtgccattaccttccttttctctctgtagatttctttcccacatatggcacatggacacacggggctgccctgaacccagccctgcctactgcagtgattacaatccatgcattcatttacagttactgaggacagaacctggttggtccagccctgcccaccacactgattacgacccatgcattcatttacacttactgacaacagaacctgattggcccaggtcttttcagaagtcacccctagtccaatctgctggaccagaggagggtcatggttgctaacccacccggcagcagatacaggggtggattctatgagaaggacagggacccactatagcaattgattaatagatctagaaagtagtgtgcgaagttaccaaacatatatgcccaaataactaagctataataagcatgttcatcacttcagaagacacaactacaaccaatgggtgtaagcgacaagtggtcagatttcaagtctcaaagaataaatatctgaaaatagataattttcattatatgtctatataatgttttgttatatatctatattgtatatgtatagtcatcatatatgtatacatctattttcattgtataacatataatggtaatatagtatattgttacaaatatctgaaaatatataatgtaattattaaattatatgattatactatacactatagtatatgtgctatatttactataataaaattaagtatagaaaatgaaaattattttcagaaatttattcttaacaatataaataaatctctatggataaatctatgtacatagatttaagatatactatcatacatagaaaaaaacagtgttttcactttacactcacactcatatagcacagaatacttctgtgaccagatgtgcagggttttccccatcaacaaccagttctccagcagataccaatggggtgtcctataattcagtgccattctgacattatctacctggagatagcatcagatcccacagattaaggattctgccgccaagactgcccccactttggactccagttggaagcctcaggttgtgacctgtgcttctgaaggactggttaggattcccatgtcccttccctgggtttaagttgatcgagtggcttatagaactcaggaaaacactgacgtgcgtttactggtttattataaaggatattacaatggatagagatgaacagccaaacgagatgcatggggctgagcatgtggataggcgtgcagagcttccttgccgtctctgggtgcatcaccttctaggtagccccactagttaagaagctctctgaactgtcctttcaggtttttatggaggcttcattaaataggtttgattgattccatcattggccattggtgatcaactccatctttagcccccctgccctctcaagaggtcaagaggtaggacagaaaattcctaccctctaactagaaggtaggtccccctggcaaccatcccccatcctgaggctatccaagggtcccagccatcagtcatctcattaacatacaaaagatacccttatcactttggagatcccaatggttttagaagctgtgctccaagaaccaggttcagcaaccacatacatatttcttataaatcacaatatcaaattatatatttgtatctatatatgtatatataacatatatatctatagagattgtatatatgtatatatgttacataatatataaatatatataacatatacatatatacatatctatatgtatctatacatagatatatatctatatatgtatatatgtatctatgcatatatagttacatttatatcactatctcaagacatgtatctctttgactatcactgtgtggagatatttactcttaggaattgtctcatgtgcttctaggggcggcaaatatgaaatttgtagggcagattagcaggctggaaattcagatgagagttgatgttgtagtcttgagtctgaaatctgtaggccagctggctggaaactcaggcagaatttctgtgttacagtcttaaggcacaattccttctccagaaaacccatctttgccctgaagaacttcaatggattcagtgaagcccacccatatttttcaaggtaatctccctgacatacagtcagctgtgatgatagatgtcattcacatctgtaaaatactttcacagaaacacgtagatgaatgtttgagcaaacaacgggacaccaccacctagactagttaacacatacgctgaccatcccagcatcctttatcatcttgatgagcttgatcactttggagcagcaagagggaaagaaaactatcaaggcagaggctgccatgatcaccacatgatatgccaacttgctaagacattgagtttcaattgagtctcccaggccaggctaccttcctcatgatgaggggaacagggaaatcaatatgggttcattaacacttaatttaggttttccagtgtggagcatatcaggaagagaaatggcagacatattacttgtctcaagcattatccatcattagcgtctgttctctttctccgacacacacacacacacacacacacacacacacacacacacacccccttatatttttcccctagtaccttcctcactgatcatattgttctgttaacacccaccaccaaaactacatcctgggtcctctccacactgcagctctcaagacgatcgtttactctattatcaagcttaccatttattttattttcaggcggttgtattcattataatgccattagcatgagaagtggggtcctgtcaccagggcaaccaggagcacagagtgcacattccctccttagctgatgtcttgttccctcttgggtggactccaactgtgtctttgattcattccattaggtggtcactgggatgtagatgcttgacagcctccttgtccttaagttgtctgtctttatatcctttactggccaagatttctctctccagaattcattaatttattaccttttatttctgtaagcataacacatataatatttccaagcatatttaaccacatgattatatctttacaattcctataacctctaaccctctaatgtattattttatattacatatcttggtgcatttccctatatattgtacatattgtatgcgagtatgatacattccccttttggtcagtactaccaattaataacaagctccttactactgaaggtatttcagctacatgatcatctgtctaggatattatagagcctattcttgcattatgaaaggggttgaaagagatgacctatacgttctttaaaaatctgaagccctaggtttattccatatctataactgtcctccatgaatataattttagctacagtggatctctctaaatgaagacatctggagcattccaaatgcaagcatgagtgcaaaatgtctgcttgtagttttctataacatccttcctacctccacaaaattacttagaatttgtgaataatttcattaaatttatctttggggggatacttgattaagtagtactccaagtgggcaatgtagtaagcaaatccattcccacattttcttttcacataggcagaatacatacaattttcttttttttattattattatttttttagacggagtgtcgctctgtcaccaggctggagtgcagtggtgcgatctcggctcactgcaacctccgcctcccgggttccagtgattctcctgcctcagcctcccaagtagctgagactacaggtgcatgccaccacacccagctaattttttgtatctttagtagagacggggtttcaccatattagccaggatgtatacacacaattttcagaaggtcttttgtgtgtatgcttttgaataatatgcccctggatcttgcccctccatcaatgatttccaaacctgacattgtatttgaattgcacacacacactaacttggatgtagaaacatttcagatctcaagacatggagaatccgaatcaacaggtcttgagtaagacccagtatctgtaattaaaaattaaaaaaaaaacctccctacgtgactgtttttctatatatttcttttctttctttctttctttttttttctttttcttgagacagggtcttgttctgtcacccaggctagagtataatggtgtgatcctggcttactgcagccttgacctcccgggctcaagtgatcctcccacctcatcccccagagtggctgagactacaggtgtgtgccaccatcaccggctaatttttttttttttttttttctgtagagacaggatcttgctgtgttgccacggctggtctcaaactcctggtctcaagcaatcctcccatcttggcctcccaaagtgctgggattacaggtgtgaaccaccgcacgcggccctatgattcttatggatgcctaggaacactggggatgtctgttttcatacagctggtggtcacagtttcagtgctattgtgtgttcttaggtggtttgcttttcttgctggctttcttcatggtcatagatcatttcaaagcctctgatatatcattgcggtttccactcagtcctctgtctgtttcattcctaattaattactttgacatgcccgtaacctgctcagaaatcactgggggtttcttagcagatacagaaacaaatcttcatccttcaaactggatttcacgaacctccaaagtttcatttctcctcgtctttgagatgtgatataatgtggttagaagacctggctttgaattctgccccttcctctgtagacctactaagttccagacagtgtctctgtatcatctcatgtaatgcttataacagcctcatgggatgaatatccccattttatagatgagaaaacagaggctcacttagctaaaatcacttaaagcctcagtagtccttggggtctggattttgcctccgaggactagggttgtcctcatatgaagtgattgcctgccagtgtcaacagaaggattcctagtcttgataatttggaaagtgcgctaagcatgagatcttgagatatatttccgacttcaacactttaatggtagtattaagaggtataattgctcatgcctgtaatcccagcactttgggaggccgaggagggtggatcatgaggttaggagattgagaccctgctggccaacacggtgaaaccccctctctactaaaaacacaaaaattagctgggtgtggtggcatgtgcctgtagtcccagctacttgggaggctgtggcaggagaattgcttgaactgggggggttggaggttgcagtgatccaagattgtgccactgcactccagcctgactacagagcaagactctgtctcaaaaaaaaaaaaaaaaaaaaaaaaaaaggcataattcagacgtggcagttgagagggtaaatagaaagcactaattaaaaaaaaatccaatttctaagactgcagagcatcagctattattgaaaatgtagacatcagaagggaaaaaccctttgttcagatacagtgctgctaagttagatgcagctgagaaatgggaatacatgcagtaaggtggttatgcagtatttttcaacagtagtccacggttgagcatggatgccatttaaatacattatctggaaaaatgtacatagaacttacgatttttgacagcaggaactcattatgccagaatttggattctcaggatagctgagcagaaagggcaggtggaagtctcccgaaatagatgagtgtttggacaaaaatggcagcaggtatactgtgccaagcattggcctttgcccaggtgccgggtacgatgtcaaggatgcaagctgaagctggccatatggttctcagagtctctctgctcattctgccctccactcagaggtagagacatgggcttttctttatttgcagcagaaggtaattgctttagacttaacaggctgcatttgaccgttgactcaccattatggtgtattatgaaatgaagcctcagccttggtctcccagagtagggggcgggggagggcggcagggagaaagggtggtgcctgaactatcaacacggcacagtttaaatgtcaggctctgcaatttacaagtgatctgagattcatgggaaatgcaatggaaaagtcactgccgagtccctctccctcatgttataagattgagtgtgtcataaattttgtgcattgctaagttcatggtgcttctgtaagaagacattaaaaatagaactccttacgtcctcgattcttacctacagggcatgcaggccaaaagtctacacacagaagttaagctggtttttaatcctgtttttcgttctggggctgtactcttaaaagccaaacactttttcagagacattctgtgcccgatatagcttcattttgttaatagcagaagtgaatagaggcaaaaacaaaccaaccaaacaaacaaacaaacaaacaaacaccctgaaaatacaagcgaatgcctggataggaattcaaagtttcattgaaaataagatagaaataaatcactaaccgtacttgtcttacctgtgtgatgtggatattacataacttaatattaggtagaatatccaaactattttgatgaaatatgttgggagagagagattttttgtttcatcagagagaagttttgcttttccatgaaggtacagcctcagcttccctagagaaatctttctccatagaaggaattatctgcaaagggtgggttgctgagggctaaatccattaaaaccaatttgaggaagagctgttacttgctgaggatgggaaaaaaatatataaaaagctcattacctagagcaaaatgattgctttaggattaagaaattgacagttactgtttaattataccagcccactgaaaactcacagactaagctttctagacacttaagcatatgtgcatttgttattgtagcaattggggtaaatttatgatcataaatgccaataacttgaacagtatccaactagcctttgtgtgaataggtttattgtgttcattttacagggaaaacacagtctttctatcaatatgaccaagatttcctcgattttcttttattctcagagttctgtttaattgcctgcaatctttttgatattaggctcttcattcatttttttgtccattagtagtttcactaaggaaacatggttctgtagggatgcgaggctgtgtttcttatacgtctgctcccctttgggtctgagatcatacatacctggcttgtggtccagtgcaagctccctggcagcttgggaaatgcgtcttcagcagacttcagccttactttgttttcaggaatgtggcaggccaggtcgcactaacacagccttctgtaacaactgtctcagtgctgactgagtagttaaggtaaatattaaaagctgagagagccagtgcctttatacaaaggctggagtgtatcaaaagcctacctagagttgtgcctaggcctttcctgggccttgaagcatgacaaaataatgaaggaattcttaataggaaccgtttggggttaaacaagttttattggggttgtgaagatactccccaggtatccacaaacaagtttattcggggtttgaagggactccccaaacctccatgatttagcaggagacaagataaggataatcatcccagcacctggacccatttagattaagtaaatttactgaggctgcagaggaaggtcttcaggactcagatcttatagatgagaagttaatcacttacgtctttagaggaatgcacacttacaggtagacatatagcttagaagctgtataagctctggaaaactttctaattttaagttggtctggtgatatttcccaggccttctccctgtacccggttacaggaataaactcccttgtctcccagttcacctgcatcttattttggggcagtgagaataagcattccgacactcagtttggcccgggaacaggagggcaagacagcttttcttttgtttattgctttgttgcctgctacaaagtaggcgtttaataaacatatttataaaaaaaagaatgaaggaagggagaaaggaagggaaggagagaaggaagaaaggaagcagaaagagaggaaggaaggagcgagggaagagaaaaagaagggagaggccgggcacggcggctgacgcatgtaatcccagcactttgggaggccgaggcggatggatcacctgaggtcgggagttggagaccagcctgaccaatatggagaaaccccgtttctaccaaaaatacaaaattagctgggcgtaggggcacatacctgtaattccaactactcgggaggctgaggcaggagaatcacttgaacctggaaggcggaggttgcagtgagccgagattgtgccagtgcactccagcctgggcaacaagagcgaaactctgcctcaaaaaaaaaaaaaaaaaagggaggggataaagggggagagggagagaagaaccaccctactaagttgaagaaagctgagtcctgccttccccatgtcatgccaacagattgtgtctcttaaaagagataaacaagattaattttggcattctttattcaaaaggacctttagactcttctttctggagaatttcaaggtcatataaaccttccgcaaacttagttattttaggaagtaacagaacatttcactgcaataatgaagtggttataatcttacattaagtaactaagtagaagaaaattggctgggtgaggtggctcgcacctgtaatcccaacactttgggaggctgaggtgggcagatcacttgagttcaggagtttgagaccagcctggccaacatggtgaaaccccatctctactaaaaatgcaataattaggcgagtgtagtggtgcatgcctgtaatcccagctattcgggaggctgaggcaggagaatcacttgaacccaggaggcagaaattgcagtgagccgagatccaaccgctgcactccagcctgggtgacagagggagattctgtctcaacaaataaacaatccccccaaaaccaaacaaaaagtaactaagtagagtaaaatctactttcataattcaaattccatagaatggttttgtttttctttaaattctattgttttagaaaactatacattttttaaagtgtgatttgactagtaataatatgagaactttgtacaactaaacttttcagaaacaaagctgttgtacaaagatatgccatcatccctggggagattttgagtaaatattctgtatgtggctcccccaaagtatctaaattcatcctaaaaataatttcagggaagacgtcatgggagttaataattagggttgttattagctcttagcgttgagcattttaaaaatccagtgagtgcctgcattatttcatacacttcagattatctgccttttgcaaacacagctgaatgtagttcatcaaatttgggtatttataaagataagcatagcccaaactttcgtggttgctagggcacactcaaatatcccatttcaatgaagtctgacaagaagtcactcttgtttttagattagctctggtcacagaaagtaacacagaatgatacaaaacagcccgaagaagcagctggctatggagaggcaaattcataggtgcctttttttccttgttaaactgagtaatcaaagtttagcttttctaaaaaaaaaattcctggaaacatttgctcatatgctgtataacacaattttgaccctttatcattgcaattcataataaatgtattttttgtcctctagtttccccaagaagttagctcctaggtaataaaattatacacacacacgctcgccccccccacacacacatttgcactaaacttctttacaaagaatcatttgacagtagccgtataatttaatgtttttcatctaatgctcagaatgaagcacaatatcaaattatttttgaggttttcatcttgttcctctgattttgattagtgagcattttctataccctagtcactaaattgaaagggatcaccaaattttatacatgctaaatggaaattggctgggtgcggtggttcatgcctgtaaccccagcactttgggaggctgaggctggcagattgcctgagcacaggagttttctaccagcctgggtaacatggtgaaacctcatctctacaaaaatacaaaaattagcgggacgtgtggcacatgcctgtaggaccagctgcttgggaggctgagatgggaggatcgtttgagcccaggaggttgaggctgtactgagctgagattgcaccattgcactccagcctggatgacagagtgagaccctgtctccaaaaccaacaggaaacaaacaaagaaacggtaatgtaaccttgacatgtaaagggcagaaaagaatttttacaaaagatattttattttaaataaaaatgggtactaggtcgaatacttgggtgacaagataatctgtacaacaaaccccaataacatgagtttaccgatataacaaacctgcatgtgtagtcctgaacttaaaaaaactgttttaaaaattaatgcttcatttggtaaatcaaccaagatagctgcaaattagtctagagtgaaaaattgataaacttaaaaatcgattaacacattttaagggcataatatgatattgttgactataagcactacgttgtacagtagatctctagaactaattcatttcacacagtgtaacttcaagctaattgaacaaccaccgattgtcccctccccgtggctcctggttaccaccattctcccctcagcttctatgagcttgtctattgcagacactttgtataagtagaatcatgcaatgtttatccttctgtgactggcttatttcactagaataatgtcctccaggttcataaatgtacaaatgtcaggatttccttcttctttaaggctgaataatattccattgtatgtatacacgacattttcttcattcatttgttttagtcagttctcacattgctaataaagacatacccaagactgggtaacttacaaaggaaaagaggtttatagactcacagctccacagggctggggagacctcacaatcatggctgaaggtgaaggaggagcacaggcacatcttacatggctgcaggcaagagagcttgttcaggggaactgccctttataacatcatcatctcatgagtcttattcactatcagagaacagcatggggtaaaacccacccccccatgatccaattacctcccactgcgtccctcccaatacatgtgggcataatgggagctccaatttaaggtgaaatttaggtggggacacagccaaaccatatcactgttcatctgtcattggacacttaggtggcttccatattttggctattgtgcttaatgctgcaaaaaaacataggagtgcagatatttctttgctatcatgacttcatttctttgtatatgtacccagaagtcggattgctggatcacctggtaatcacatttttaaatttttttttgagaaacatttatactctttttccatagtggctacatatctacattctattcagcaatggcaaaagggttccagtttttccacttccaggccaacaattgttttttttttttaatttttcatttttttgataataggcattgtaacaggtatggggtggtatttcattttggttttgatttgcatttccctatgtttagtgagctgtattatgggcttaaaatttgctaagatttccctttgttaagtgttcttaaccacctccatgttaagatctcatagtaaatgttcttaaacaccctctaccccactccacatgtccaaataaagggaaatttttggatgtgaaagataggtctgttcctatgattgtggggatggtttcacaggcctatgcttatgcccaagctcatcaaattgtatacgttaaatatgtgcagtattttgtgtgtcaattatacctccataaaaccataaaaatctataatattcttatgtgaaaggctagtgtatttatggacatatctcagacacattttgtgactagttatgatgagtcagaatttgcatctaatgaatttctttaccagtgttgtaaattctcagaattagttacataccctaatatctaatgggggttggccacaagttgataactaagccttcatcccttaatatcatctactccactgacttccagggctgagatgaactactcacagcatgcatatttaagacaaaaatgactctgatgagcaggtattaggttggtgtaaaaggaattgaggtttttgccaaatatttttgcaccaacctaataaaattctctcttgtatctgggatgggtcatgggccccagagacactgtaggtacttctatctcttaactttgaattagttcaatctaatgtggcatttgggaactgaaaaaccaaggaagttcattactgctattattattttttccaagtgtatgctaataggaaaaactgcttagcccaaaatacgtgtagcatgttgaattagctgaagcatttcccccgtgtttgctttagaacgtaatacacttccgttttggaagtaaaatgacaaatttttggtgcacaaacatgttaaaggctattacagaaaatatttagaatgcataatcttcctggattcctattttattgtaagtgtataaattttaatagagtttttatattagttgttcctcccaactaattatttttaaattgctggaatgttttgaagcagaaccataaaaggtatatattttttttatttgatagggctctttcaactgcaggtgatagaaaagcaattcagcaaggttaaatgaaatagaaattggtggagggcctggaggtgttacactatgggtactggcttaaggcacagcatgatccaggagctcacatcagtgtagtgaaggttcttttctttttctgagacagagtctcactctgtcgcccagagtggagtgcaggggtgcaatctcagctcactgcaagctccacctcctgggtccctgccattctcctgcctcagcctcccgagtagctgggactataggcgcccgccaccacgcctggctaattttttgtagttttagtagagacaggatttcaccatgttagccatcatggtcttgaccttctgaccttgtgatccgcccgcctcagcctaccaaagtgctgggattacaggcatgagccacagcgcccggccatcaagcttctttctctctccccctctctgtttcttgcacagctgtacagactttttgtatgtagtaagcatgtttacctgtgactagtaattccagcacaaacatttcacccccttatagctctgcagatattttctggaatgactggagatggcctgtcttcagtcatgatccatccctgaaccaatcatgataaaatctctttggttggttctaccacatgcattaatttctgctagagcatgggggtcctgtgaaggaaccaaatatctatgatgcttgttaaagacagaatgaaagactttactcaagagggactatcgtgataggtgaaatggggtcttgcagtgggggagaaagattgggctcaattctgaacgcaacaaccaaaagtggtgatttatagccaggaagtcaagtgagggtcagtggatggagacagcagaggtaagggaggattctgagtaaatgaactaacaaggttcttgctaacactggacaatgcagaggcagcacagaagctcaagcgtcaggcctcacggggaaaaggattcagatgagtctgaaatatgctgagtttggtggcttacgtctgtaatttcagtgactcagaaggctgaggtggtaggactgcttgaggccaggactttgagaccagcctaggcaacatagcaagacaccatctctaaaaaagataattaaaaaaaataaaagaagggtctgattggagtctggttaaggagaaaatctttgtcagtgcccaccctgaatatctggaacacgaacctccagaacagagagggggttctttcactagagaagctggatggtcaataataaagaatatccctgcttctggtgctcccatttatcacatgcagggaatgaaatttgcagaagtgacatgacttgaacaacgtcagacacgaagcatggaggtgaaattaaccaaaaggttgaagttaaaatgagtactttgcaatgccattaccgatgcataaactttgatgagctttgagaaataagatcaccacattttcatctacttttccagggaggtggaaaataaatagagaaatactcatttattcatctgtttaacaaacatccattgatattctttatgtgctaggtgctgtgataaacactacagaaatagcagagaacaatacagagaaaaagccatgtcttatgaatcttacattcttatacaccatcagaataaaatactgctttagaaaatatactgtgtaccttataataatagaacacaatctgttgtttctgagatgtgaaaagtcaattgtaagatttacgccatagaacaaagatgtaattcttgttacacatacacacacacaaagacacacatttaatcagggcataaatcaagatttttgtgatattaatccagtgcattcaatacagagttggataatctgttgctatttcaaatgtagttcctccctccttaaaatgattaaatcaaagtcccagaaggaacttggggaacttctaatcggtctccatgtcgtggacaaaaattaactgaattaactgtaactatctcaaatcaagacacacaataataaccactgtttattctgtgcctgccagtcactgtgcagataatttattgtgcactgtctcatttaatgcttgtggcaacctaatgaggcaggtacatttgattattagtcccattttacagtagatgaaacagaggcttatcttctgtaaagaaaattgctcttaaaacacagctcttggccgggcgtggtggctcacgcctgtaatgtcagcactttgggaggctgaggagggctaatcacctgagtttgggggttcaaaaccagcctgaccaacatggagaaatcccatctctaataaaaatacaaaattagccaggtgtggtggtgcatgctctatcatcccagctactcgggaggctgaggcaggagaattgcttgaacccgggaggcggaagttgcagtgagccgagattgtgccattccactccagcctgggcaacaagagcaaaactctgtctcaaaaaaaaaaaacaacaaacgcacaaacacacgcgcacacacacacatacacacacacacaccccacctctttgggttacatatgctttttaactgtttgaccttcggtaggtcagtaggttagcgagtgcccatgcagtgtttgcctgagcttttgcatcagccttgcctgtttttttgttttttgagttagggtcttgctctgtcacccaggctggaggacagtggtgcgatcatagctcactgcagcctcgatctcctggcctcaagtgatcctcccacctctgcctcccagtcttgccttttaagagccttaggactcttaacctgggaaatctataaaattttttgttatgtataaggaagaacacaacttttcttctgtgagtactgcttcaaagacacagagtccaatgtacataggcaggtggatagacaagctcgctgtcaaacttgttacatagatgaaatgggacagatggggtcattcatctaaagggttcttggtaaaggtacaaaaagcaaaaccatgaggccaaaaacgggagcagaaacagttggcactcagtgagtaggctccaaagctctggctcaaggtgggaacatggaagccaatggtcaagtttgttgcacagtgcacttaataagatgaacagcagtgctagaatctggaggatcatcatccctggagcttgacagccaatatctagcctgcttgagagtgcagatgaagcgctcggcaaatgtagttttatttacagcttcgtaagcctagatgggtaatcctctgtggtgtcctttagagggaaacgtaaaatggggatgacgactttaaataccttccagagttagatggcttttagacaccaaagttcagcctcttgcaacatattgcatttcagcccctgccacggttctctgctgacatttcagagatgggcagacaccatggcattgcagttgacatggcagcttggccaggtaggagctcacatatggagcatttcttgctttaggtgttaaaaaacaagtcatatctttaaaaggtcaccgtggtttgtactaactatatgactattgaaaggcacagtttggggcaagcctgtttattatttttcaaattagagaagtgatattgcgtcactgctgcgaaccaggaagggagaatgagaaagaaaatcacccatgaccaccaccatccctcttggaattgtgtcgtgctctctagcctccttcctttaagatgatggtttctatggaaaattgctcttaaaacaaacctccttaagttatatatactttgcaactacatggtcttcggtaggtcaaaaagtgcccatgcacttttcccctgcgctcttgcgtcaaccttgccttcttttatttttacttatttatttatttatttattcatttatgtatttatttattttttgagtttgggtcttgctctgtcacccaggctggagtacagtggtgcagtcatagctcactgcagcctcgacctcctggcctcaagtgacctcccacctctgcctcttagagcttttgggagcttgcatgatatgacggttgtgactaatgttaggaacatccaaggagtagacattggaaggactcctctcatgccaccatgagctgttgcccccaggaaatgagtgaagtctcagtaaaatggagagaactttaattcccgggtagatgtatctgaatctgagactgaacattttgttggtaacacaccagttatcaggagtgtcttgatcatgctcatctttgtctaatctttagatttctcatctttccggggaggttaagagttgctgtgtcctttctcagtcccaccacttgaacatgtggtaacatgtatgaggaaatgctttgtacataacaaatcatgtgaaagtaaaggattgtcgtcatttttgccattgctattaatattattacacagggtttctagtatattatgttggttaagagcaagcctctagagcaagcttctccagcccatgtcccccacagggtgcatgtggcccgggacggctttgaatgttgtccaacaataattcataaattttcttacaaccttatgagacgtttttgggggatttttttttttagctcatcagctgtcattagtattaatgtattttatgtatgacctgagacacttcttcttccgccgtggctcagggaagccaaaagactggacacccctgttctagagccagtcctaactctactcatttctacctagctgtgtgaccttgggcaagttagttaacctctctgatcattggcttctcctttagatgctgctgcatttttacctctctcataagattgctgtgaggaggctgagacaaggcagggcatcgtgcttgcagcaacaccctgcacgtagcaagggtaccacaaatggtagctatcaatgttgttatttgatgatccagaatatgtattgcttttgtcatcctttccctagtctttcatcattctggattttccatgtctttaagtttgttgctgtcttagaattagtagattttcatggttctaagactctatctgaaaactgtgcatggtggatcttgttaatgtggtaaaaatgtcatctgtcacagcatcccagttcatgatttaatttatccttccacagatagcctttattatattagcttgtagtgtatatttaatgaactagtgtaaaagtcatttttctctggctgggtgcagtggcttacagttgtaatcccagcactttgggaggctgaggcaggcagatcacttgaggtcaggagttcaagactaacctgaccaacatggtgaaacctcatctctactgaaaataaagaaaattaccagccgcattacatgcctgtaatcccagctattcgggaggctgaggcaggataattgcttgaactggggaggtggaggttgtagtgagccaagattgtgccactgcactgcagcctggacaacaaagcgagactctgtctcaaaataaaaaataaaataaatagggagatagggtcttgctctgtttgccaggttggagtgtggcagtatgaatatggctcactgcagccttgacctcctggcctcaagtgatcttcctacttcagcctcctgagtagctgggaccacatgtgtgtgccaccatgcctggctatttatttttatttgttttttactttttgtagagatgaggtcttgctgtgttgtccaggctggtctcaaactcctgggctcaactgatccaccagcctcccaaaataagctaccactcctggctgtaaaagtccttttgaaatggtacaggagttcaagaccagcctggacaacacagggagaccccgtttctacaaaaaaataaataagttagccaggtgtgatggcacacacttgtgatcctagctactcagaaggctgagatgggaggatggcctgggctgagcagttgcaggctcgttggagctgtgattgtgttactgcactccagcctgggcaacaaagcaagaccctgtctcaagcaaaaaagaaaaagcctttttcttgtaatttttaaataattccttccaatacaaaataataagtgtctagtccattgagaattaatttagaatgctcatgtgtcttggattgactttcaaaaccctgattcttaaaccatttgtgattgaggcttacaaccatgtaacaatcctcctaagttctgggagtgaatttaagtctggtaatgctattaaggaaagagagaagagtatgttttctaatgtacagtggatatcttgaagggagccatgcaggcatatttccaccttggtgtgtacttgatggggagaggcaaggagagagcgtggcaggttcagggtttgccatcccaatcttcccttggcgctgatccgtggtttccttcctgatcccacagaataagcaatgttgatctcgtgtggatcatctgttatgtaaaggtggttaataccaccattttctgcttcacatgaatcagagaacctgggtatctctgaccttcagggttccagctctcacctaagttcagccagtgtgtgaatcctctattgacctactgggaccacttggtagattgaccacagctcctgttatgcaccaagcattggcctgtgtgctcttgccagcaaaacaggtgtgatcctcagggagcctcaagtctggagggggaggcaaacattgattgaagaaacttacaatgaatgcataattaagatagggatatttactgcaaaggaaaaataaaaagattctttacatcaaatgacacatagcaccaacttgggctgagttggaagtgactcgtttatgaacaggggtatatatttttaaaagatgtactcttctctgaatgaataatttattaaatatgaaaagcaagagaaatactattaaaagaatgccacatttttagggaaagtgttgttgagggttcgaaacagacttttggtaaccggccaattccacaggctggtgccacattttcagtgccctttgatgtgtgtacgtgaaaaagctgcttgttttcctgtttaatatcaatctattaattttaaagtatttgaagagaaaatcaaagacatagtctgcatttggaaacacccagaaccacaaatctaaatcctagtaccaccaatttgaagactgtttgtcatggcttgaagcctcctgagaggggaattttatttacttgacggagtcatgtgaggttgattggtctaataaaactggattttaaatgaatgtggagcatggtgtccctttgccctgggtatttaaaaatagaccaatgatttctcatagggcgtctttcagatacactttagcagactgatgaaggctgttcccgggacacatttaaatctgaaacaaaatgagagtttaacaaggtgtgttggttcaggttaaaagcgcctacccctttcagctcagccaagatcatctctcattggacaaggttcccccaagactggctgggctcgtcccctgggtgctgaaatgattagtataacattccggagttcaggtctctgttatcttgtttctctgtcggatgcctgggaatgtgaatttgcctacacattttgagacatttttacactaggatgcttctgagctgaagatgaaggtggttggttttcttcctcctcttccccttttcaatattgtagggaccaagtggtttgttgctctctgctgccccctgttgctcatgaatgggaacagctggttttccactgaaggtgattcttaaccattacaaagagcttcccgtgaggttgaacctggggttcctagcttcatgtgaggttggctgattttatttatttatttatttttgaaactgacttttaaatgaaagttgagctaaatggggaagaaggtatctagcaatagcagaagtcccaaggttaatggaatacccaaagaacaaagtgaacagccgtgtgcctctctttccattgttggtagattccagctacctgcagctacgcttggtttcttgagagtcctagtccttgtaattgagccctggagttaagtccatttgaacaaacatcctcctagtcccaatttattccaggtcctgcatgagtggctgggattttcaggaaggagggattatagtcacatggtgtgtggttaatattttgagtgtggagtcaaagcatagttttgaatatgagcttcaactgttttcaaccgtatggctctgagccttggtgtctgtgtctgtataatgaggattttggtggtacctgattcagaggttgttgtgggaaccaatgagaaatttaaacaacttatgatttgttggtcacttaccaataccagtgcttttttttttttttttttttttgagatggatccttactctgtcacccaggctggagtgtagtggtgcaatctcggctcattgcaacctctgcctcccagattcaagcgattctcctgcctcagcctcccaagtagctgggattacatgtgcctgtcaccacacctggctaattttttttttttttttttttttttttttggatttttagtagtcatggggtctcaccaggctgatcttgaactcctgacctcagagtgctgggattacaggtttgagccaccgtgcccagcctccagtgcattttaggcactatgcttttattagctttttaatcctcagtaggacagcaaagatgcttgtcttttccctttcaaatagggctaagggctaacagcccttagcagaccttctctttatccccttgaccaggtttgtatcacatgcctgtgcctaaaccaaatgctggcaatagggacggaatgataagctttgctttgattagttagaatgattcccaaggaagggacaatgttctctgagcacacagagaatgatcactcaaatagaactagggctgaggcaggaagagagaataccctgaggatatcagtttggcttgtaactagcagggcctaccttacatagctgcaagatgatgcacttggacccaatagcccagatcccacgggtgtcataggaagtgcttatcacggagcctagcccatagcacccctgctctacagactcacccaatcactgctctcaagagggtcgtgctgtaatggggaagactgatccatcagcaaatttttgtttgtgtgtttgtttgtttgtttgttttttagatggagtcttgctctgtcacccaggctggagtgcagtggcatgatctcggctcactgcaacctcctcctcccaggttcaagcgattctcctgcctcagcgtcctgagtagctgggaccagaggcatgcactaccttgcccagctaagtttttgtatttttagtggagatggggtttcaccatgatggccaagctggttttgaactcctgacctgaagtgatctgcccgcctcggcctcccaaagttctaggattacaggcgtgagctattgctcccagcccaaatgtttttatactaaggtggaacatgctttattagctgtagtcacagacatttatggagactcagaagatccctcatatttaaaacatgtgttcctagatatgctgttgaagtttatttctttcaactgcatatcattacttgctttcatgctctctttggtccatttttggttttggttttggtttttgagatagggtcttgctttcttgcccaggctggagggcagtggcacagtcacagctcactgcagcctcaacctcttgggctcagatgatcctccagcctcagcctcccaagtagcttggaccacagacgtgcgccaccacgcccagctaattttttaattatttgtagacacggggtctcactgtgttgcccaggctggactcaaactcccaggctcatgcgatcctcctaccttggcctcccaaagtgctgagattataagtgtgagccaccagacctggccccccttctttggtctcaatccctcaactccaatatagcccttttcacccaccttcccatcttctctaaccccgggggacactggcaatctttaagcagaagaattggctgcctgaaagcctgtagatttatttggaggatgggtcaagaagaagtctcccaaaggagcttgggggaattctccttttgattttgttattcaaaaatgatgtcaaattttagaaaatgagagaaaatttagtagagtataacggttaaagagtctcaactttgctactcaacactttttgaccctgagcaacttgcacttaggggcctgagcttttcaatctgtaaatacggccaataataatacctccctcttagggcactctgagcagtcattgagagagcacgtgtaaagtgtttttgcacagtgcccagaaatttgcagtatttaatggtccttcctccttatttatttttattacttgtttttgtttttttgagacagtgtcttgctctgtcgcccaggctggagagcagtgatattatcgtgactcacggcagcctcgacctcccagactcaggtgatcccttcacctcagcctcccaggcagctgggaccatagctatgaacaaacacgtccagctatgttttgtattttttgtgaagacggagtctcaccatgttgcccaggctgatctccaactcccaggctgaagcaattcctcagcctctgcctcccaaaatgttgagattgcagacaaaaaccactgcacctggccccttcctcattctttttgaagtattttagctttcaaaaggtcaaggaccctttataacggtttgctagtttagaaagaaaaaaaaacagtgacatggtgaaaaagtaagcctgctctctctctcgttttctatgatgctctatcgggattccttggttaggagataaggtcaggcattctagggtattcagagggcccacctcttcatggggaagcccaggcttgcttgttcttatgttttgcaggacaaacgtcttagaactccacagatggggagtctgagaccctgagtgattaagtaattttgaccttgagctatctatttgacttgaagtggctaatggccagataagtgctctgagatgatatctcagtttctgctatttttcttgtgaggaaaaggaaaaaaagagcttgatagtgatcagagttcatttgcagaagtggtttccttttccccaatcaacttgtgagaattcacttctgtcctcagcgtgcgtgcttcattcattcactcatccaaagctgtctcaggcagagtgctggggactgggtgagggcggggagtctttccttcaggggcttatttctgctactgtgcatgttcttcctccacaacttgcagatccagacctctcctcctggcaagactttctcatttctttcacgtgacttttggttagaaacattggcctgactttgaggcttacacccagctttctttgtttgtgttttgttttgtttttgagacgcggtttcgctcttgttgcccaggctgaagtgcagtggtacgatcttggctcactgcaacctctgcctagcgggttcaagcgattctcctgcctcagcctcccgagtagctgggagtacaggtatgcgccgctatgcccagctaattttgtatttttatagagagggggtttcaccatgttgatctggctggtctcgaactcccgacttcaggtgatctgcccgcctcggcctcccggtgttgggattacaggcgtgagccactgtgcccgaccctcacacccaggtttttaggatacccttggttctatgcccctgatgacctgaaggcaggcaggagaagtagcagtgtgtgtttgtgtgtgtgtgtgtgtgtctgtgtgtgtgcatgcgcgcacgcacatgcacgtaaggggatgatgcagcccgtggcgcttaaattctaccctccccaagagttgggtcccttcaccaaacattaattttttccgaactccatcttatctctgtaaaatagaagtgctgattctttttttttgtttaagttctgggatacatgtgccaaacatgcaggtttgttacataggtaaacgtgtgctgtggtggtttgctgcacctattaacccgtcacctaggcattaagccccacatgcattagccatttatcctgatgctctctcttcccccagccccctacagaccccactgtgtgatgttcccctccctgtgtccatgtcttctcattgttcagctactacttatgagtgagaacatgtggtgtttggttttctgttcctgtattagttttctgaggacggtggctcccagcttcatccatgtccttgcaaaggacgtgatttcattcctttttatggctgcatagtattccatggtgtataggtaccacttacctagtaatagacaagcacatgcattgggtttgaattttgcaagtgagttgttggaagggaacccctagatgtcatttgcatgctaagtgctttccccgactgtgttatttgctgttcacccagccccgtgcattccatctctcacatttttcatgcgagtgttctgctgcccaaagttactctgtatagtgtttaatccactctgagtcagttctgcagagcagtcggtggtaaagtcctttcaccagcactgtctgagagttcctgtgacaacagcatccccgttcattgaggcctgagtgttcttttagattcctgcttaaacataaaccagcagtgaacgaagaatctttagtacctgacgtgaaatggagcccaagtctatactgctgactgggctgggggcgcatgcttggttggggttcattatatctgaactcatatcagggagatgatttactgtttctcaataaaagatggagttttgaagaataccttcttttgtgtgggatggaaacatgtggctaagcctattgcatcaccttgtacaaaagagatattcagcaggtatttattaagctaaactgaatcatgctcaaagacgctcctcttccctaagcaccattcagttgaatgtaacatgaaagagacaatgcatcatgttcattctggtttagggtctttccttgttgaaggctttctgctgtttagagaaagaccaagtatagcagccagaaaaacacagagctggcaactgagtcacaaagctgtagcaacacatcactcaagaggaacccttctcacaatgggtagatatacattgagtggtgatgtggagtgagacggattgatatccacaatgtcccaaaaggaaaagagacaaatttgacagtaatccaatttccgtcagcaaatttagatgatgagatgaaaagttagatttatgaggatagattcattctcactaggtattatgacgttagaacgcctgccaggtgaaaagtggcacatttttaggggaatttaggtccaacgaaaaggtgtttccttaggcagaaattgaaacatgatctgtctgtccagagttttgtgccttcgagcacacatgtgcatgcaagcttttaattaaccaagaagttcttctttaacgtttatatatatatatatgtatatgtatctacagaaataggataaaaagaagttcagaattcaactgtgattccaatatccatagataactattgctaacactttctagccttttttctctatgtgtatacacatatttggaaatttggaatcactgtaacctgctttgtcttaagatagcatgagaatttcttcatgctataaatgtccttccgaagtgtaatactttaaataactatatactgttccattgtatggatgcagcataggaaactcattccccttggctggatatttatcttactttttttttttttttgagatggagtcttgctctttcaccaggctgggtgccgtggcgtgatctcggctcactgcaccctgtgtctcctgggttcaagcaattctcctgcctcagcctcccaagaagctggggctataggcgagcaccaccacacccagttaatttttgtacttttagtagagatggggtttccccatggtggccagaatggtctcgatctcttgaccttgtgatccacctgcctcggcctcccaaaatgctgggattacaggcgtcagccaccacacccagccttatcttatttcttgtataaaaactcctgcgtgtgtgtgtttgtgtgtgtgtgtaaaacttttattctaatcaagcatattttcacaatttctacagcagccacaacaaactttctacaaggtgaattttagagagaagaggttcaccgtctcgttatttcaacctcatcatctgtaacggtggccatagaacctattctgatttactctaccagaaaacttaccctcttagttactttttttctttcattttttttttctcagctgtattgcctcagttggatcatatctgtttttcctcaggaatgtttctgaaactatgaacaatatggaacatgttgtcaataagggtattttcacagatgcgtttttgtcacacagtgtttattgccagagaagtatgattagtcatgttctctgatgtgatttagtaattgtcatttgtctattattaggtgaaattttctagctgaatttttccaaagatgaataaacaaattaatcattcactttcctatccaccattcaaccatccatgcatcctccctcccttccttcctcccccttccctttccttttctccttccttccttccttctgcatttattaaataccaactctgtgttaggcagtatgttgcatgccaaagacaaatgtataaactagatagaatggtggaatgctttccttctgagcactcacattttaatgctgggaattttatgctgaggttcagtgcttttcagggagccatgaaccccctgcaatgacttgcagactgtaggtattacatgtaaaacttgtgtgagtaatttcctgaagaaggggtttcattcttcagatcctcaaaaagatctatgatccggccaggcgcggtggctcatgcctgtaatcccagcactttgggagaccaaggcgggcatatcaggaggtcaggagatcaataccatcctcgctaacacagtgaaatcccatctctactaaaaatacaaaaaattagctgggtgtggtggcgcatgcctgtaatcccagctactcgagaggccgaggcaggacaacagcttgaacccaggaggcggaggttgcagtgagccaacagagtgaaactctgtctcaaaaaaaaaaaaaatatatatatatatatatgatcctaaaaagacattgatattaaagagtaatgatggggaaggaccaccaagtgatcatttataagatgctgcgagaattgctaaagttgagggatggattctgcattccaggagaacaaaggaggtagatcccgattaactgagtagcaggatattgagggaagcttcttgtaatgattcagctgagtcttacacaatgaatgagacttggatagatgaacatgcattaggagacatcagttctggtcagaggaaacagcaaatgcaaaggcccagagccataagagattcagatgcactaaagaaatatcccatcatttaggatggtcggcatatacacagagggcctataaggaaggagaagaaactgaggttgtagaagctggtagggactgcatgctgaaaggcattgtaaatcttagactaaaatctgtgggagactttgaacaacctaaagattttaagcagagtgatgcaatgcatttgtcttttgaatgcaaatattgctggggcgggtcttttgtgttatcagctaatgatttagttggtggttacctgagtacggggtcaggtgtatgttcttagctggtggaggccttggggatgtagaagcacaaacgggtaagtcactggaaaggtaggtgaaagattggccaatattagaggtgggtgtttatagaaatgaatgacaatgaccactgagtagttcctaagacaccatcgctttgcataaatcatgtcattgaatcctcttaagaacacacaaactcaaatattgtgtattagtttcccatggctgctgtaataaatgatcacattcttagtggcttgaaagaatatggatttagtatcttacagttctggaggtcagaagtcctaagtgggtctaactgggctaacatcacgaggtaggcagcaataagaaactaatcttttggtggctttgggtacagtccctttccttgccttttatagccactagaggcctcctgcatgccttggctcgtggccccttcttccatcttcaaagccagcattggtgagttgagtcctttttcacatcatgtcactccattcttctgcctccctcttctaggttttaaggagacttgtgactacattgggcccacagagataatccagaatagtctccctattttgaggtcagatgattagtaactttaattccacctattcccttaattccctgttgccctgtaaggtaaaatatattcacaggttccaggtatcatgacatgcacatctttaagaggctgctattctgcagatcacatatcatcatctccactcttctgagtgtagcagcaagcagtcttttaggttaatgtgctacagctatagaaagttgaaaccaagatatgaaccatgatgcttttggctccaaagtcagcaggttctaaaaggtaaaccttggtccccaattaatgatcaaaggcagtgggaaaaatctaacattctgatgactttgtagatcaatgagttttgtttcacaagtctaatgcattacgttaccatattgatctttactcttcagattctgaacacacctgtgaaagcagggtttactgttcttttgacaacctgccatctctaattagctccagggccccttagtgcagtaaacaaatccgctgaatgactcagtcctctttctcttttcttattgttggatccgttaagctgtacaaatgtagtctatggtggagggaggggtgagagcagaggggaagagaaggggtgcacagttggtcactacattatcctgcttctgctccaagaataaaagcaaaacttaaaaaaagtattgattcatatggtttgttcatatgtatgggaagcatgtgatattttggtacatcccatgcatgtgcaatggtcaagttagggtatttaagatattcatcgctttgaacattgatcaattctttctgttggcaacttttcaaatcttcttttctagctattcttaaatatataatacattactgttaactattgtcaccttactgtgctgtggaacattaaaactcacttctcctatctaactgtaggtttgcacccattaaccgatttgtcttcatttcccactccacccccacacccttcccagccttagtcaccataaccctattctcttacatctatgatacccacttatgaactcctttctcctggtccatgaagtctttaaaagctatttcgtcagaagaagatttgtctgacccccttccctatgtaaatgcagcacattgtcatactctctcaacacactcttatttctctttatagaggtcaccagatttttaactcctttacaggattttctacttttttatagggtgagcggtctatatctattttattgtcactttatcctttcactcctcaactgactacatggtaggtattcaaaaaaaacatttgttgaggccgagtgtcatggctcacgcctgtaatcccaggacttttgaaggctgaggcaggcggatcacctgaggtcatgagttcgagaccagcctggccaacatggggaaaccccatctttactaaaaatataaaaattagccaggtgtggtgtcaggagcctggaatcccagctacctgggagaccgaggctgggagaattgcttgaacctgggagttggaggttgcagagagccaagattgcgccactgcactccaccctgtatgacacagtgagactctgtctcaaaaaaacaaaacaaaacaaaacaaattgttgaataaatggtcctctagtgttttaatggcttttacttttgcttctgctactggtccttattcatccatctacctccccatctatctgtccatctacccatgcatctatgtgtctgtccattcatccactcattcctccatctatctacctacctgttcacacatccacctatccatccgtcctccttgaagacatacttaagagtacctagcaatccttctggagttccacattctcctctctattttcttcagcctgaagtcccaactggtacatgggcttggtgtgagggaactaataaatgcttatcatgagaataataaaagctaagatttatttattgagtgctagtcacatggcagccaagctctaaatgcttcacatgcattaagttagtaagtgtaggaagccctctgcagtaggcatttgtaatatccccaccctgaggatggtgaaactgagagacagcaaccatgggaacacagggagtaaggctgggatgaatccctggcaagcgaactgttaattctatgtctcctaccttcttgttttccctagcctgctgcaagtccagcttaaaggaaggaaagttctaataaattgaaaatgttaactctgtggactagacatcttcacgtgcttcgtgttcaacatgttataacttcaccataatacaaattaccatcatgagtttatttttgtatatggtgtaaggaagaggtccagttacagtcttctgcatatggctagtcagttatcccagtaccatttattgaatagggaatcctttccccattgcttatttttgtcaactttgtcgaagatcagatggttattggtgtgtggcattatttctgggccctctgttctgttccattggtctttgtgtctgtttttgtatcagtagtgccatgctgttttggttactgtagccttgtagtatagtttgaagttgggtaacttgatggttagaatgttctatttgcttaggattgccttgactattcaggctcttttttggttctatatgaatttaaaaatagtgttttttaattcctatggtgggaagaaagtgtggataaaaaactgcctatcagatgctatgtttatcacctgggtgacagaataatctatacaccaaaaccatgtgagatgcaatttacctgtatgacaaacctgcacatgtaccactgaccctaaaataaaagtttaaaaatattacccttttgtttgcttcattttgcaagaaaactggttggctatccccaaaaagatgcaattactgtcatcttcactgagtggtctgtaggtaaacaagcatctggagatgagtttaagtcctcatggtttaggattttaatatatactaattaaaacgagcaacatgttattattcaataaagaatagaagcaattgattttaaatcatagccaggtgcagtggctcgcacctgtaggcacatctacttggaaggttgaggtgggaagatctgttgagaccaagaattcaaggtcagcctaggtatagtgagacgccatctcttaaaaaattaataataataaaatcatagtatataatcatgcttagagtaaagatctggaaggatactcaatatactaggatttccaggttagaggggcaatgggggttaaggatagtgatcacatgcaactttaatcttgtctacaatttttctaacaaaaggtatttatgtattgtgtaattaagggcatgggacggtctgtgaattctgtaatcttttccttttcttttcttgcagcacagtctcactctgtcacccaggctagagtgcagtggctcaagtgtagctccctgcagccttaacctcctaggctcaagcgatcctttctcctcagcctcctaaatagctgggaccacaggtgcattccagcatgccccactcatttttttttttgtaaagatgggggtctcactgtgttgcccaggctgatctcaaactcctaggctcaagcaattctccctcctccgcctcccaaagttctgagattacagactggagcccctgtgccctgcctgtatattgtttgagaagtcatattcttcctcttctgcccgcccctgctggctttcgcaaaagagaaatcatgccgcttttttaggtaatctgtgttctgtggagggtttctaatttacttttaaagttagtggtcctcgacatgacttgtcccagttttgccattgaaaagaccccaaatgtgcatgagaaacctactgtgaaatagatttccagttttgacctgagctttgtcccaaggactcatctgtgtcagaggaggagatcctcccaaaatgtgctttccatggatgaggaagaccagccatttccctttgacggcctccttgcattttatcattccctgagccaccgttccaaaggaagagagaccattggggaaatgattttgagaagaggtctatcaactattccatttcttttgaaccccaggtggcacttctcagcaacaaggaggcatttaggcaaagagggaacagtttctatgtaaaacctaaaacgcttggactcacagagaaaggcagaattaatcactctctaaagtcaccaagagagaaactgacatgctcactagacattagaataccaacagtagcaagcattccactggaagcttgaaaggagttattttaggagaaataaaagaaagggctagttttgaagcaggtaggtcatagataagagctctggaattcagctccttctagtttttattccaagttctccagtgctgggagtttaagatcacaggcattgcatcttatcctatgactcagtttcctcatctgcacattggaaataatgacagtatcaacctcatagtgttgttgtgaggattaaattaaattatacctataggaggggctggccatggtggctcacgcctgtaatcccaacaccttgggaggctgaggcggatcacctgaggtcataagtttgagaccagcctggccaacatgatgaaaccctgtctctactaaaaatgcaaaagttactaagggatggtggtgcatgcctgtagtcccagctactcgagaggctgaggcaggagaatcgctggaacccgggaggcaaagtttgcagtgacttgagatggcaccactgcactccagcctgggcaacagagtgatactccatctcaagaaaaacaaaacaaataaaatgaaacacacatgaaacccagtggattccttagcacctaataagtatgggcccatacatatatcatcatcctcagcattactggaggttattaacagaaattggtgttaataaagtttaaataaacaggtggatttggaattcctttccaagtaaaacatttaaagtaactttgagggtgaatatacaaataagtgaagtcaagatgctaaatccttcatgggtttgtaagtgaccaggggatatttaggacatctcccttatttctaagagtaggagctcatgaaactccaacacctcactctttttacggcctgtgtctgtgcactttctgtggagctgattggacccttgggggatggccttgcaggtcagacagtcccagcatcttcttttcactctttctctttcagtttctgggttttcacagccaagggaaaggtaggcagaactggaagcaagtggaaatgctcggtctgccattcatctaggaaggcagacgcctctaacaagtttgaacctgataaagcctctgcctgtgcaaagaacttgggaagcagccagcaccgtgcttttttacctctgattagttcttcttccattctctcttctgcgatggaaagaaaaagaaaaaaaaaaaaagacatggagttgagacagcagagaaagtccaaaactgggtaattcagaggggcaggctaatgacccacctgagtctgggatcgttaccaacagtgcctggttttcactgtgacaaatatgaaggtaggcccacagttagtgagagagttgccttgtctatctcctggcgtgccttcccacaggctcccagtggagtctggtcatcagtcttctccctttggagcttgggcccagatctcagccacccaggccacgatggggaagagcctggcctgccccaaaggtggccctttcagagtttaagacgatggagatacaatggaagtctcatcatgtgtcactttgcctttgactccgtgttgccatggaaacagaacatggcttgttcatggtaaacgaccttgtcattgatttttgtatatgctcttaattattgtggcatagttatttataacctgatggggaaggaaatcccaggagaagagcattgtcctgctgaattattccatagtgggaaggagaaaagttctgtcccaaagaaaagaggagaaaaggaaaggaaacgaagatgaaattttcaaatataaataagtccttcaggaaaatcgttccccagatgcattattgcattatttaggaccatgtgcaccccactatgtttgctctcgacatttattttggggggttttgtgtagccgtgacagcatttcctcacatctctttaggactgctgatgccctgcatatcccctgtagaactttgcggatagttcatattttagcaatgattttggaattcctggctgaaataagaggctttgtgaattctctactcctatgatggcctttgaggaaattctggatctttggtttggaagttttgggattctgtgaaccaacactttcttttcattgggtttgatacagtggcatcaatcttacagtttatcatgtaccgatgtttaaaactctaaccattggttatctggttaccatcattgtcactacgaaataaaggattagagctataaaaatactaaaatagataatacccttgattatctaccctgtgtcaaatacatgaacccaactgctcaaactgtcattcattggccaggtcatcagcctccgctgggaaggagttggcactgccaagtcccagacccttcctcagacctactgaaccacctgttgcattttaatgacggctcacccctctgcactcctggtatggtttggctgtgtcccacccaaatcttatcttgaattgtagctcccataattcccatgtgttgtgtgagggacttcgtgggagataactgaatcatgggggtggtttcccccatactgttgtcatggtggtgagtaagtcttactagatctgatggtttgataaggggaaatcgctttcacttcgttcttatattctttcctgtctgctgccttgtaagacgtgactttcgctttctgccatgattgtgaggcctccgtagccatgtggaactgtgagtccattaaacttctttttgtttataaattactcagtctcatgtatgtctttatcagcagcataaaaacagactaacataacccccctttcttcctacccctgtgatttgggtggatattaaaattttgcaagccgccactctagagaagtaccactcaaaccatggtctgcagactaccagcattagcaaggcctgggagtttgtgagagatgcagattcttggtgcccatccaaacctacagaagcagaatctctggtggcaggaaccagcaatctgtgctttcaacaagctctctgagtgcttcttctgaatgttaaagtataagaacctctgctgcacagggagacctcactttcattattctcatttcacagatgagaaaaatgagtcagtaggaggaaaagtgattgactcaagtgcttaataagtgtctaagctaggatttgaccctagggcttgtgaatctggagcccatagactcaactcctgtgctatactgcctctgtgtctttggtctgtgttctcttctttttttttttttcttaccaccctccaaaattcttatttatttattttctatcaccgtacttactggtggagtggaagtcccttggaagtgggggacgtgtctgatttgtgcatggctattttgcgatttgccattgctggaatatttagcaagcatcaatgagtcctggagggcttttaaaccatagatgatcagggcccctgcttggtctaggatggagcctgcaattttgcatttgtgacaagctcccacggatgctggtgctcacttggcatagcaaggggttatgctatttttcaaaggcaagagaagtgtgcatgtacttgagaggagaaggggtcggtcaccatttactttgtgcctcttgctacccttcgttgcctggagttctacacactttgcaaactttacctcattaatcttccccaccctgggagggcctgtgtgacaggcactggtacctttatttcacagatggagaggcagcagtgccaaggggctgtgacaggcccaaggtcacctggcaagtcccttgcatggacccagaatagaaacgccaccgcctgccacaaacccctctcctctggctcctgtgaacctttgagcccccaagcctgttaagcctcttcctgtcctctctatcaatgcccacttgcactgcctcctaaattagctttgtgtctttaaccccagcctcgggaggcccaggttcaaggttagcactaagcaccttttgagttccttgtaagttggacgctggaataattctaagtcaagagcaattaattatagaagcattagtcctgcagaaaccctgcttcagtcttttgtttctggctgctgccaagggccatgcacattctctgtattatctttctctgcatgccttcagagtttatacattcatttccaccaaaaagctcatcatctgagacccttactacgggtacagatgtccagacaccacatccagctaaaaatccagaatcaatcactgttttactaacaagttcctcaggggactctgagacacacccatcccggaaaattcctaagtggagccaggtgcatcagtttccaggagcactaagtgtccaaccctgattggctggtaaataattgggagggatgtggcttgggttgagggatgtggcttcgttgaaggacggcctggactgcacttcgtaagccaccttctgtagttctgatactattaattcatgattcatatcaacagaggatgggctgggtagtcgagttcctggttctttattaggcagagaatgtttctccatctggttgagagtctgtcatgttgtatgagtccagggggcgacacattttagaatttgaaaataggtcgaacccgatttgctttctttattaggcagcactcacctgggggaatggataactccatttggttcagtcaaaatgaaaattggccaaagaaagtgttaagagggcctgccatttgtgtgagttgagccataaacattggcctgctttttagcttgtggttcattggtgtatagatgatttcatgatgacgtcagtaaagggtctatgagaacacaaactacaccgaaattgacatctgatagggtcctgttgtctatgtagccacaggaggttagttctgagtgtcttcatggttaaagaagaattcagtcaattgattatgtgattctatttttataaaatatccagaggaattaaatccatagaggcagaatgctgattgctgattgccagggtctgaggggatggggaagtgagagcaattgcctaatggttgtggggttttcttttggtgtgatgaaaatattttggaacttgatagaggtagtggctgtacaacaagctgtcactgaagtattcactttagcatagtacattttgtgactgtcacttcacaaacagagtcacaaacaaaattcatgactgtccttgattttgagaggagactgtatacaggaaagtgctctgtgacttttacgaaataagacaaataaaataaaccctaacccaactccgggcatccttcccttttctcaaagacctcaccctaatttaagagaacatgaataacaaatattttacttccatattaaaggagttcttttctctgtatgtcatttatcatagcaaacaataaaatgggtatgaatcatcatctttacaagaaggtggtgtaacagcctcattctgaatccaggagccatctctagataaaacaagatgcatggaagatgtgacttaggaatgttgagcacatattattctttttataaaatagcagagttgaatgttggggatgctctaaagtagtcaacttcagcttaattgaaatgtgatgcaggcttattgcattattgttttttttgttgttgtttttttttgttgttgttgttttttgagacggagtcttgctctgtcacccaggctggagtgcagtggcccgatctcggctcactgcaagctccgccttctgggttcacgccattctcctgcctcagcctcccgaggagctgggactacaggcgcccgccattacgcctggctaatgttttgtatttttagtagagacggggtttcaccatgttagccaggatggtctcgatttcctgaccgcgtgatccgcccgccgcggcctcccaaagtgctgggattacaggcatgagccaccgcgcccggccggcttattgctttattctaatgtgatgctttggtagacctgagcttcctccacacactaaacacaaaccttgcacttaatagactttgattgaaggtgcattcaaagttcaagatgatcagtttggattctctttttttgtcacataataacgaatatttattgagttgctatagtagggtccatactttccatacattgatctatctaacattacagcaacaccttaatatagagactattattgtttctgtgttttaaaagaagaatcccggtccatcaatcttaattaacttgcccaggttaacagtgtttgtcaaaatagcaaagttgggatttgaaccctgggtggcctgaacaccaaagcctgtactgttaccatcaccctcttataggaatgttccttaagtgttcttatgtgtaagaagagtctgagatgaagagtttcagagggatgactgtgtggccaatcttccctacaggcacaaagggatttttttccgtctcgaaattgtcagcctcctattctaaaggtacaggttcctcctatagagttttagggtcagatgtcagttttaccccaagtccaccactagctagcagtttgacctttgccaagctccaaaaaccatctgtgtccattttcttcctctgtaaaatgggtataatactgacttctgagaaaggctgttacaagctttcaaagaaatggtatttatgagaacatctaaaggctggagtctccggacccactctctcactttccccttctctgtcctcaaaacagcatgcaccttcagtgggtgtaggcctctgggtctccatcctttccccaccaaataatcacatgcagacagttgtaaaaaccacagagcattttcctgtacacgatgtcctcatactgaaccaagtcgttagcatccatgtgtggctttattttttctcacaaggcagcctggaaagaacaaatttatttgggtgtgatggttttgtatcttctactttttaaattattattattattttattatttttatttttttgagacagagtttcgctcttgttgcctaggctggagtgcaatgatgtgatcttggcacactgcaacctccacctcccaggttcaagtgatactcctgcctcaccctccggagtagctgggattacaggcactggccaccaggcccagcgtggctcatacctgtaatcccagcaatttgggaagctgaggtgggtggatcacctgaggtcaggaatttgagaccagcctggccaacgtggtgaaacctgtctgtactaaaaatataaattatttttattgtcctggaacactcctacccctgcccaaatcctgcacatatccacagctgcccttgccctcatctgccggggcagctgtagtgggaatctgtggggccagattgtccgttcctgggaggtgattatttggccagtccacgaatagtgcactgcagtaggcctggctctcggaggcccagggtgggagctgattgctttggcttgatcacatttcttgagagtttcacattctaataattaaaacccaaaatggtgtgactgttgcattggctgcattttgtttcctatgtgtgtagcagggtggtctgatttccttccttataattcaagtattctgaacagcagtatgagtttcggcctgaaggaatttattagggtaatcttccctctttcagccaaaaaaaaaaaaaaaaaatgcacccagaaatgcatttagtggaaacctctagtgacaagcaatattctttcttcctttctcctttcttccctctcactatctttccttcttagaaagaatgttgtgacatcattaggtctgtagtaagagtttgttaatttttctaagaaattatctttaacactgtataaacccagtttttatttcatatgatcagatttaagttggtgcttcagtctctaagtcttacaacggtgtcatttgcaacaacatcaatcattgaattgcacgtcaacggctgaggacatctttctctgcacaggaaaagtttcctttcaggcaggttgatctggatgttagtttcaggataattctctctctctctccaccctcccaccccttccagcagctcacgccacgtcttccctctccctctccttttatctacctctcatttttatgtaaagcattgtctttcagataatattgttcccttgtgaattttatagaacggttattgaatcattttcgcctcgatttccaagtgtgttacctttaccttgacttggtgaatcacagctgttaaactgtgtctcgtgattttcattttagagtaggtcctggtttttattatagaatatgctcatcttttctaagccttgtgtcctggcttgtaggacagggttggggttggaagtaacttggggtcatttggggttttttttagaagaaagtgatggagtctgggaatttctctgcaggcttcttagagtgttcagggccattctaatgctttcccttggttcagtcttgcaagactttcataattgtgagcaaccacagtgtcttcccctcttttggacaattaagggatttaaaatatagatcgaagttggacacttgttggtgatttaggagatgaacagtagcactgtgtgtcagatatctgagaacatgcaatatttgctcagtgggtagtgggataagccagttccatccaagtcatgcagcctaagaatgaagaggaggcttggggtctgaaccctgtgggtttaattctgtctctgacagttaccagttttgtgactgtgagctattactttcattctgcagtactcatatgacaaaagatgggagaagtgataatggtattcccttcataagtatttttgtgaaagttaaattagatgacatatgtaagatatctaacatatgtctgatgtatcacggtcacacaataatattataacttattaaatttattattactgttgttgtcagtcaggctaggttgatgctgtaacaaacatcccccaacttttcaggtacttaacagcatcaaagttgatgccttattcatacaaagccatgaacaagttttctagatcaagtgataacaagcagattcaggctccttccatcttgtgactctgctgtttcctggcttcagtcacccttgaatcatccaaccaagagacagaagcaagagccactgagctaaggatctgggggtgggaaatgtggaggtcaagtctggagtggacattcctcacttccacctgcatgccattggccagaaccagtcatgtgacctccatttcaccacagagtagcatgggaaagagtctccctggggccctagaaagatgaaacaggattggtgaggtccacccgccacagggttactttttggtacctgaaattccccttttttgctctgttccaatttggaagaaacttttcttttgactctgggctattacttcgccctagccattggggctcagcctctgtggtctcagcttattgtcctcttcctctgttcccagttcttgccttgaccctagagaatttcaacactctggtcctcagcctagcaggattgtccactctatcctgaatagcaacagtcatagccttctaattagggacatcataggtttctcccagttgaaacacacacacacacacacacacacacaatattatttttaattgacagacaataattgtatatgtttgtaggatacaatgtgatgttttgctatctgtatgcaatgggcagtgattaatggttccatttaaaatacgcttcttaagtataaggagaatatccttcatcagtactctttatattgcaatattaagggaaacctttagaacttaaagaataaataccttcttccaagagtcaagtgacactatcttggaaataaggtaatattcaaagtaggtttttaaaatggttttatagaggtataatttatataacataaaatccacctttttcaattttacaattcaattatctttagaaaatttacagtctaattttagaacactgtcctctccttaaagagagctcgcctccaagcccatcttgcagtcaatctctgttcccaccctcagccccaggcaaccactaatctatcgtgttcctagcagcataattcaaaatagcccagaagtgtaagcagtcaaaatgtccatcaactggtgagtcaacaaaacttgctatattcaaatactgtaatacactttagccaaaacaaacaaagagataaaacaaaaaaacagaatacaaatagaagctacaccacatagatgaacctcggaaaacattatgcacatattatgcaaagtgaaggaagtgagctgcaaaagactacttattatgagattcctgtttatgaaatgtccagaaaaggcaaacctaacgttgattttgattgcaattttccattaggcaaatacctagaactttcttttctaggagcctgaactactcacatgccttgggcctttggggctaattctctttaacataagaatggctaatttgttgcttcttagatttgctttgtcattttgtctaccaagggaagaaattcagaagccaagaaggagatggtgactttgccagagccatattaaaaaggaaaccatcttacagctcatcattcctctctcacctgaatcttgtttgatttctcaaagcccatgtgggaccaccctccatttttaagttactgttttggagaatatgtacagtgtctactggcacctggtggcaggcaggaatgtttaagctgatcatttgttttaaacgtaatccatttgtaacgcatgattcatctattgctagaaggtacttggcatcctttgcatataccgtgactcaaactgtgacaatgtttatagctcagaaggtaaaaaaaaaaatcagagttttgttcatcagaattatcacaaattccacatttttggaattgaagataatgccatcttagcctatttaagactggcattctagaaagaggcatgctgatgcaagcaaagcaaagacaatcccaaaaattaacctgttttagaaatgagcagccaaatgtctcctaaacttctatggttattttcatggacactaccttttattttattttatttttttgtttttctgcttataaaatactatgtactaattgagaaaaacttggaaagtagaaaaaaaatatatatatatatataaattaattcccttgtcattcctgtgtctagaatagttaataacatcattctgatggatttaccttttatttatgttttcctgtatgtatgtgagaactcaggcacttaattgggcttaagctgtatatgttccataccctgctattgttgcttgacattttattatggatattttcctccatgtcattaaatattcttcaaaaagataaacttaatggtcatagtaacccaacatttttggatacaccatcccacttgccaccccccagctctttacactaatattgctttagtcttttttttttccatcctagttaaaagctgagatgaaaatttgtaagtagagatggctgagcacttctccattttccttcaatggctcttaaaagtaaaataattggctccaggtatagacaatattaaggattgaaattgtctgtattgacttctttatcaagaatcaggtagttttggccgggcccagtagctcctgcctgtaattccagcactttgggaggtctaggcaggctgaatcacctgaggtcaggcattccagactaccctggccaacatggcaaaaccccatctctagtaaaaatacaaaaaaaattagtcaggcttgatgacaggtgtctgtaatatcagctactccactagggaggctgaggcaggagaattgcttgacccctggagtgggaggttgtagtaagccaagatcgtgccactgtactccagcctgggcaaaaagagtgagtatctgtctcaaaaataaaaaaaaaaaaaggtagttccatgctcttataaataaagaatagtactgcgttagcacataaaaatgggttgaccttcaatgagacggtcatggactttcgttcagaaagactttaggaaagtctcttcattgccaaggggtatggtccatctcttatggaagtatgcatatcataaggaattaaaatgactctccttcttttcctttttttgagacggagtgtcgctctgttgcccagggtggagtgcagtggcctgatctcagctcactgcaagctctgcctcccgggttcatgccatccttctgcctcagcctcccaagtagctgggaccacagatgcccatcaccatgcctggctaatttttttttcggatttctagtagagacggggtttcactgtgttagccaggatggtctcaatctcctgacctcgtgatctgccctccttggcctcccaaagggctgggattacaggcgtgagccaccatgcctggccacccctccttcttttaaaaaattcctgcagtcactctgaagaatgccatttagaacattcgagtgaaccaaacataatcagcagcccagagaagacctcttttacctgcctcctcttatgttgctgctgagatgaacacagtccttggaaagtggtggttgtgcctttgcttttttgtttttttgtttttttagttatgggccttgccattggtttcttctgggtccccatctgtggcctctttgcttatcatggcctggtgaccccctagtacctgatgatatctatagtaggtctgctaggaaaggcttggagtcttcctttcactacccatgaaatgaccctccaggcaagtcactttcctaacacagcattaataggtgttgcttctttgagataacctctttcttatccacatgctcagggtacatatctttgtgtttttgtttagtaagacacactcctctgaagctaaacttaatctgcggagatgtcggatgataaatttgtcccctactgtagtgtcataatatatcctctatgtattaattaaaatgaagttagatattgcttttcagacaacattagttcaagatgctttcagtacaggattaatacatgtatggatgcacggatggatggatacatagatgaatgggtgaatgaattggtggacggatgaaaggatgactagatgcatgggtggatggataggtgggtgggtgggtgagtggatggatggatggatttgtgggtgggtgggtgggtggatggatggatgggtgtttggatgggtgggtggatggatggatgggtggatgaatagcaatttctagatcttactgtctataccttactttgagcactgagaaggaaataattaatagttgattctattaatttatgcttccaccagtttcctggaaattgaatttcagagttttagccatgtttcctccaaaaaaatcattgcctttcttgccttatcaattaagattagtcttgaaaaaaatcccacctgtgatgtcacacacagctaccttttgctgttaattctggtgaaaatattaggctcactattaatatcaatacttaatggatcataagaatcaaatatcaaatgaagagaccaacatacatgtattacttcttaaaaaaatctttaatgactaggaatgtattttaatattggtgatacctaaatttaatgcaatatacatgtctctgttgttttttagacccaagctttttctccttgagataaagaatgatgctcagggtagtgtagcagagtggttatagaagagggccccggaatcagctttctgagttctgacagctctgtcatttggtactcgtgtgacaatggatctctgtttcctattctgtgaaatagagatactaacacttgtaaggtggttgtgatatgagggtgaaagaatgcaacatagctatgtgtttaatggagtgcctgtcacacagtaaatgctgctacagggtaggtggtgctgtgctattatgtggcattatcatcatttcctttattattaaatagcagaagttgggatggattaggaagcagacactcagaaaatatggtgagcttataaatgttctttggtgcaataaattgtcacacagttggtggcttagcacgacatttattctttcacagttctagatgacagaactctgaagtcacatagaggtgctactgggcctatctccttctcaaggtcctgggggagtgtctcctccttcctcttctagcttctggtgggtgctgcccttgactggcttgtggccacatccctgactccttccaatctatgtccccatcttcacatcaccttttcctcttctgtacacgtctgatctccctctgctctctcttatagggacgcttgtgattgtattaatatttcggacccacctagataatccagaataatcaccccatctgaagatcattaattgaatctcatctacaaagacccttttctctcacaagttaacatgtacagactacagggattaggacctgatatcttcgggtggcgattattcagcttaatacagtgggttagaaataaaacttgattttccattgtacaagaatgggggtttagtcttaatggttttatcatgccatgtacataaccactgtcagtatcagtgggggcgttttctgaatcgtggcttttgttttctgtgagctcattgccccctttcccctttaatattctagtaaagcttattttacaaagaaaaatgcctgcagtgaaaagcatttcttgatcatctttggatcaatatgtaatatttatatttcactgaatcttcatgccgtgtttcaggtttagcttctgtgtcaattttgaaatgatctgtggtaaattccatattggaaagacatgggtctcctctactgacttattttcttcttattccctgaaaagcctttcttatcaccccaggaattgtggagataaattttttcactcatgaggcataatatagttagtcgatgatatatttgttgtaaaaaactctttttccattgtagtccaaacttaaatttccctagtgttcatttgctttctctattttctagtgcacttaaaaatacatttgcagtcacgattgcctgggtaagttataaatcctagatattagaatttttatgctttagaaataataaatgagggcttaccaattaaagataaaaaattacttgactggggatagtagaatattttatcagtattattaaaatttaagggcagctgaaatgccacaggaatccttgtacaacattttggtttaaaaagttggcttaaggataagttacattcttttcttcaattttacatcaaataggatattatataaatttcttaaaacagagcagaaatcttgttgaactgaatcaaatgcagagcttttctccagttgtagccctgtggttttactttttatgtttggaaatcacttttttatgtatcttgggtctctaataattaccattattactttatcaaaataatgttaataccacacatggaataaataacctcatgtgatttattgtaaaaccaaggatttaaacaattaatatatttaatccatcagcacatctactgtctatggataagtacatctattttgtggatgatcacaacaggtttttcactctaatttttggttttctgtattttcttcttcttttttttttttttttagttcattattcttttagctctctggtaccctggcttcttctttgtaggtcattgtgacttctttgcagcatcatcacaattctctatagcttgataaataacctctctggaaattgatgattgctagagaatagcacagaattctaggtaggcactgaaaaaattataaaataaaataaaagattgccttttcagaagatgatcctattaggagaagcagaattctgtatcctgcacaaacacaattgatacctaagtagtgtgcatttttaagcagtcatttgtgaaatgatgtggacttaatggcagattaaaacaactacccgctgggctgtttcaaaaaacaaaaccctccaattaagatggatccatgagaatgtgaaatcaatctgccctaacattgagcactttctgtgtgaaggacactccacgagtggcatgaaataggaacggaggagttgaatatcatctcagtcctcaagaactgtataatccagagcagtggttctcaatgggggacagttttgccccccgccagaggacactaggccatgccttgagacctatttcactgctgcaaccagggaggcagtgctgctggcattagtgggtagaggccagagacggtgctaataattctccagtgcacagcaccagcccccaccacaaagaattacctggctcaaaatgtcaatagtgttgagattgcaaaatgctagtgtggagtaaagggaaaagcatgtgcagaaaacagtatttcaaggaagtcatgataggtaccagcatatttatgagggttcagtggaaggaagagattctcatgggttatacaggggtggaatggggaggtcagacctcatgctagacttaggaagtgtgatttgccttgaaggatgggcgagagagggagatcatgagggcatttcataaagaaaaatggcaatacaagaatgatattcataattcttaatgaaaagtacgccacatacactgacttgctggaacagacgtctcatcagtcagaacagaaatgcaatgtcaccccattgttggacatacaggtctcatatcagccttgtgacaaccactctgtctcaagactcaatcagctatcttgttagaactagttttatggtgaactgggatgggcttattttcttgaagcccttcaataagaaaattggactttcctgatacacagagtgggctgtgaaaccaccaacaccttttgagttaaggagtttccaagaaagtttgtcattctacttccacccactttgtcagtgaatttcttaaaaggatattaagtgtgtgatggaatcttataggcatgtcccattggagttacagagcaaagccccaggactatggcttttgacaaatgtgtcatcaaaataaactgggtatttctaatgtgagtcattggcggtaacaggataggagaagactgtgatgatgaaggcagtatttcaaggagtttaattctggggcaaaatgcagcatgatttggaatgagaagaaaccaaggaagacttttgaaaattgtttgggtataggtagtggggtcagaaattcagacatacattagtggtatgattactaaagaatcagtaccatctaaactctctcatcttcttttaagtgatttgacaaaaaggggtaagtgtatggattgatataaataatccatatacaatacttggctcagaggataagtggttttggacttaagaaacatatgctaaaggtgtgattattaaaggatcgctaaaacttaatctgtctcattttccatttagtgatctgataaaaaaaaagtaggtgatgttatagattgaatgaagtatttcacatgaaacacttggcccagtgtaagagtggtttggaagccaataactggtatattccagaccaattagctagctggagccaattaaccattaagttcttcattgttatgaagaaggtaatacattctgtggactttaagaacttctgctataagggttataggatgaaatgcaggtaggaattgagaacagtgtctggaatcttgtcagtgttaaataaatgaatatagtaaatggtccttcaaatgtttatccgatatgtgcattctaatagagaaatcaaagtttaccttgacatgttgagtagtagtcacttgagtaataaaggttcgttaaagaagtccgaggctgggcacggtgactcacgcctgtaatcccagcactttgggaggccaagatgggcggatcacctgaggttgggagtttaagaccagcctggccaacatggagaaaccccgtctctactaaaaatacaaaagttagctgtgcatggtggtgcatgcctgtaatcccagctacctgagaggctgaggcaggataatcgtttgaacccaggagccggaggttgcggtgagctgagatcgtgccattgcactccagcctgggcaacaagagcaaaactccgtctcaaaaaaacacctggagcaagttctgaggtgagagatggagtggaatcgttttcacatgcccagagtttgatataaagaagggacatgtctgagtgaaatacttagcgggcatttggaggattttgtatctgagagatcagagtaggattgactggtttggaaatctttgtagaggggagttggaaagtgttggaaagtaatttgctacatcagcttttaagtatctcctgtttattgtttgcatttttaacttcatttgggcctagaaatggcaaggaagcaccattgaagccaagaaaaatgtatcagacagctattgccaccatggttctgtgtaacaaaccatcctaaagcatagttcctcagataactttgcttactcctgagtctgtggataagcaggcatgtgagtgctatgtggctagtccggactggattgtagactccaagatgcaagttgagttcacatctgccctggtgtctttcatcctccttagaccagagacttctttggacattttcttctcttggtgaattacagatggacaagagggtgaggccgattgcaaaagggcattttaagcttctgctcacatcacttcctctcacctctcattggccaaagcaagttatgtggccaaatccaaggttaagcatcaacatagccaccattaggctatgatactgatgtgttttttaatactacttcagggaagtaaagagccagaagaaccacagcgacataaaaggaaatttttctgggtgatgaaaagtgcaagattttgtgtggacttgttgatggtactgtggcagccatcctgtgggcatgatgagatggccaggagcatcacagagacacagctcttgaagcaaaggcagaaattgcctgtctccgcatttgttgatattgaagccgtgaagtcatgctctctgttcctcacagtgaagggcaagactaaggacaccagaggggtatgaggagggagaaaagaagaagctgaaactggaccttgggcttcacccacatttggagttatgggagtggcagaatgcctagcatgtaacatacactctagaaatgtttgttgtcttgaattgatttgaaggcgtcagacaggccgtggtctctgtgtctttttacatctgttattccactgccaggccgttctcctttgctcccatcccagagaaacctgtatcaccaccggcataataatgacatttcattattacgatctgatactctagggctggtatccagctgttctaaatagagcaggtttctgtcaaagaggtttcacttaggactaagcatgactattcaaactactgccacctggggagaaattatttaccgttcttcctagttgtcaatctctagataggtatgttctcattattttttttctcccttcatcttctctcatattcacaaagaaaaaagttttgtgttattacagaatgatctgattttagcaatgaacttcttctcttgttggttattttacagttagattcttggatgaatattatttccatcttatgcaattaagagtgatctctcatctgatttcagtgaggaaattcttctgtcgttgaccattttacggttacagtctttgaggaattttatttccatcttatgcaattaagaataatatctcatgcggcattaaattgttggactgtctttgaaattgaagacaatgagaaaattctagcatgagcatcacctttttgtgtgtacgtagctttttggatctcattacttacagtataaaaaggcaatagttgctgcagttatatttatagttgtttattcctcatttttctaatggaacttgtcaattagaatcaatggcataaaagttttcttggagggggcgtaacttatggactactaacactgcctttagttcagtctttctgatactgtttttatgagacaaacaatgatatgcttgccttgtctgttggcaccaaacccctttgaaatgtatgttagaatgtattaaggtttaggatgactaatggctagtgatgcaggacgggcaagtccaaaagttggggcttagcctgggaggattattggcttcacctgcaaaagaattcatgtgcaagcagatggtgttagacagcagtcttctattgaatgatatggctccttgcagaggagggctaactcataggcactgagcccagagttggcaacatacgggctattcacaactatatttacactgacttagaccattttcagttacatgcaaattaagggacaagttaatgcaaactgaggggtgggttatttagaactttccaggaaaggaacagtagcttccaggttgttgtcatggaaaggggtagtaacttccaggtgattgccatggcatttgtaaactatcataacactagtgtcttctgctaacgagccgtgagggtatctgggtattgcttttatcaccatttactagttcctgccattttatttttacttcatcctgtcaggacccagaaatatgtcctgccagtctcctacctaactaggattcttgtaagaaatagttggcataatgtggagtataaactttaagttttaggatttcactgccccttagaatgtaacaagtacaaattaaagggcttgcataggattgcatgctttaaatttttccagagaaaaggcaaaaagaggtctttattattatgataattttataaaataaagtgaattgaagccatatgcagtagtgaggatgtcttaacagagtagccctttaatagatttgtgcatattggctggcccaaggggtgggctatagtgagatctgtacttgtctgcataacgtctgttttttttcccctctgtccttgcatggcagccaggtggtataagattgctgagataaattccaagtatagcatatctttactctaagctagtggtcagcaaactttttctagaaagacccaggatttttgtgttgtgggccgaacagtctttcttgcaactacttattgtttatttgtgaagtttatttaccaagctacacagtgggctaggtttgccttgtggtcataattccccaatccctggtctacattacatatgataatctccagggactcaggcctctgctctcctgagctgtggtattctcctgacccacacagatttgttaaggaataggaaagtaatactatgtgcactagtgaggtataaatatctctagtacccaaaggattataaatcactctactataaagacacatgcacatgtatatttgttgtagcactgttcacaatagcagaaacttggaaccaacccaaatgcccatcagtgatagacttgataaagaaaatgtggcacatatacaccatagaatgctatgcagccataaaaaaggatgagttcatgtctttttagggacatgggtgaagctggaaaccatcattctcagcaaactaacacaggaacagaaaaccgaacaccgtatgtcctcactcataaaggggagttgaacaatgagaacacatggacacagggaggggaacatcacacaccagggcctgtcagggggtggggggcaggggaggcatagcattagaagagatccctaatgtagatgacaggttgatgggtgcagcaaaccaccatggcatgtgtatacctttctgacaaacctgcacattctgcacatgtatcccataacttaaagtataataataatttttaaaaagctgttaatcaaagttttcttattaccaagaaggctgtaggaagatactaccatgcattgcagtggagattttcttacatgaatatgataaccacaactgctgcagccacttacccacctgcttggagatgaagccagtgcaggtgaggagaggagcagagtgaagaggaacttctgaagctaaaaatatctgctagcttgtataaatgctagagtgcccagggtttcctgttatgtgcgacagcatctttcattgccgtttaatcaagtctgagttgggcttcttgttatttgcaagtacacatacctcagctgataggggagaaaacagaactcccgtgaataagatattactaggaatttagagacatgggacagcagagaagagatgagatgaaattgggagacagagggagagagaggctggtggctgtacagtaaaggtattgagaagagataagatgaaattgggagacagagggagagagatgctggaggctctacagtaaaggtattgggataatctccgttggcagatactagaagtcctttcaagagctagagtattaaacatctagttctgaatagggtgtgtgtccaagatttaaaattcctctgcaactccaaacttcattaaagtctgatgccctcaccaaagccttcttggagtagttgtagataaataaaggctgagatgctgagttccattcttgggtaagccagacccaaatgaacgggattccctgtgaaaagggtgagagttcagggggtaaagaattaaagccacaaattactatgagtgtgtaaattcctaggaatttgtggacatgtttggaagtatgctaaacgtacaaaaaaaaatatgcatgacaattacctttaaaactcagaagacagcttcaccttcgtttccaagttcattatgcatttcaaatgatcagaactaataacaattatgttcaccatacaatattagatcacctttcatggtttgaatggttccgctccaaaattctggtgttgccgatgtgataggattaagaggtgtggccattcagatgccattaggccagaatggctcctccctcataaatgagattaagcccattgtacaaagaggcttctggtagcatttggctctcttggccttctgccttttgccgtgtgaagacacagcattcctctcctctggaggatgtagctttcactcaacaactgagcctgctggcacctaggtcttgaacttcccagcctccagaactgtgagaaatacgtttctgttctttataaattgcccattctcagttattttgttatagctgcacaaaatggagtaagacgctatctaagatgagttatctttaaaatatttggaaaaaagacatagtcaagttttctttaagattttttatgtattctacttcccctaatgatctagtttccttcccaccaccatgattaaatattttcttctaaacacagtgaaagcagtaattttgttggtgataaagcgaaatatttctagtaagaacacaagatggacatctgtaacttttgaagtagcagctgtaaataatttaaaaattttttgagataattttgcactttcataagagttgcaaaagtagtccagagaatttctgtatagtcttcacccatcttctctgagtattaacattttatatcaccataatacaataatagaaactaataagttagcattaagaccatgctgttaactgaaatatatacttcattgagtttacaagattttactccagttcttttactctttttctcttccaggatccaatccattattccacattgtttttagttgccatatcaccttatgtctcagtccactcaggctcctattatgctattacaaaataccttacattgggtagattttttaaaaagaaatttatttcttatagttatggaggatggaaagtccaaaatcaaagcaccagcagattcaatgtttggtgagtgctggtttccagaatcatagatggcatcttgttgccatgtcatcacacggtgtaagggtcaaggtagctgtcttggatggcggcagtggctgctgctgccgccgcctccgcctcctccttgttctcttcctttctctttctctttctctctctccttctctccctctctttctctgtctctcttgctctcctccctccctctctccctctctttctttctctttccctctccttccttccttccttcttccttccttcctttcttccttccttccttctttgtttctccctctttctctctctctctctgtccttccttccttccttctctctttctccctctctttctccctctctttctctctctccttccttccttccttccttccctccttcctctttctctctttccccatcttcttcactaatcctgcacatgagggctcttgtcccatgacctaatcatctcccaataccatcacattagtgattaggtttcaacatgtgaatatggggagggcactaacattcagaccattttaccttagttccctccagtctgtgaatctgtgacaattcctcaggttttttttttttttgatctttcatgactttgatacgtttgatcttgcttgccatgggatcttgggtgggtcatataatatgtccgagtgtcagtttccacataggttttacagatataatggcattacctacaccatgtttcttagatggggattatataaagaaatcattttggctcaatgaatatgagctgtttataataattattgttattaattattaatattaattttagaatttttaaggggatatttctcagctcagattatctgctgtttgaccctgagtagaatgaatttatgtgttcttggaagggatgccacaaaagtgatgtgtccttagcagatcacaatggagggtcaacgatgtctttatatcttattactagtgatattagccttgatcacttagttgagaaggcatttgccaagtttcttcatggtaagattgtttttaacctttgaacttaaaagtacactaatttattactttgatggcccaatggtgattttcaatttcctctcatgccctgtacatgtattcattggaacacttgtgtaaggaagcatttttcattctcctccatttattcagtatttatatcattattgactcaacatttattttgaaggtgagctataatctaaaactgtcattatttatttttgtggctcaaatcattccacagggtatccacaggctggtttcagactcgtgaccctaagcaatcctccctcagcctcctgaaacactaggagtagaggcacaagtctccatgtctggccccattaacctttttagagtgcacatttcagtggaatttagcacattcgtaatgttatgcaaccgctacctctatccagttctaagacatttttatcaccctagaaggagaccctgtatccagtaagcagtcactcttattccttctcctctgccccagcccttagcaatcactaatctgctttctctatgtatagattttccttttctggatattttgtgtaaacagaatcatacagtatgtggctgtttgtgtccaacttcttacatttagtatagagtttttttgaagttgagccatgtggtagcacacatcagtgcttcattcccttttatggctgaataacgttccactgtatggatagactatgtatttatccgttgattagcatttgcgttgttttcattatttccttgacgtaaatagctgctatgaatatttatggagaagtatttgtttgagtacatgttttcagttcttttgggcacatacctaggagtggaattgctggatcatgcagtagctctatgttcaacttactgaggcatcagcaagctgtttcccacagcagccaccccattttacatttccatcagcaatgttggaggattccattctctttgtaaacaaatttcctatgttgtgctttcctaagggggcactggagtgaatggcatcctctccaccatcttgcttgtcatgggatcttgggtgggtcgtataatttgtctcagtctcagtttccacatgggttttataggtacactggtaatacctaccccgtgtttgttatatgaggattatataaagaaatcatcttggctcagtgaatatattagctgcttataataattattgttattaattattaatattaattttccctttccttctcaggctcttttatgttcttgcttgtggctctgaattcagatgtctgagtaaccttttagcaactcagatctgtccctgcgtttctcctctttgtaagacgtcagttctggtgctgctaacattcactgcagcccctcactctcttttttatccaaacatttctggtgtacagaacacatgcttctggatttatggtgggggctggtgaagagaagagaggagaacgaagtctggggctgttgtgtgaaacagcttgttcttcctgcagatttatttctattatttcctagagttttcacacttgatcttacatgaatgcattttgtaattttacattctactttatgatttattcatgtgtgtcctaatattacaatcaaccatatcttgataacaaatcttcctgtccaactggcctgttgggagtgtgcacctggtgtgtcctgtatgtccaggcacagccctgccaacccatcaaaatacatgcactgcaggtttatgggaacttcagtgtgtacaagacacgcctgaagagctggtcaaaacatgagactctagactctgctttgagacacagacttaatgtgtctgtgagggcctcaggagtctgtattctttacaaggtgccccagtgggtgtgatacaagctggcctgtctacatggtgggccacctgtagtgtgctgagtgtgctgtggaccacctttggagaaacaccagggaaagtgatgatgcttgaaatccttgatcctacctgcttctcttcatctcaggccactgcccgtacccagtacccccaaattctagcctccaggaatgatccagccacattaacctttttgtttttgctgtgtctgactgtgtcactccatttgcttgtacactgtgcctgccttgtctaagggagcattcctgctcatccttctgaggctcaactcagtggggacatctgttcctctgggagcttagtgtagcatggtggttaacaggtggggagctcttaaggtcaagggtgtcagggctagtctgctttctacatttaccagctgggtgaaggtgaacaagttcattgatctctctcagactgtttcctcctctgtaaaagaaggaataactaatggtacctatctttaaaggatgactgtgggattaagtgaggcaatacctgtaaaatgcctaagacagagttagtagtcaatgactctttttgttattttattttatttttgagacagagtctcattcactgtctcacccaggctggagtgcagtggcatgatctctgctcactgcaacccctgcctccggggttcaagcaattctcctgcctcagcctcctgcgtagctgggactacaggcatgcaccaccatgtccagctaattttagtgtttttagtagagatggggtttcaccgtgttggcaaggctggtctcgaactcctggcctcagatgatccgcccaccttggtcttctaaagtgctgggattacaggcgtgagccactgtgcctggccctttttgttattttttaatgtttttattttcttttaattaacgtcctgattgtctcatctgctagtctgtgagcctcttgacagtggggaacagtcctcaataatttgtgtatttctgttatttataacagaaccttgtgtctaaaagataaacacacacacacacacacacacacacacacacacacacatttttaaaggagctttcaacctgctgggaattcttgaatgaacaaatgcactttatgaattccctaatccttttctttgctattttcaccactttctcattcgagttaatctctgaagacataataccctgccatggagcctcatccctgcatgggctatttgtcacatccaggcttatattgtgctgactaggccttccgtgtgacacccgctccccattaatgattgactgacagtgggtggccaatgtgctgagtcagcaccctggggctcactggctcttcccttattgaaggggaaaggagtaactttatcttttcagttaatgggaaaaaaaagccacgggacctttgtcatccattctgctgggttgcggaatatgatctgtgtggctatgtgtgtgtatgtgtgtgtgtgtgtgtgtgtgtgtgtgtataaaatatactctctgattaaagcaccaaagttactgccaataagcttcaggataagtagaaaagatattagtttaaaagactgaaataccaccagtagaaaaataaaacaatttttcagcaaaccataaaaaaaaaaactattggaaatatgtaaactgctgttctctggagaatattagcattttaacacacatggctatcagaagaaaatctttgcataacttagggaggtacttaggaacattgcaaaattttaggagatccctcaaaaggctacacctaaaattgccttatgatgcagcatttccattcctatgaatacacacaaaggaactgaaaatagaatcttgcacagatacttgtataccagtgtttattgtagaattatttgcaatagccaaaaggtggaaacaacccaaatgtccatccatggatgaatgaataaataagatgtggtacatatatacagtggaaaatcatttgtccattataacataataaaattctgacatgtgctataatatggatgaaccttgcaaacattatgctaagtgaaagaaaccagatataaagggacaaatactatatggttctacttctagggatactaaagtagtcaaatacttagaaactgaaagtagaatagaggttaccaggggctgaaatgtgaggaataaggagttattgtttagtgaattcagagtctcagtatgggaagatgataaaattatggaaaagggtagcagcgatggttgtataacattgtgaatgtactcaatgccactgaactattcacttaaaaatagttaaaagtaatttcagcactttgggaggctgaggtgggtggatcatttcagctcagaagtccaagaccagcctgggcaacatggcaaaatcccgtctttacaaaatatacaaaaattagcccggcatgttggcacatgcctgtaatcccagctcctcaggaggctgaggtccagggatgtcttgaccctgggaagtggaggttgcagtgagctgagaatgtaccactgcctgggcaacagagcgagactccctcaaaaaaagaatagctaaaaggtaaattttatgttaggcatattatatcacaagaaaaaaatacaaggagaaaagcatataccgcttaaaaaaatgaagtcttgcttggccacaaaggttcattcccttcatggggggctcattggtttctagctgccctcgagtgtgagacataggctggagactggtaactcgtgggctggaactcacccttctgggtgttttgtttgcaccacacagtttgtattatttgtcagcatttcactaagaggtatttggcatcaaaaactgaaactggattcccttttatgttggatggtttgtccatgctgggtccacattctcctttgctacccagctccctctaaagagagtcttcagtctccatgggcacctgggccctacagaagcttgcagttatagccccagcgtgaaagttttcactctgtctcagagctgaccctctgctattggagtcattgcctttgtattgtaggatttgattattgtaatgtaaatgagcctaagatgacccctagggattgacccctgggttatttcttcactccagactgggacctggtagctggaaagcccattgttgcctaactcaattttttcttttttttgagacagtctccctctgttgcccagactggggtgcagtggcataatctcggctcatttaaacctccacctcccaggttcaagcaatcctcccacttcagccttccgagtagtgaggattacaggcatgcaccagcatgcccggctagttgttgttgttgttttttgtttgtttgtttgtattttcagtagagacggggtttcaccatgttggccaggctggtctcaaactcctgacctcaagtgatctgcccgccttggccttccaaaatggtaggattacaggcatgagtcaccgtgcctggcgccaattcaattttttaatacatccaattattttttaaaaatagcccaaacaagcagatttttaaccatctacaaccagcctgctttccatatttcacagtgcctcaccagccttaccatttggtgaaataggtctttgtagttacaaggctccaagttgagccaacgctttggaagcctccaacccagagactccccaaggggctgctgaatgacatcacctagacaagtgatcccctcctcagagttccccatcctccacatccactgctggatgatgacttgctcacacaagcctctggatggtctcatactgtaagggacattgtgcagctccctgtgcatgtgttacctcctcttacagtcatatctttgtcaagcccccaaatccttaagttccctacaattattacaatgtttttttcttatatgaaattataaataataagtcactagatggaggaggatagagatggaggagaagaagaggtgggtctacttaagagggcctttttctcccctgttgagataggaaaagcaatagaataggtgttgggaatgctcttgtttgccagggccaggagagagcatcttgtttgtctgctttgggtacatggctaggccttccaagagtcagcctcatacacatttgctctttgatgttttacaaggggccctaaactgaggataacccttggagagttaaacaatgtgaatgccatatgcctggagtgcacttctcattggtcaaggattaaattcatgggaatcgtgtacccaaagcagatgcagcctcattgtaggttctgaatccagggtgaaaaggccttgggagctgactgcagtcagcagaaatgcgtgtctaacctggattgatggttctggttgatcaggatttgcaggaaatagagtaatgcaattaccatccttggctcgctctctgtgggatgttctcacagatcagtggcaaagggttggtaggctattttcctcccattgtattgtgagatgtacaaaccttcctactgatactgccggggagagattttctgaaggattatgaggctgctatttaaaaaagtgatttccagttaaatacctttcagtattaaaatggtaaagctataaggaatggggggatagtcttccataataattgcttctcaaggagcttagtctgattgtcttattaacaactttaacttcatccttttcctatgacaaatgagaaaagaattctgtgattcattgaacagtcagatttccaatatggtgtttacttgcattttcgtttccacttcagccaggaaatcaaatccgagggattaaataccccatttgaaatgtaatggagaattacaccaaaaaaggaaaattcacccacaaactagagcaacttcattcaaaatttcagatagtcaagagcgccagcgcatcgaggaacagtgacctaaccttcgcaggccgttggtgttagccctctcttaccttcctactggtgccatgaaattcactttctggcagtcatcatagctaatagtggccatgcattgaatgcgcactatgtgccaagtctggtgattcttatttttttttaatttaaattttacaactctgtgaagtagatacttccagtgtcccattttagaagaaggaatcagacaaagatagttatgtaatatgccgaagatcacagacatagtacatggtaaagtcaagttccaaactatcttccatatggctttagactgtaatccaagtcagcatttatgtgcatgctaccaggtcaggtatgatgggatgcctctttttacttaatatgtatattctgggggtctggctcctcccctggttttcactagagcaggttttgttctttttttacaccagaactctctaaaacccaaaggcataacattcacataatagtcaacatgtatgtatctcaagggtctactagagaccaggtaatgagctaggagctggaggaaggaaaagacattaaaaacaatggtcctgccttcatgaggcttacactctcctgagaagccagcttacaaagaagcaaacagctcagaaacaggttatgccttatgccaggtactaggaaaaaaatcaatgtggttgtgagataaaaaacaaggagggtttcatcgatataggatggtcggggaaggctctctgaaaagacggtgtttccactaaggcttagagagggggaaggaatcaagctggacccacatccatgggaagaacatctcagaggtagcagcaagtgcataggcctcaggttaggaacaaatgtgacctgttggagaaactggaaggatgtcaacatgggttgaatggagtaagagggtaatgaggaggactgccctagatggagtcaaaggtttgggtttaaacagcagaacaaacctattccatatctcagattattttgtctctctctttttttaaaaaaaaaaaaaattgttttccagtattgtttttctcctgtttcaccttattcaagcacctgctctagttcccattatttttttttaaaaattgctctctgttcatgtggaccttttaattcaagaaatgtttgagcattatatgccaagccctgacgtaggcaaggcagggatttgaaagatgtgaagtgatgtgtctgtgggccttagaaacacgtagctttgaattccgaaagtgagaattaagttgaccttgcagaaatgaattgcaggttaggtggtggtaagtctctaaagaagattcatgtgggaccttttcaaataattctgttctccagtcaattttaaaccaccctgcgtcccagcaaggacagtttatggctttgttcacatcatagatttagaaatcaagacctaagaaaggtcacaccattaaataaatgttcaacactccgggaaaaatgggatgttaataacaaattctcagttgagtgacattgacttgctacttttgtaacagctactttggtttgcatttgtaaaacctaaaaaaaatttttttctttacttttgttggagaaaagggaagtttttgacctgagcattttctcacttcagagaattgaataagggaagcgtgcattgattaatattcttgggggtgctagaaatgtatctgaaaacctctccagtctagtgtttctcaaattttaatgtgcttaaagatatctggagctgtgctgtgaagtcactaggcacatgtgacttctcagtacttctgaatacttgaaatgtagctagatgaaattgaggcatatctctaaaatgcacacatttgaagagttactatgaaaataaatgtaaaatatcttgacaatttttgtatcaattattcaatagaataaacttttgatatattgggttaaattcaatatattatttaatcaatttcatttatttgttttcactttttaaataaaatgcagctattagaaaatttaaaatcgtatatatcttacattatgtttttattttaccctattactctaagaagacttctgtgtccagccatgatgctacaactgataccaggttggtcctcagactgaaagcaatgaaatacctaaggctactctttttaagcattgatcaaaaggcagctctgtgatcttggagagaagggagacacctaaggtgagcctcatgaaagctctggctttctgtccaggagcccttttctgctgcaaggcaggtagttggtgccaagcactgtgacgttctcactgagctgaagatttgaagagtagagttctgggattctgaagtggaatcgttttggggtcaggtgccacaaaagaggaatatgtgcagggggaatgctcataagtctgcatggaattttacagctggtccttggctgactatccatgtccagggtgacagacttcaccggagatcagagatcagttgatgcagtgctctgagctagatggtaaaacaagaatctgtgcagtgctggggcacttgggatccaagcaacccagagttgggagaccttatgcaacaccttgtgcaatcaagtggaaaccccagaatgcccatgctgaggactaagttccagtttcactagaataagaccatgcctgttgactaagttcaagatggaaacagacccacctgacaaaggataaaacctagcacaacaggatcaaatgacactctagtcatttaaccacttgcatgaacaaaattcagcacctttcagaagaaaacattattagcacaatctggatttctataatgcattatgcatcttgttcaacataccacaaaatttattaaacatatgaataaacaggatcatgtgacctatagcaagatacaaaataaagcaaacagaaacagaccctgatgtgtcatggatattagaataatcagaaatgactttaaaaccacaattgtaaatatgttgaagacttaaagagaagattgtgttacttaaatgaataaacaagggatcccaggaaaaaaaatggaagtcataaaaaggaatcaaatggaaagtttagaaaggaaatgtaaaatatttgaaataagcaaggcacttgaacagtttaacagtagattgaagactatagaagaaaggactagtgaatttgaagacagaacagaaaattattcaatctgaagaatacaaaaggaaacaaaggtagtaaaataaacagagtcagagatctgtgggagagtatcaagtagtctgatatatctgtgattgaaagcatagaggtagggaggagagagagaataggatagaaaaaacagttgaagtaagcggtgaaaattttccaaagttaatgaaaaacatccatttacaggtccaagaagattagtagatcaggttaaatacaggtagaattaaaaaaaaaaaaaagaactaaactcagacatcagtcatattgacgaaaaaaaaaaaccatagataatattgaaaacagccagtgaaaaaggaaatataaaatgcaggggatgaatggtacaaacagtaactgatttctcatagaaactgtggaggccagaagacaatcatatgacatctttaaagttcagaaagaaacaaaacaaaacactgtcaacacagaattgtatgactggcaaaaatattcttaaaaattaggtgaaataaacacattttcatctaaaggacagtagagggaatgtgtcagcagcacaagaaatgcaagggacatgatcaaatatgaaaggaaatgagagcagaaggaagctctgatataatgaagtaaaaatagttgaaatggtagacacataggtctaccataggtatattaatgtatatgctttcacttctcttaatttatttggggaaaacagatagtttacaataaaaatgatacagttttattcttgggtttgttaagtatacacatgtaagatttatgactactgtgcaaatgtatgatgctgagtaggaaatacagttttattatagtttttatattttaacagaagccacataatatgaactgtaaaaagattctgataagttatggatacatattgtttatcctaccatgcctaaaaatgaatagaatatagctttaaaaataaatgtatatgtaatgcaaaaaggatttgcttaataaaaaagaagtcaagaaataaggaataaaatgaaacatatggatgtgaaaactagaaggcaaaagcttgaaagacaaccatagaaataatttcaccaagtgcaagtggactaaacactccacttaaagagcagagattgtcagactataataaaaagcaagaatccgttatttgctgactacaagagactcgtcttaaatacagagacacagttagattgagtaaaagagtggaaaactatatcccatatgaatagtaaggataagaaagctggtgtgtctgtattactgtcaaagttgacttcaggggaagaagtattagcaaagtggaaaagagacatttcagaatgatcaaatggttaattcatgaggaagatataacagccctaaatatgtatgctgctaataaacagcttcaaaatacatcaagcagaagttgacaaaactaaagccagtaatagataaatctgcagtcatagttgtagacaaatttgcaatcaacaactctctctgattgaaaaaacattcataaccagatcagcagtgatgtatgcactgatgtggatgaatctcatatacattataaagagcgtaagaggccagataggcatgcatactctatgtttccatttatatgatgctcaagagtagaaaaaacaaatttatggtgagaaagttcagaacactcattcctttagagctttgggttctgactaggaaggggcaccagaggactacctagtgtgatggaaatactctgtgtttgatcggagtgttagttatatgtgtgtacacatttatcaaaagtctttaaatctttattagcctaagccccatgtattgccacttgtttttgtaaacaaaatgttattggtactttgctgtactgatttatctacgtattgtcaaaggctgcttttgcactaaggtaacagttgagtagtggagatagagactatggcagaaaaaacctaaaatatttatgatctagccctttctagaaagcttactaccccttgctctagagtcacttatttaaatgcagcttctgaaagtcaccctctaagattctgatccagaacatctggaacagagggaagcatctccaatctattccactccccagatgactctcaagtttataaaactgtgtggacagaagttgcggaattgctcctttcaagattcaccatatcaacatagtagctactctctttggtcataaaggtattttactgactaatctcattgaatcactctggagttataaaagcccatttcctccccactggccttccttggaaagtgagaaaaattccttctcatcatagttatgtaatcatccttcataaatgtggagaggctcacatgtgctgctggtggtaacacattctcctgccactctctggctctctgtaggcggctgtttgagaggttaaagataggatgaaggaaaaattcacaaaacactttgtatgcacgtctggcggataatgacacttaagaagctttgcttaaaactgatctgccttcgtgatgatttgagcttgctctttaattagcttttaggagcatatattgtttagtatgattattttattttgccaaatagaagcttaacacgctttagttcacaaaggagcgagatctactttataccagcttttaacgaccaattgagagagaagaaaatgtctgactgccctggaacctttttccccatgggtggtatgtgactttaagatttcacgatcatgggggacactttcggcagcaacagcaatgctcagcaagtattcccttggctcttctctatttccagccccctggcagttaggtggagctctgtgactagttttgctcactgaaatgtgtgacttgtccattgtttcttctagcatagaatcatgcgaatgcatgatgcagttaccacagcatgtagataccacagatacggttaccacaggtgtgacatgaagcagcttgaattcctgagctagttttactgagcaggaaattgatgtttgttgcgttcatttatcgaagtcttggagtcacttgttagtatggtatagccttctctttcctgaccagtacggtacctactgccataagttcagttactcactggggaacatagtccaggagtacacgtgaagctagtaaaaaggcaccatttcaaattagcgaaggtggcatggactgtgagttaacagaggaaggaaaagtgactgtatatttgggaggaaaaagtgagatctctttcttcaactatgtaaaaataagttatatcccagcactttgggaggctgaggcaggcggatcagtaggtcaggagttcaagaccagcctggccaacataggaaaatcctgtctctactaaaaataccaaaattagctgggcatggtggcgcatgcctgtagtcccagctactcacttgaacccaggaggcagaggtcgcagtgagccgagatcatgccactgcactccatcctgggcaacagaacgagactctgtctcaaaaaaaaaaaaaagaaaagaaaaaaaagactattgcttttcaaaaggtctctgctgtgcattatgttgtgtaatttttttttttttctgagagactgcctcaaaggatgcaagttattcgtctccatgtcattttaaaaatgtcttctctggaggtatctggatggaagagaaaacttctgtgatgctggggctcaattctcttggggctctctataagacaggccattatatcaattgctacatctagcatctcctgtgctgacaaaagtcccctgattgctccactgccctgcagagttgattgtgctatcttcctcgcttgcctgatactggcttccacgttgctctctctagcatgtggacttcagaggcagagcctgcgttcttcatttttagtgcctatcaggcatgtggctggcactgaacacagggttctgaatgaataaataaatgaaatgcttctaccacttacattccctgcctcttgggatggcaccatgcccagtgcaccaccctgatttaagttagtgtcagtcaaccctgccttgattcctgcgatcacgctatgtttactgttacccctccccattagttctttcactgaagtcagggaagatctgtttaaaatccatatcttatttcactccctacctaaaaccctttggtggcttcccattgctctttgaataaaggcccaagtctttaatgtgccacataggacgccatctctgcatcctcaccttgctcacacctggtagtcaggaaagatttattccttacagttgctgaaacacaccctggtctatcctgccacagggtctttgcctgtgctgtgcttcatgcctcatgtgccccaagcaatagtacacacacacacacgtttgcttacctagtctacttctaaattactgtttagaccccagctcaaattaggggacattcctcttttatataatttgtaatttctttcttttctttttttttttggaattggagtctcattctgtcacccagggtcaagtgcagtggcgcagtctcggttcagtgcaacctctgcctcctgggttcaagtgattctcctgcctcagccccccaggtaactgagattacagatgtatgccaccatgcccagctaagttttgtatttttaggagagacagggtttcaccatgttggccaggctggtctcgaactcctgacctcaggtgatccacccacctcagcctcccaaagtgttgggattacaggcgtgagccaccacacccagcctaatttctttcttatagtattcagcaccccttgtttgcagcagatattgtggttgcagttttacgtatatttttacggttattggattcaggtctgcaagcacaaaagaggatttgtctggtttcagtgtaatcttgcaccccaagaaccgattacaggatctgatggatatccactcaacaaataatcttgtgtaaatgaatgtcttgttaggggtattgtactagttccctgccatccagggatgcatagtaaatctgcctgatcctgtgagctcggggaaacctaaagctttctgcgggagtggtaggtaccaaagacatgacattagttctgccctactcagaaggtatgggctgggacaggcagtgagggggtgaaggagactaaccgtgaactgtcagtgccccct[136 bp omitted]aactcagagtatttcttatgtgaggggtccattctctagcatcttaccccaggcaggccattttttttttattattatactttaagttctagggtacatatgcacaacgtgcagggttgttacatatgtatgcatgtgccatgttggtgtgctgcacccattaactcatcgtttaacattaggtatatctccaactgctgtccgtcccccctcccctgaccccactacaggccccggtgtatgatgttccccttcctgtgtccaagtgttctcgttgttcaattcccacctgtgagtgagaacatgtggtgtttggtattttgtccttgcgatagtttgctgagaatgatggttatggtagtaggttttcagaagccatgcttcagttctgactggctaagcattcagaaatgggtcctaaacagcaaaatatagatggcattccaatgcacccacagaagaggttttcagctgcagaacaggcattctgagttaaaatatctggttgttttctattggaaagcattggctgtactttgaaactctttaggcttcattctgataagagaatgagatgacaaggtaccatagaattcagtgcaggtattattattatttacattttgcatttagcttgttttaatgaggaagagtggtgggagtgtataaaattttgccacttgtcctgaatcccatcatcattttgaggcaaattggagggatcacagattcaacagggtcaggtgtgaatatggggggtattcattggatatttgaatgaaaacattggtctgtttatttagggtttaaaagtatgacttaaatcattgcatttaagtgtaggtaaatcagaatgtctgaaaaaaaaccatgaacactaatagttaatggaacaatgactaatcataaggaataaaaagtgggagtagatttaaacaacaaaaatctcaagtgtggctgaaggtggcaggggaattcctggagatggcactcgtttcgactttttttttttttttttttttttttttgagacacagtcttgctctgtcgcccaggctggagtgcagtggcacgatctcagctcactgtaccctctgcctcccaggctcaagtgattctcctgcctcagcctccccagtagctgggagtataggtgcccgccaccatacccagctaatttttgtatttttagtagagatgggttttcaccatgtcggccaggctggtctcgaactcctgacctcaagtgatctgcttgccttggcctcccaacgtgctgggattacaggcttgagcctctgtgcctggcctgttttgacctttttgccattgactttaggtactttgttagaccattgctaagctcgcgatgataacacctattagaggaagtcttctgaaagtaagacctggagattcggaggcgatgtgtacttgcttccccagcagtccaaggtgtatgtcctgccctcctccggcagggccactaccatgctggctccccttggtttaggcttgactttgcctttgatacaaccttcccccaaggcaccctgtaatcgcagttgagccgtattccagatacgtgtgagccatatgtctcaggtgttgcagagtaggaaacaagttgagacatactgaggcaattacagaaaaaaagaaagcatggagaattgcggtgataagggcttacgcttcattttttatgctgtctcttttctgaccatattttagatttcctagaaactacccattattatgaatgcctgagttctgtgcatttcttcagagctcaagtctaaactaatttaatgtaaattatacatttgcaagtaatattccagaaaaacctttatggggcccacaaagacaaaatgcacaaaaggaaatgatgatgtgttttattcataaggaagcatttctcttcaaaattcttctacagccccccaaaatacctaatgcatcacaagccgacatttgtactgctggctttccatacacagagaagtactgttccttttaatcaagtaagtttattttgctgtgaaaccctttgtataatattgaaaaatagttgtgttccttggaagctatttcagttttctgaaatgatcatttttaatcagtctcctagcaaaacaatttaccaagcagtggaggataacgaaccataaagtttaatttgccttttttaattgagttgttaattatcacccctccaccgctggaaactcccaacttgcttttttgttttgcttctgatccgagacgttttcaagaatctaatctatcatatttcctctgtccaggtactttcatgaatcacatcaataggtgattattttctaaatctgttaaagcttccacagttgcgtacaaattttgtcagtggtaaataattagatagaaaacatccagtggtggtaagttgataaagatatctgccatttattgaattcctactatgtgccagatgctgatctaacttcttaacatatattatttatctttcacagcatttttgtttgttttgttttgagatggagttttgctcttatcgcccagggtggagtgtagtggcgtgatcccggctcactgcagctgccttctcccaggttcaagtgattctcctgcctcagtttcctgagtagctgggattacaggcactggccaccacgcctgggtaattttttgtgtttttagtagacacggggtttcaccatgttggtcaggctggtctcgagctcctgacctcaggtgatccgcccacctcggcctcccaaagtgctgggattataggtgtgaggcactgcgcctggtcatttttttttttttttttttttttttttgacagggtctgactctgttgcccagactagagtgaagtgacacaatcatggcttactacagcctcaacttctggggctcaagtaatcctgccacctcagcctctcaagtagttggatgtatgcaccatcacacctggctaatttttaaaattttttgtagagacaggttcccactatgttgtccaggctgctcttgaaactccggggctccagtaatcctcctgcctcaatctcccaaagtgttgggatcacagacatgaacccgtacaccaggccttcacagcattttgaggtacaaacagttatctccattttatatgcaactaaactgaggttcagttatgttaagtaccttttccatcacaatccaacttatcaggactggagcaacgcttcaatcctaggtggtctggctagtggcctcacaggttatttgtttaaccctaagctgtatttttgagatccctgatgtcaaacaaacctgcatttgaattctagttctatcgttaatattgatattaaattaacagaatatgacttagggcccatttgatgggtgtgcggtctgggcccctgcccagccacaccctgcacttggtttgatgttctgctgttgcctttctggcaactctaaatcattttgaacaagggggccccatgtttttattttgtattgggtcatatgtaacataggtagccagttccaataccattattgttttaacatctttagaggctcataaggctgaagtcaacgtgtcagcctggttgggttcacatatggtggcttaactggtatagatctacttccctgctcatatggtaacattcagttccttgcagtcataggatttgtggcatgtttgcctttttaaagccaggaaggggagagagaacgaccagggcaaatctgctgggaagatggaatcttatgtcagataacataataataggagcaccatggtggctcacacctgtattcccagcactttcggaggctgaggcggacagatcacgaggtcaggagatcgacaccatcctggctaacatggtgaaaccccgtctctactgaaaatacaaaaaattagcaagggttggtggcaggcacctgtagtcccaggtacttgggaggctgaggcaggagaatcgctggaacccaggacacagaggttgcagtgagccgagattgcgccgctgcactccagcctgggcgacagagtgaggctccgtctcaaataaataaatacgtaaaagagcagcatccaatcaccttcgctatattttattggttagaagcaaattacaggacttgcccacactgaagaggagggagtcatacaaatgtgtgaacatcaggaggcagagattgtggggcaccatcttgaagtctgttacctgcaattattattattactatatacagttattagtgttgtttttattaccgctattgttattgatagcagttctatagagtactgtgtcccaggctctgctgtgtgagctttatgtgaattaaagctttctgtgttcagcagggaccatggtcctgaggactgaatccaaggacatcccctctctgcccactgaaatcagtagttttcaggccaactaagcatgaggcaactgttattttcctgagtgatacgatcgtttcaggaagtataaggaggtggaaacacagaattctgcatcacacagaccaaggtgaggtcccaactctgctgctttctggctgtgtggtcttgcccaagtcactttctccatgtgggatgttccaggagacttttgaccacccgctgcaagagaaatctcttacaacctgcccattcagcacagttcagcctgaagagagtcatgtgtttgtatttaagatactattaccctgctcaatcccaagagcccactggtctcaggctctgcatggtgtttgaaacaaaaaaacacaatgaagaaatggaaaagttatcccccaaattgtcagcacccatgtaactgctttctcctctcctctgtgattgtccatgaatatagattggcttggccatgccatcttttctctactagcctctttcttgctctcttcctcactctttctgtttcttggtcgtttttttcttgatttctccttatgtatctgtttttgtttctccttctcctgtcctgttccccatttttatccaaatgccatgtcagtgattctcccttctcaggaggaaggaagcagaaaagggtggacaaaggaaataattgaatagaattccatcagtctctcttagcaggtgtatctctgaagctcttcaaagatggtcttgatgagagcagaggaaggaactgctcctctcaagattcagctggaaaaaatacggaatattgtgttaatttgtcttaccaaatgctcttctccccacgttttccctttgatttctctgaatgtttgggaggcatgcattttgctgcagaagagaatcaagtcttcttacaccatctttgttaagatactactgtctgataattcgtaaacttctaaggttttttttccactggaaatgacttttttttttttttttcttttgagacggagtttcatgcttctcacccaggctggagtgcagtgactcaatcttggctcactgcagcctccacctcctgggttcaagcgattgtcctgcttcagccccatgagtagctgggattacaggcatgtgccatcatgcatggctaattttttaatattttttttgtagacacgaggtcttgctgtgttggccaggctagcctcgaattcctggattgaagtgatccacccatcttggcctcccaaactgctgggattacaggtgtgagcccctgtgcccagccagaaatgcttctactttctcctgtagggtggcctgtagcaggatcatccattcacattcccaagtatcctctgttcattcacctgggcaatgagaggagcaacaattaagccagaaaagatttgctgcctccctgtcttgatcccaactccttccctcctgtctgtgtaacttggatctcttacttgtcccctttgtcaaggatagagtcaatcccattccttctagtagatcttcccttctggcccaggagtacctcatcctataagcaaaacatctttagcatctttcatttcttcaagctgtgtttccttctcacttctgaaaaaagagcaatctgtggtttggtttcttatctctggtcacccatttactacccttttaatctgagtgctgtgcaaataaccatctcacaggtgaccaagggacactccagtggtcaatgtgtagtctcagctcgtattctccccaagctctctgcagcgtcagaggacactgacccacactgtgacttgactctctgccctcccacattgttgtgagactggagctctgcgtcattttcatcctcttaattctctgtgtccatccccatgtcttctctctcaggcacaggctaaatggaggtggtgctcctgaacttgaccctcctttgtctttttgcatttccctgcagtaccttagcccatcaccatggccgctgcttttggagcaccttctaaatgtcagcctcttttctcagtgccctccatatgtaaacccttctaatcctccctaacactttatgagataaaaatgagggttgttcttttacaagggcgatacggaagagctgagaggctattcctttctttcagatctctgggcataaccctgactgctctcttagattgtctttgatttctgcttgtcgcttgtctcctccccctgggttatctgttagggaccacactcaaaaccaaactcacctccatttctcttccaactatgttcatcctctgcgtcctgtggttttgttcatatactgctctaagttccattcaacacttcctacatcatttttgtgacttcctgtctttccctgcttgtccaatccaccactaagctgtgtttatttcactcccaaatattttcctttctaatttcttccaaattccaaaatattcttttcagccctctttaattctcttactgtaatattacaataagtttcttttaaaattaatttcatttttctccattgtgtaattattgtatgctgatctatttggagaaaaggtgaaagaactcttttttaaaaatctgtaatctcagcacactttgggagggtgaggcaggcataacacttgaggtcaggagttcaagaccaacctgaccaacatggtgaaaccccatctctactaaaaatataaaaattagccaggtatggtggctcatgcctgtagtcccagctgctcgggaggctgaggcagaagaatggtttcaacctgggaggtggaggttgcagtgagctgagatcatgccactgcagtccagcctgggtgagctcaaaagaaaaaaaaaatctataatctcatcacctggaatactgcttcttgcttctggcctgtcttacttctcgatccctgattaatttctctaaaaaatcagcttttctatataacccccttcagagatccttgttgctgctgctgcaaaaaaaaaaaaaaaaaaaaaaaaaaatccaactcttttttttttttttggagacggagtcttgctctgtcacccaggctggagtgaaatggcgtgatcttggctcactgcaagctccacctcctgagttcacgccattctcctgtctcagcctcccgagtagctgggactacaggcgcccgcctccgcacgtggctaattttttgtatttttagtagagatggggtttcaccatgttagccaggatggtctcgatctcctgaccttgtgattcgcccgcctcggcctcccaaagcgctgggattacaggcgtgagccaccatgcctggccaaaaaaatccaactctttagaaaaacactcagaacattccaagttcccctagaagataactttcaggaaggcaatggctctgccttttgaccagcacatagatgaatgccagaaacagagtgagtactgattggttgaatgaatgagtgaatgaaggaatgagtgaatgaggaatccatttaccttctctaatctctggcttcatctagaccaaattactgccttctcctaaattgttccatattttccacttcttctcacttactgttagtagctgagatctcctcctgtccatctcctttttgtttgtagatcgtctctgtcattcaagactcaactcattcttcggggcttcctcaaaattcccctgatgttctctgactgcaaggagctcttccctctcttccctcctctgttactcctgaagcagtttttagttttcattctaattcctttctcccagctcctgagcaaggtaatagtattttttcagctcggctcttggtagatatttaatatttgttaagtgcatgagttcatgaaataaatatttgggataatggagctgaagttaaaaccagtaagctccacttacttctgtgtctgggccacactttgtccaaagatttccctcttaacgtttttgtttacaaatgctcttcaggaataacttgtaagagaaaggagctgtcattgagtgccttgaaaagtggaattgcatgtttctatggaaacagagttgagagctgagttttctgtacatgatgttttaatgaaaacatattcttagccattatagatgggtttgtgtaccagatgagaagtgctttatcttaattgaccattatgttcataagtcagattgatggtctcaagtattatttcatcaaatcacaatgcattactgtggtttcctttcaggaggtgatcccaatgctcacaaaatgaaggctgtccttgtttgtggaggaaaatgtttctatagacttgctgttcttccctttgctattgagaagtggcctctttatttatagctaaaggacacttaccataagcatccaagtgattctgttctctcttggaggatgataattgccccaaatcatgcatgtatcttatatcatatgaacaattgttaagcagttttagggactccaggatggtggtagcagcggtagtggtggtggtgatgtgggaaagctcaaagtttgctcccaaactcttaagtagaagactacctgtgcacctgatacttttgcttttcacttgtgtgtttgttggttttgttttttagagacagggtcttgctcttttgcctaggctggagtacagtggtgcattcactgctcactgcagcctcaaactcctgggctcaagcgatcttcccacatcagtgtcctcagtagctgggactgcaggtgtgcaacaccatactcagctatatatatatatatatatatatctctacctacctacctatgttgtccaggctggtttcgaactcctggcctccagtgatcctcttgcctcagcctcccaaaatgttgggattacaggtgtgagccactgtgtgtggtcacacctaccatttttggtttgtactagttctgaagcatgtattcctatagcatggatcaacaaattagactctacagattatatccattagaatgccatggactataagtgctgggatcataattagaaaattattctctttttaattttctgttaatgataatttattaggcatattgttcctatccagagatgggcttcctgcttcagtttgtggcaaatttagggtaccattttgcttacctcttggagatctcttttaatgcagagatctaacacatcattctcctcaagtaccttttaataggaaatttcccaataaacctattaaaagcataatgaaaacctcattcagtcttctgtcaggctttggagctataagtggcttctaatttgcacaagatcggaatagcattgaagaattacagtaactaagtgaaacatgcattggattttcaattttctgatagcatcccatgtaatttcttgtaatgcatctgtagccaagggaggtgacacatgtcaaggctcacgctgcagcttctgcccacatcagtcttccgtggagaagcacgatgctgtcagcttttctcatgagcaggggccagataggtgtctttgtttagccttgatggatattccattatgcacagtcctctgagcaatagccacataatttaaaaacagctcagatagatgtttttgatgcttgacatttgacttcacatatttattggaacaaactgtgaatcatccctcttatgcaagtgcttgacagaatagtttgtccacctgtggtctgttgtacctgtggagtctatttgtattctggaaaatgaattccctctaggaaaagccaagagaagtcctggacatcatggctacaagccagtgagataagaccctgcattttattttttttaatcatagtatctcttttttttttaactttaaagttcatgggcacaagtgcaggtttgttacacaggtaaacttgtgtcatgggggtttgttgtaaagataatttcatcacctaggtattaagcctactgcccattagttatatttcctgatcctctcccatttcccaccctccaccctaggaaaggccctgggtgtgttgttcccctctatgtgtccatgcattctcatcatttagctcccacttataagtgagagcatgcagtatttggttttctgttcctccattagtttgctaaggataaaggcctccaactccatccatgtccctgcaaaagacacaatcttgttttttttaatggctgcatagtattccatggtgtatatgtaccatattttctttattccatctgtcattgatgggcatttaggttgattccatgtctttgctattgtgaatagtgctacagtgaacatatgtgtgcgtgtgtctttgtattataatgatttcttttttggggagtatatacccagtaatgggattgctgaaaatcctatatttcctttggcatatttcattttatccagatgaaattatccactttccctcttagagagcctaaatgtttgtttttaacctgaaagagggagtctcttgtaccttacctgtagtattttcaatgtttatggcatacgtccattatttaaaacctcaggaggagaaaagccagtagtatatttaaaaatagactaatcacagtttgcaaaggaaaaaaagaaaaaagaagccaaccagactttgtaatcattaaaataattaatggtgttgcttttcttgtatgtggccttgacaagactctctcactcctggggcaggtattttgactgatttttcacctgactgaggatgaatttgcactaatccagctctatactctcccaggatctcctttgtgaccaaaggcatttatttgcaaggtagcagtgtggaggttaagatgataatctaaggccagagacagcgtccagctaattggctttacatggggatccaagctgtgttctaactatggtgcttacgtagcctgaagcacctttctgaccctttatatcaccccgaaaacagcaaacatttgttgaattcccatgggtctggtgctgtgggagggggtggaggcaggagaagccaggagagactcagcttggcacagcaggagcttcttgggtgctcacagcagataggaatccacgcttctttttaaaatacactgaagaaaatattatttgagtctttccatttttagctgttcaatgggtgataatggaaagtaagtccagattagcctccaaaattgtagatcagctgttttcaacctcaacactattgacatttggggctagatgattttcactgtgggagctgtcctgtacattgtaggatggttggcagccgtagatgctggtaaaaccccctctagttatgacaaccaaagagtgccttggctgagaacccctcctctggatggcttcccagtggctactgatactggcattttctgcttttagagagagtaggtgactgttttcacaagtgtaaaatataaagtccttaggacgatgctgggcatggaataggattcaaaagtaaaagggcaaacttttcactatactgaatcaagctgttatttttttgaaagtgatatcatcatctttgctgttcattatacctttactgaaccttccggagtgtccctgtcttaataaagaagtgagcatcgtctaagtactgttttgagctttaagtggcgattcaagctccacctcgttgcagaaacatgggcagtaaaactgttagtatctgagaggcatcaagaaatggtagacgattctgaagcatggcatcacgtggctcttcatgtttatctcgccacaacatccttagctcctcctcctcccactggtcgtgcattaaagcttcaccaccccaagggccatctgtagactcactgcatcagcatcgccttgggagcttgttagagatacagagactcaggccccagcttccacccacggaatcagaatttgcatggatagagagccagagaaatactttgttgaagggccttttccatcccactccaactgttacctaaaaggacctcttcagagcctcctttcatagatattctgtcttgctggctgcatgctctcttagcgtcctctgctggccgctgttgatggtggtgattgtttttcatacttttccttccttaccattctgtgctctcataagtacaggccagttttgcttttctgtgatcccaagctatgacctaacacaaccctttcccatacagatccagtcccaagcacccgggagcattccagggtccctggacatggttctgcaaaactcctagctactcagcatgccagaattctaattcactcatgggtcaaagccagagaggctgtgtgtccacctctacacatatgtacccatgttgaatttaaaggtccccaataggagctacctcaaaaacacccaacaattaaaactagaggggatgggggcaagaaagatgaaaagaaattgattttcaagatgccatcaaggttggggaaaaaaagaaaaaaacaaggaatggaagggacatcagacttaatgcctccttgaacatgttacgttcaactcaaaagcctccccagtcctcgcaccaaaatctttcccaagtttgtaattggtgtcaccatccactcagttgctgaaattaaaacctaggcattatgattgattccttctttctcctttcagtctatcaacaaattgtatgtttctaccttcaaaataagaatctcaaatccccccacttctagtcatctccattgctatgaccttgccttcagtcccagctctcaagggtctcctacagccttctcctaaattgatcttcctgatccactgttgccattctcagaccctccctttggcagaagccaaaggctggtttctaaactggcagtgtagactgggcacggtggctcaagcctgtaatcccagcacttcgggaggccgaggcgggtggatcacctgaggtcaggagttcgacaccagcccggcaaacatggtgaaacccgtctctactaaaatacagaaattagccgagtgtggtggcatgtacctgtaatcccagctacttgggaggctgaggcaggggaattgcttgaatctgggaggtagaggttgcagtgagccaagatagcgccactgcactccagcctgggcgacggagtgagactccgtctcaaaataagcaaacaaacaaactgccaatgtgctggtcatacttccttgttcattttgtttcacttttctatttctcaaactcctcaagctcattctagtcttagaattttgttctgctcccacctcctggaacactcatcccccagctactggcatggatggctcattcttctttgagtctcaggttgaatctcaccaccctcaaggcaggaaaaccttatcaaattaggaccaataagagtcatgttcctggcacctaggtagtagatgaatcccctttgactaaggctacctcaccgagtgactgtgttctctaaaatgctggtgatgtagaacaggcaggacacagttagcatgggagacccagctagaaaaagctggagagatccagagtaaagttcatttgccatacttcgctttatctaatagtgagaaagattgcctatcaattaaaaccacaagggtggagtggggatgttttccctagagatttgaagtagtttcatctaatgtggagcagttttagaattcaataatgcaatcaggttttagtatttccacccccctccctgccacgtaatgattcatgtgccttgaaattttttcattaaaaaattccaaggctcacaacgtagaagaaaaaaaagaaaagggggcctcacacctcatttgttcagccatctcatcgaggccccaaatgtagatcattgaaatggagccttggaattttaaatcaagttttactttgcaaatttaatgaaatgcaaacaaatacttagcagttctaaagggcatgaagtcattaaggtttctcattttgttaggcgctttgggggcctccttaatttttggagtaaaatcaattaagttctttgtgtgtgtatgtgtgtgtgtgcgcgcgcgtgcgcggatgtgtgtggctgcttgtgtagccagtaaatagacgaggtgtactttggatttgaatgtctgttgttccctttaccagatgtgtgtccttgggcaagtaacttaatcttgcctcctatgtaacatgaggaacattgaagttttgctaggaggattcattgcagacgcacaggtttctgttcttagaagtacccgtgtatgctttaatgctttgcttttaccatcttgaaattcttagtaattattccgtgatgggacatgcattttcatttttacataaggccccagaaattctgcagctggtgctgactgggtgaaataatgtgagtaaggtgcctgtgagcatcccttagatgaggcagatgctagatatgcattgggtctttttcttccaggtttgaatagctgtgtcttgctgctttcctgggttgggcaaaatgtagaatactgacactttatacagccacccccataagagatgcaggttatctgttgattacctttaagactggagaaagatagtcgattctcttacctgcactttagcaatgttgggaggatagaacttatttggagaacgtttatggcctaatagcttggtaaaatgtgaatcttcatgaaagtggtttgccaactctaaattgctatacaaataagtcctgattatgtgcactgaacaaaaggcttattgagcagtaactgattcagatggaggtaagaaaatatgccaaactcttaggggatcgcagacattcaaaatcatagctcctgaaatgtgagcatttctctgtcaattcagcagatgtagagcgcgattctatgcactgtggggcaaggtgttggaatggtagatgatgaaaaatcatggcttttggtcataggaaattatgtgatgttagcagcctagagctcacagctgaggctgctggaggtaatgctgagaggaagcatatcgtgagaccagagagggttgaagagaggatcttgagatctgtgtgcacctgaggtcctcaattttggattaacagaatccccaggaagtttacccagattgttatgacttttacccagagtgagaaccatcattgattaacacttaaagggcctggcagagaaccaggagagaagagttgaagttgtgaggatctatctcaaggcatgtgtaaacaacagtgcccaggtgagaagtggagctctacttctggaaattctttcctttctgttttccattaaaaaaaaaataagataaaattagtgcctatgttgaccagctctgttctctatgttttccttcccaaatgaaccaaatgaatgctagctcttgcaaggccaacatcacagagaggtgttattcctgtccccctttattttctctgcatattctgtttatttcacccacagcatgacacacttacggaaattatctcattgctggtcctaatgatcttttcccttcctctttccacggctggaatctaaaccgcatgagagctggggaatgggtcttgtttatctatctctctatccctaagagctagatttgtgcctaggacatcagaagcctccacatatttcttgaatgaatgaatgagccagttttcctcacctgagaccatttgcagcatgtcaggttgtcttgacgtgcagctgaattatttacattttccggcaattcattgattgacaccttgggcgccctacatttgtgctagcctcttggtattttttctcccagcttagatgttcctgctgttctccaggatgggtccttcttccttacagattcagaaaggagaatcttctatgaaatctacaagatcctactagaacgtcaggtctgaagggcaggactatgactatggtttccttattcatcatccctccataaatacatatttgctgaatctcttttcctcccttactcttcctgtatatagaagaggaggtggacatctatttggggtgttctcccaagtttgtggccaggcttaaggaaccccgcgacaccatttgttttcaggaa[134 bp omitted]ctgctgcctcagcctcccaagtagctgggattacaggcgcgcttcaccacacccggctaatttttgtatttttagtagagatggggtttcaccatgttggccaggctggtgttgaattcctgacttcaggttatccacctgccttagcctcccaaagtgctggggttacaggagtgagccactgcaactggcctataatcagtcttttatgtcattctccatcttcatgcatttaatagattacagcccaaatatcacaatcgtaattgaaacagatttgtttgttagaagagggggaggtattaatgaggctacacaggcactgctgtgaaccaggaaaactacacagtgtgggtatgagggagtgaagaatacatttatgttttaggtctcacttctttctttgcctgtattaagtagtaagggggagaactaacaaggtacctctgcatttaatggttcttttgcagtttggctgaactgtgtcttgaaatccttgaagagcattactaagatggtatagaagttacttgcttaaaaggagaaaagaaaaagctttaatatagacaactcaatagctgaactactcttgcaatgtgaatagccattccttgggtttctaaatgattttcacacttcccacacttgtttaaatttgtaatatcctttatggttttcctttattggccaggagaagaaaaacaccctgaagatctaggtatccatcaaagctgatggaatacactaataaaatcctgtgtcatattaaaatgtaaaatatatgctggcataatattgtctgagtcaatccaatggaataacataattaatagtggctttgataattaatttataggaggaagaagctgaggacagcttagttctttctgtctctgtattcctcccaccccctcatcttttctcctgctctctgtctttctctctctctctctttttaactagctgctgtttgcttcatccaaatatgcatggaaaagttttaagtggttgttgaaactcccagaggcctgtttacttcaaggtagaagcaggaaagctgccataattcagaaagcagcttctggcatgagatgaaagtcagatcagctcaagttggggtcagaatttagaggccccactggagtgtttatgcttgtatctgtagtccagataagttagtggaagaaattgttccctgtggcaggtcatgaatctaattacactagaaatattactacaagcgcttcattgaaaattgctaagcaatgtatgctatctatggctttcgtaccttcaaatcacatatgatatgtggaacacatcttccacgtgggcccacagacccataactcaagccatggtttctcagcagaaaacagaccccagagagctcctgttcctgaacatctgtctaaaaaaatgccctcttagagatgagagaaacagagaccttacttgaacaaagagagaggagcactgaagtctcaggagctgatcaggaaacacagaaaggaaataagtcgatggttttaagagctagctcagtgccacccatgttgcaatgtaggttctggatctaggcctttttcctgttttatgactattggatatctctcttaaaaggggcatagttattttctgttttttttttttttttgttaattttatgtattttttatttccataggttttgggggaacaagtggtgtttggttacatgagtgagttcttgagtggtgactcctgagactttggtgtacccatcaccagagcagtataccctgaatccgatttgtagaaacactaagcaaaagaagttccagaacagaattaaaactatgcagcattcctatttcctccaataaaaatttataattgacccttgttagcaaaaattttcaacaatggaaacattgagaatattcagtaaaacaaaaaacaaaaccattttgaatattaaatataaaatattgttccttgctaattgaattcttttttaaatatggaaacacacaattgctttttattaccctttcatttttttacattgttttgtatttgttcttatattcaaatgaacaggctattttcaagttaacacacagtcccactccttcctccaagttcccaaagtccattgtacgttttttttttcccccttgggatggagtctccctctgttgcccaggctgaagtatagtggcatgatctcggctcactgcaacctctgcctcccgggttcaagtgattctcctgtctcagccttcctagtagctgggattacaggtgcccaccaccatgcctggctaatttttgtatttttagtagagacagggtttcaccatgttggccaggctggtctcaaactcctgacctcaggtgatctgcccacctcttcctcccaaagtgctgggattacaggtgtgagccaccatgcccggcccattatatcatcttaggcttcgcattcttgtagcttagctctcactgatgagtgagaacatacaatgttttgttttccattcctgaggtaaggtgacctcgttctaattttatcaaatacagtatgtcaagcaacaacacaataaaacaaatgggtatagttatatctggtttgaatagaggctgtgggttcaaaatgaggataagtccagacctcatggaaacctccactggcatagcctggtgattcacacaggaagggttttgaaatcagatgttcctgcgtcataatctcacgctgacgcttactaagcctgtaacatcatgcaagccagttatctctcagcctggacttggtcatctgcaaaatgggtaactgtcacattacttgccttgcaaggttatcaggttggtacaaaagtaattacggtttttgcttttaaaggtaatggcaaagattgcagtcacttttgcaccaagttagtataaagataatggtataagcaaggttatgaataagtattttctatgttgataattctagatcagggtattgtatgacatgtaggcattgtaactgtaaaataactatgacgtaggcagggtattgcatctgaataagccaggtagtgaatctattatcctacaggtagattctttttttctgtaaggtctttgaggtaaggtaggaataaggatagtgggagccagcggtgatgaggatgacaagatggtctaaatcttctccctctctggcattattgctgtttatttccttggagagagaatctactcttggtattggaatcagaagcagggaaactaagggaatgaatatgaatgtcaaagaagaaatgggatgcgggtttgagcaaagaaaatattagttaatgaatgttttaggaaatttgcaatgtctggaaggtaaacgtctttctcattactaatgtgactacaggtcgtactgtgtgttaatttgaaaatagcctgttcatttgaatataagaacaaatacaaaacaatgtaaaaaaatgaaagggtaataaaaagcaattgtgtgtttccatatttgaaaaagaattcaattagcaagcaactatattttatatttaatattcaaaatggttttgttttttgttttactgaatattctcaatgcttccattgttgaaaatttttgctaacaagggtcaattatataaatttttattggaggaaataggaatgctgcatagttttaattctgttctggaacttcttttgtttagtgtttctatatacattttctaggtagaataaaatccattgtacatattttaaaaaggaaaaagtagtccggagtgagtccttcccattgactgctttggacattacaatctgccatctcttcctctggggcatccaggagacaagccctaggagactgagacatggaatggtgatttcataataaaacaagagacaacagggcaattcagtgttcagcgccgtggagctgtgcactgttgaggaacacatcagggcagcctggcccacagatttagaaacagagtgagactagaagggccatctgctgagtaagtagagacctcaagatgtacagcgtgtgttttatgatccggaaggtagattttccccccgttcatgtaaagcacttcaaggacttggtaatgggacaaggagcttttaacctccaggttactggttaagaaatgtcccacatcgatagtgaccagaaggcattgccgtctgctggctgcgcagtggcctatgtaaatgactttaaggtctcaaagcaaaccattatgggccgactttctatcccaccaactcttaactccgagtacaatgacccagactcagactccttgaagtagtccccgtggagcctgatgggaggacggcaggtggctaacagcggcggcttccatgtgggactctgctgtggcaatgtttttttttggaactcacttatttttatagtttaaaagaacacactttatttttcactctggtgagagactttttaattatgtcttttgctgagcatttcaagatggtatcagcatctgacatttgaaatgccttctttgccaggcactctgataagtgcttaacctgtagggtatcatttaatcctccccactcttcgtgagttagaactctgtttcttgttttataaagtaggagactggggcagagaaaaatgaggagatctgcctgaagccacagaagcagggtaggattcaagacctcccctttgtttagctaggattcatgttcatttctttattccatccaattttctaaaacatttttaagaatcagtgtccctttatgtttttcctaatagaggtttctgtgacctcttagcacacatgaactaatgcaggaatgtgcagacactgtccgtcaccttcctcacagttacctctcctgcttcccccacagctaatggaacattgattttgttaaaggattgggaagccatttgtttcacaggggccttttctagccccacccagtgaatcatggttggctttgactgatcgtaaaatgctttgaccaacaataaaacatttccttgccagtgatttgtcttggatgaacatgcccatgtatgtgaagagctcagatggggcatgcccttgagaaggtttcttgatcttcacagagctatagaaaagagaatgcttattttctttcttttggcaaagttgtgtggggagctgttgagtccaacatgtaacagtgagacgaggtggccagcttggccacctgtgggacaatgctgagggttgtggggggatccaagaggacttccctccccacttcccagtggccaactctgccactgacctgagttgttttccttccttgtgtggtagcatgggtgaaaccagagacgtgcttatttcagtccattgggggctcttgtgttactcgtaactgggcattcttgctgaaatgggtagtctgtatactatgtttatttaaatgtattttatttcttattattttaagagacagggtcttcttacgtcacccagactggatggcaggggcatgattatggttcaccatagccccgaactcctgagctcacgtgatcctcccacctttgcttctcaagttgctgggactgtaggtgggcagtgactaattgtttttcgcatttttttgtagagatggggtcttgctatgttgcctaggctgctctctcactcctggtctccagtgatcctccaccatggcctcccaaagcgctgggattagaggtgtgagccaacacccctctaatataaataaatcattttataaattatttataaaaatttatttttatgatttgatttatttatattccctttaaagtgtacaaataaaagagacataaatgtagaggtgatgatacaactttcagtgtacacagcaaacaggtggccaaggtaagcccagaaaccatttgccctacttctctgggcaaatggttgccagatacaacacaggatgcccagctaaatttgaatttcagagagtcaatgaatatttttccttagtatcagtatggcctaaatatttcatgaaggcctacttacaccagtcatttcagttgtttatctgaagtgcaaatttagctagactttctgtatttttatttgctaactgtggtaatcctattctgccaggactacatgctttttatcatttgtcttcctatttttggactcttatttgaaaatactaaatacccagccaccactaacttaagccaaagaagtttatttgtaagcttaatttctaggtgtaatttatatgcatatataaatacaagttatatatatatgcccatatataaaatgcatacataattatattgtaattatatgatgcaaaattgaatgtataggtttaaataatttataggcttatgtaactctgctctctgttatatttcttgccaagtggattttgctaagataattatcagcaatgttagacttatgtcctatcatctttgtgaactccagtgaaaagaaagctaccttttttccaagagttgaaagcaccaagattagatcctattggatggatttaagtcatatgttgattcctaaactaattactatgagcagaaagatgagatatactaattggctgaacctggtcatgtgaccacatttgaagatggaggataatgatacagcaaatcatatccaaaccaatggaaactaggagcggggagattccccgagataaaacccgaacgcttttacaaaatgaaagtggagtggcttctgggcaaccaataatgatgtccactttagtcactaggtatcagacacaatgctggtctgaagaatgtgatgcttgcaactgtccggcggggccttggacttgtctgaatcggtattttgctgaaagtgggtggagggaagtgaaggttctgcatcacaggcgatgcacctacagcaatcagatatttgtgaacaaggctgttttgttctgtgtcagaagttcagtggggttcagcttgttagtcaatagtgaaggaaataatggcagcccgttccagtctcgccgtgcctgtgaggcctcctttgatttttccctcgtaaagaatctcatttgatttttatataaaactcagatttgaattttattggagtacttatacatgattgcctttcagtgaaacttactgtcattttagccgtaatgttctagcaaatggagtggtgttttttagtttcttttaaattgtttcattaagcaaatatttattgaccactgcacatgagttaggcattgcggatgacagagaaaaagtcagacaaaagtccatgtcttggagagcttacctgaagacattttgctgtgtgtatgacagaagtaaacggtccaagtttctgcatttaaatattatgttctctacaattatattgctctgggaaactggggagagggcacgtctgggaatttgaattctaagagagaatagacaggcacctattaaaagtgaagttggttttctagctttttctgactaggtgaaatttctctgtcataggtttgttttttttttttgagacagtctctctctgttgcccaggctggagtacagtagtgcactctcggctcactgcaacctccacctcctgggttcaagcaattctcctgcctcagcctcccaaggagctgggattataggcaccgaccaccatgcccagctaattttttatttttattttttatttttgagatggagtctcattctgtcacctaggctggagttcattggcgtgatctcagctcactgcaacctctgcctcccaggttcaagcgactctcctgcctcggcctcccgagtagatgggtctatagacgcacaccaccacacccagctaatttttgtatttttagtagacacggggtttcaccatgttggccaagttggtcttgaactcctgacctcaggtgatctgcccgcctcggcctcccaaagtgctgggattacaggcgtgagccaccgcacacggcctctgtcataggtttttggggggagaagctcctttcttcttagtggttggaatagttgtgagcaaagaatgctcaaagatgggcattctttgaggacatttgtgttcaccagaggacagcaagtgcttgaaggcagaagccatccagttccagtgcacacagcacagggtctgccctaaatggagaacccaataaagacttgttgaatggaggaaagtttgccttcccctcctgcttttttcactctggccattgaccttcccacgtctcagacagatgaggaaatgtcatgttaatatcaagaagtatgtacagtgaatgtgctcttaacctcatttttctgcagcttcattctatgtttccttaaagatttcgcagggatgtgatttggttccacccattgcccacatgtacaaaaatgacagaagactgacttgaagtgggcatgcaaagtaacattgcttttccaaagtgccaagaggaggatattcggtattaaatcagtatctccttaaatttgtgctgctcttttcttttgccagccttaaggtgctttaataactgtgagacatagtagccaggtgcttcctaagggaacctgagacttacttaaacctcttcccaccacaggtcaatagaatatacctgtgattgttcttaccttcagtgaagatgcttatgccttattgaggcatttactgatacaaaaaaatgccaggccagtctgacatcttaacctaaatctacagggtttataaggtaatgtgtacctgcaggaatattttttcctaaccttaattaaatgcaaggggaacaattgtaataggagtgccattttagggaggaagtaggaggtctgatttatggctgtcaattgttgcctctgtttttttcttaatgtgtatatttgaggtgtatgcaacatgatattgtaggatatatatagatagtaaagtggttatgatagagaagcagattaagatatttatcatctcacaaactttttttctgtgacaaaagcagctaaaatatacttgtctaaaatagggaagtcaaccttgatgcttcacttcccttttgtatctggggcttgctcacctcttggcccctccagcaccatcaccctgggcaaacaccgtcatctttgagtcattaccaccagagcctcatacacagatcctgcatctagattctcctccatccagcccgagtcatgctttaaatgcacgcatcttctcctgtctgttcccagtggctttatcacacaatggttttgtgagaacaaagctggaggtcctcatccttgcttgcaaggctctgcataacctggtacctggcaccactcccatcttgcctcctgcaactgcagtcgttcctctaggagccatccttattccatcccgtcttgggcctttgcacttgctgatctctcttgatcctctcaagatcagctctgttgtcccatgaatgccttaatctcgagtgtcctttcctcagacagccttttctgagattgccctcatcgctctccgcacacgatcctgctttatcatatcatgactagaacattcgccccttgttcatttgtgttctatctctccttcttcctaccgacaatggaatgcgagctccatgagcacagtggtgtttcccagctttattctgcagccctgccccttgaacaggctttaataaatcattgttaaataaataaatggagaagtgatcactggctgggcacagtgactcatgcttgtcatcccagcacttggggaggccgaggcgggcagatcacttgaggtcaggagttggagaccagcctggccaacatggtgaaaccgtgtctgtactaaaaataccaaaattagcttggcatggtggtgcacgcctgtaatcccagctactcagggggctaaggcaggagaatcgcttgagcctgggaggcaaaggttgcagtgagcgaagattgtgccactgcactccagcctgggcgatagagtgagactctgtcttaaaaaaaaaaaaaaaaaggattgattagttcgtcagtaaattatcttactctctctccatcccattggctggggcagctgactaacaaaatagcccacacaagggaagcaggggttttgtcctgcagagaaaacctcatagaatttaacatccgcatccaaacataaacactcaggaaatatgtctggaaaggaattgcatggcatctgcttccttccatggtgactttcaaatgacaaatgcccaacatcatttagggtggtagagcccctttgaaagagctggagctgattgcttctatcatgcccagaaaaagtcattgtcatctacacacacctggcttacatttggagaaaatgagcttctggtttctgtcttgctccaagattgaaatttccgtgctttgtgttactattaccaacagatacttttcttttgtgaagcgtctagccagctccctaatcactgggaacaaactttgagtaggttgaaccaaaggaggtgtcagagtacatgctttccagccaaataaaccttcagaaactgcaggggctggaggccctctcagtccttcacagccaactaagggtacttatttttgaaagttggactttttttcttagttattaaccagcattagctgcaaaagcattataggaaagaaaacgccttttctatgaaggtcagattcacacaatgcagatttccaaagaacaggatttctgtatttttaattgtttggttttggagactgggcgtcactctgtcacccaggctggagtgcagtggtgtcatcttggctcactgcaacttccgccttccaggttcaagcaattcacctgtgtcagcctccctagtagctgggattacaggcacaccactacatccatgtaattcttgtatttttagtagagacggggtttcaccatgttggcaggccagtctcaaactcctggccttatgtgatccacctgcttccgccttccaaactgctgggattactgtcgtgagccactgcacctggcccagatttctgtattttaacaggaagtgccaggcatgcttatggcttgatttttaagtgggtggtgcatctatataaaatgtgacaactattatctgtttaaggaacgaaatgcagggccagtgaaacatagatgactctcagtgaaatactgcagaaggtggttcttccttcacccaacaacagtggtaacagtgtttccaaggaaagaacaactcaagggagacatttaacccccaaagaaagttcataatgttatatgttacaagatgttggtaaaccacacatggaggggaatgggcatacaatgtgcttttgcctttgtgtgtgcgtgtgtttgagatggagtcttgctctgtcacccaggctaaactgtagtgacatgatctcggctcactgcagcctccacctcccaggttcaagcaattctcctgcttcacccaaccgagtagctgggactacaggcgtgcaccaccatgccaggctaatttttgtatttttagtagagacgaggttttgccatgttggtcaggctggtctcgaactcctgacctcaggtgatccacctgcctcaccttcccaaagtgctggggttgcatgtgccaaccactgtgcctatcccacaacgtgcttttgagcaacagcaataactccagacaaaatgagacccagagaaggttaattgtgaatcaccctttagacacagcactgaaggaagggttgtggtgtaagtagatacctagaatgggatgcatattgcctgaaaagataatttctggaaatgatgagactgggataaggccaaggggactcacctggccaaaatacaaatagagtgtttcatacgttacttttgcggggaggtaaagaccagagaatgagtgtcaaggcacttattttttgagaaatgatgaaagatgaacagcttttgggagcatgttaaaacagatttcatctgggaatttcattttgcacaaaggaatcctgtttgagcataagcgattggtaagttcattgttgttatagcccttggttatgctaaatacgttagtagctgaaagtttccaggacttgacaaatcagataaatcatggagtttttcttttctagtttttacctgattttggatgttaatttgttgttcattgacagtgggattttcatgcaaatgttgggtgttctgtaagcctgagaagtctcttggtgtcttagcctcaagatagcagagactttactggttattgttatttgttctttccaaaatgtttccgcagatcatatttttaaataaattgtaaaaccagtgatttgtaaaaatgccaggtcagtctgacactgcaacctaaatcttcagtatttataaggtgatgtgtacctataggaatattttttttgcccaatcttaattaaatgcaaggggaacaattagaaaggcccatatagggaggaaataagaggtccaattcttggttgtcagacgttgcctctgtgttttcttattgagtatatttgaggtttacaatgtgatgttatgggatacatatagtaaggtggttataatagagacacagattaacatattgtcacagagttacatttttgtgacgagagtagttgaaatcttcttatttaacaaaaattgctgatagaattttattaactttagtcctcacgctgtactcaatgttgcctcttttgttgtgttttatattctgtgaccatacgttttgtaacattaatcatcatccaaagactacactgcagaaggaattgtttacttggacattagtctacatatgcaaaatcaggcagatatttgtacttctgtatctttgaattatatgtaatgtcaattgctagatttttaaaaatataagcctgataatactataaataattataaattaaactacatttctgaaagctaactcttcaagtgataggattgttctttgcatacctatttgtatcctgaggaatcttgcatttccaaaatatatatatattagttagaagtgatgttttccacagagttcttttttgcattgttatattgatttttttttttttttgagatgtagtcttgtttcattgcccaggatggagtgcagtggtgctatctcggcccactgcaacctctgcctctcagattcaagcgattctcatgcctcagcctcccaagtagctgggactataggtgtgaaccaccacacctggtaaatttttgttttgttttgtttttttttagtagaaatggagttttgctatttggccgggctggtctcgaatttctgacctctggtgatccaccccccttggccttccaaagtgctggtgtgacccaccgtgcccagcctatatggaaatattttaattgcctgtaaacacactcagtggagctcgttacaagaagactgtcgatgtacttgaaaagtttacttctgcataatgctaaataccatgtcagaaatcacagaatcctacgaagttgaatttttcattaaaggatcataagtaaagtttggggggaaagtgtgcagttcaatagatctcaatatgaaatggcatattattgttatttatatgtatatttaatattatataaaacacttttgttttaacttaagcatttggattctgattctttgaggcgtgattatggttttgtcattcacagcttagctatgtcatctcagataaattaatgaaatgtccaagcctcagctttggcagtttttaagtgggagtaatagtattaatacccacctgacaagattaccctgtagacggaacaagataatgtaaaatgatgaatgaaaggctttacatacagcaagtgcttaataaatgacagctcattatcattattgtttttatatttacttttttttggttgaaaatattaatcttctgaactacccttaccagtgccaaaacaaccgtaaagaaacaatcgtgcagtcctgttatccacgtggcatgagttacagggttcattatactgaagacaataaaaaccaaaaagaaagcagcacctaggaaggagctatttgcagaagtctcactcaaaagagttcaaaatgagagttccaaacctaataaagataacacgtttgccctctggtggacattcattttgagttagaattttctctgctaagactagagatttttcaacctccctaaaatgtcagggtgttgtagctggagtagcaaacagttctgcctgcttcgtttgaattttgtctgataaatgtgcaggtgaacgtctaaacgcacaacatgcatgggcaaatgaaatgttttatggctacagcgtaatgctctcctcatttttgttcagctccttcaggagttaacaattgctaagggttatttacaagaaatctgagctgtctgatcactcaactgtggaaggtaaatgagatttttaaggtgaagggaaaaggagaggcaaatggtaaaatgggccaatgcatgaaaaagagggagacgtcaaacttaggtactggaattgccgggatgttgtcatcaacgatttgatttgatgggaaagggatgcttaatgtttcttctgtgaggtgtgtgcctgtaccacacacatgtacacatacagtggagtggaaagtattcctgcaaagggccgcaattctcagagtgtagtcttttctcttcctactcgaattggtaaaaataaataatcaagactgttttggtggcttctggttccccaagtagaaagcatcttagttggcaattcagtcactgaccttgaaataggacaccagacctattgctaaaacgtcttccacctcacaggccttccctgcctgctgtcctggtgaacttgttgactctatgcacataaggactctctggggtccaaatgacggggaccaagctcgcacacatcattcagcgaataggctggctcagctaaccaaaggttccatgggctcatctagcttaaggtggctgtattccttggggcggggttgggggggaatgaaaataaggtcatcaaggtgtctctctctttctctctgactctctatttctctctccttctccctccttccatcacatatctctgttttctttttccatgttggtttcattctcaggtagacagtcttcgtgtggtgacaagggtgacctgagactccaaacctctgtcttcatcactgcctttgttttcaggaaaaggagagactcttactctgagcataacgccggtccctgaataaggacagcatctctctgtctgtatcataagcccactttcacaccagttacctctttggtgggagtgggttactctgaagagcctcagtcatgtgcccagccccgtggggtttttgttttgttttgttttttttgagatggagtctcactctgttgcccaggatggagtgcagtgcctccatttcggctcactgcaacctccacctcccgggttcaagcaattcttccgcctcagcctcccaagtagctgggactacaggcctgtaccaccacacctagctaattttttttatttttaatagagtcggggtttcactatattggctaggctggtctcaaactcctgacctcatgttctgcctgcctcagcctcccaaagtactgggattacaggcataagccatcctgccctgccttgcctgtgttttgggagtcaaggcgagatgatgagaagggagggtatttgctgacgaatagtggcgttgtgttgctaaaagaagggcaaagggtgttggatgggaagagccgaaacacgcatgcgtgatgttcagggcccttagtccttgttctttttgtctctgcaagtttgccgaagttgctctttgataatctttcttacctttccaaattgcacctaccctttgacgtatagctcaagttgtactttctctgtggactttttctcccagcctggcttcagcttgccttcgattttaagctgagagcacttacctggtgtacccactggctgtttaagtgctaacggtagctcctgctgttattgttatctcttattccagccttctaacattttttccactgtttcattttgttttttgtttaacggttttattactctttgttttggggactgacaaatttttggatgcccatcttatctaacacagtcagtactgcctcttttgatgatagtgagataggaatttcaggagaccaaaagaaagagcttgctcaaatattataacttgccctttagtcacttttaaaatgcaatgtccaaccaaccttttagttcttaatggaactcttgtcagcaatctgcttgaaggtcagcctcatcattcttggatgtggtcctggggcctcagagtgggcattgttcccttagggagtggaggccagaagatgtagggtgccccatagcaggcatctaaggctttgggtgctccaagcactgctccgggatggggtcaaggaggagaagttgcttgtccttttaaaaatttttgcctatgctgcaaagattatgggtcaaagtgaaggtcatttataaactccacccatggcaaaatccaattataaactttaaccttagtgaaatgtcattagagcttggcttggctttatttgggatggagactgacagttttgtctgtgatatattcagggagacatatctattaaagctagtctaacaatgggggcacacgcagatttgcattttaattcgttttccctcagtgctgatatgcggcttatctttcaagaacaggctcacatcaaccctgatatacgttgcttaagaataatgctcataatctattagtttaatctgttcacatgagaaagaaagaagaaatcgtgcatggtgcggagggtttcaggccccagtgggcgattttttggaggatttcccattacaactgttttcaacttgtgcttgttttcctttctctagcttaagtatgaacagcttaaggagaggtcatgtcttccttctacgtagagccaggcaagctcacattacagtcaggctcccaaagatgttggttatatgcagacttctgaacttgggttccagtttcatgatctgcaatgagcctatagcaattcaaccttgaaaatgggttttgatcattaccgattatgtataaaaatgacccatcagaggacccgtcagataacagataatcaatatttttatttttctggaagtaagatcgctgctaagacctttagaactttctgatacctgcaatactttgtgctttttctctcacctctgccactcctgggggagggaaggggtcttttctttgcaaagtgtgtttaatattggaaggagttgtgtttaactctaagagttctatctcactttgcccagtgttctgcattttcactggttctttcacttttttactttttttttttttaaacactctcccagtggattctctctggggtccagtgaccttgatgtttttcgtccagggaagatggctgaggcatcccagcagggagtcaggagtaggaagaaggtctctgtaacagagaagttttggaattgccgtggggtgctacagcatgaatttagagttgggcaaaagtgcctgaaaagcaggccttctcatttcataatgagcgtcatataaaccatgtttatcacttcgtttagccacattcggatttgtagaaaaatggatagaagggatgactccaggcagattagcaaggggattgcattgatcttggggtcattggagtaaagcaaaacatgatcactgacctttagctctagggtcattgacttggtagatggaacttgaaagcaagagtagaactcggcaaatgtggaagttaaagataaaatgtggcctggagagtctaatggaccactaaggattaatgcactttgttatcacgttggggaaagacgagaaggagtggagagaaaagaaaatttcgggatttgaattcttatacatggaagagttcagagaggttatgtccctagaaggctgagatagagaaggaggtttctgatgaaaaaaaaagcttcagccaaattaaatttaaaggagttaattgaacaatgaacgattcctgaatcaggcagcccccagaatcagggcagattcagagagactccagcacagccacgtggtggaagatgtatagacaaaaaaagggaaatgaggtacagaaattagaagtgaggtacagaactgagctagattggttacagctccgcgtttgcctaatttgaacatagtttcaacactcagcagtgtatgagtgattgaggtgcagccactaggattggccaagactcagttgttgttacaggcacatgctcctaagttaggttttcttatttatttatttaggtggagtctccctctatcacccaggctggagtgcagtggtgcaatctcagctcactgcaacctctgccacctgggttcaagtgattctctggcctcagcctcccaagtagctgggattacaggcatgcgccaccacacctgactagtttttgtatttttttttagtagatagggtgttttaccatgttggccaggctggtctcaaatgcctgaccttaagcgatccacccacttcggcctcccaaagtgctagattacaggcatgatcttatcgacctattaagttaggttgcggtttgtccacaaggactcaaatatagaagtggggagtccttctcaggccacatttagtttgctttaacacagctgaattatatgtgtgaggctatggcatgaggaagggtatcatgaagaggttgaagtccatgaggtaatgagagactatgaaagccgtgttcatgtccagtatttgccatttgcttgtttgttttcttacccgctgggttccactgtagtgttaagtcctacgagaccctggtctgtcctgctctctgctctttttccaatgcctttgacagttcttagcatgtaatcaatctgcagtaaacagctgctgaatgagggaattaataaagtcaccaaggaattgtgggctcctcttctgctctgagccccgtggatgcattgttatgcgtaataagtgtgaaatgagcatttgttgattgtattccatgtcaaagcaaaaaataaaaataaaataaatgtcagaatacactcatggtgctattaattatgatgtagagctttttttcaaacttttattttaggctcaggggtgcataagcagtttttttatttaggtaaacccgtgtcacgggggtttgttgtacaaattatttcatcacccaagtactaagcttagtacccaatagctatttttctgcttctctccctcctcccaccctctatcctcaagcaggccccactgtctcttgtttccttatctgtgtccctgtgttctctttagtaccgtttattagtgagaacatgcggtatttggttttctgttcctgccttagtttgctaaatataatggcctccagctccatccaggtctctgcaaaggacatgatgtctttcttttttgtagttgcatagtattccatggtatatatgtaccacattttctgtatcttgtctgtgattgatgggcatttaggttgatgccatgtctttgctattgtgaatagtgctgcagtgaacatttgcatgcatgtgtctttatgatagaatgatttaaattcttctgggtatatacccagtgatgggatcgctagatcaaatggtagttctgtttttaggtagagcttgtcaggatctcttcttccctctctccttctttgtctatatatgcaggtataacaggtaaaacatatgtgggatgattctacatattttgtaaatattttccatgtcaacatatcaatctataacaccaatttcaaggttttgtagtccagccgcaccacaacaggttttcatgcatcccctattgttgagcatttaggttgttctcaattctttccactttcaatgcataaggagttcaagactcgatttagagaatgcctcaaaggtagcctttggccaaatctagaactagagctcaacagtgccacagcctaaaagatgaaatttagacacattcctggagtttggtgggatatttggctcattggcttgttggaccagcagttagatttggagtggttctgcaaatgtcttgccatgaacatatgatataatgcttagagggttaaaaagcatacctggattttcaagggttaaaagtagacctggattttaggtcccagcctggcctagagcataagtgacttgtggacatcctgaaaaagaaacccattctttggaatagcagaaaagcggcatacatcttcagatgaatagtaagagtgattgtgaaccaaagggtctgggtgacttggctgtttttatcttatttttattttatttatttatttatttattcttttaagacagagtctcgctctgtcacccaggttggagtgcagtggcatgatttccgctcactgtgacctctgcctcctgggttcaagtgattgtcctgcctcagcctcctgagtagctgggattacaggtgcatgcctccacgcttgggtaattttttgtatttttagtagagatggggtttcactgtgttaggcaggatagtctcgatctcctgacctcatgatatgcctgcctctgcctcccaaagtgctggtattacaggcatgagccaccgagcccagctagctgtttttttatcattggtcaaggatgtcacactgcatggtggtggacaaaccagtgctgagaatgaggccttgcagccaagtgtgtcactttgcagcctgtgagctaagatgtcacttgcaatcgtgtagggagagtgggccccggacagcggggagatacaacgtcctcatcttctgcaagttgctctggtgggaaagaagggaaagcaggaatgagtaagggaaacagaggaaactgagctctgaagcccaacctctgcttcatctctcgtttacagttccatccctgtgagcaaacccttggtgtctggagagcagaaccatcacttcccatcttccttggctgtcaaccaaaaattgcccctgtggccccctgtagtgcccctcaacttcatgtcctacagtagaaagtcctctgtaagctcttcaggatgcacagtctagaataatggatgtgatgcagcctcagtggtggacttcctgagttcaagttctgtccctctggattattcaatgtagaaacttcatcacattgtttaaccttcctagatgtgtttgctattcttcacaatcaggatcacacatatagagtacatcacaaacaatgtaagctgcaggacagaagggttttgtgttttccaatgctgcatttatttttttattgctgctataacagattactgcagacttggtggatacaacaacacagatttattcttttacagtttgagtggtcagaactcgacactagtctcacagtgcgggcagagctgcactcctttctggaggctgatgtggagaatcttagccttttccagcttcctgaggcatcctgcagaccttagctcatggcccctttctccatcttcgaagccagggatgtagcccttctccatgcatttctttgatagtaacagcaagaaaaggttctcagattttaaggactgatacgatgatattaggcccacctggataattaagactaatttttcccatttcaagatccttaacttagtctcatctgcaaagtccctttgccatgtacggtaacatagtcacaggttcccaggattacagcggcgtggacacttctgaggggtggggtaggcattgttctgtgtactatgactgccaacacccagaatagtgcttgacaggaaaacagatctcaaatatttgccataggaattaacggtgattattgaagagatccaatgtctttaaagtgcctagtgggatacctggcacatgggtgagaccttggttagtgttacgtgttatttgcagtcatatgcatcactcaaaggaaaatttacaaacacacatgtgtgcatgtgcacacatagacacacacacactccactcaccagtggatattgtttctagatgcttactccctgtctacccaaatcgattgttcctgctgcaggggcaggagacaaagctattgaattgtatggagtggacactgaccactccctttttttttttttttttttttttgagatagagtctcattctgtcactcaggctggagtgcagtggcacaatgtcagctcactgcaacctctgcctctcgggttcaagtgattctcccgcctgaacctccagagtagctggggctataggcgtatggcaccatgcccagctaatttttatattttcagtagagatgggtttttgccatgttggccaggctggtcttgaactcctggcctgaagtgatctgcctgccttggcctcccaaagtgctgttttgtttgtttgtttgtttgttttttttactaattatgagtcagaggaaagagctgtcccttttgaagtcattaaagttacagagtccttcacagtgatctcgaaaccttggagaactttgaaaataacccaaattctcaactctgtagtagcagactcccaagacactgcatatacttttttattcccttgagttcatcaccctgtggttgagaggcaacttaacaggttactggagctgtctgacttggtttgcacttctatgagtcggcgtcatgttgggtacactttgcctttattcctcgaatttgctggttttttggtttcagactgagtggtggagaggaggcaagatcaatacctcattgtcctcactgttgcgctgtcatcagaaagcaaagtgtgtgtctcctgttgagaatacaaaagttagggccgggcacggtggctcatgcctgtcatctgaacactttgggaggccaaggagggcagatcacctgaggccaggagttcaagactagcctggccaacatggcaaaaccccgtctttactaaaaatacaaaagttagctgggcatggaggtgcgtgcctgtagtcccaactattggggaggctgaggcacaagagtcgcttgaacccaggaggtggaggcttcagtgagctgtgatcatgccactgcactccagcctgggtgacagagtgagagcctatctccaaaaaataaaaataaaaataaaaaaataaagaaaagaaaaatataaaagttaggatatcagcacaagaacttcagtgttgtagatctgctctgattcttcattcttttcaagacatgatttggatgttctgcacctacgtctcatgctggatggtgaacttcagtgcatatgctaggatttgtgctccttttgcatcctgtggctaaaagttcaggctgatcagctaagctttctctatgtgccaatctaaggatgcctttgagaatagttgggaggtcatttgacaccctttccaatagtctactgcttaaaaggaaggctctggtggcagatggccagagctaagctcctgtatccactgctcactagctgtgtgaccttgagcaaggtgcttaagtcatctctcttcctcagtttctttaaccatagtgtggtaatagaaaccatacgtatctcccagagttgttataaagataaaatgagttatcacagtgtaagcacttagaactatatctcatatacatagtaaatgcttgttaaaggcttactgtgagtccgtgactacagcttatattcatattcataagcaaatagcaaagcaatagaacctgactatgaaaaaaggtagccatgagggaaagaaaaaggatggtctcctttggataaacattttccgtaatacgtccctaggaacacattgtccacaaaagatgttaataggagtgctgagttacagggtaccacagtcataaatatttgggaaatttcttctcctggagatttatgatgcgcattagtatgttaacattacacgttctgctagagctcagagtagagacactaattttggctttatttaatccagttggtcccagatgtgtttgaccacccggtttttctgtaggtcgggggggtgggggcgagaggatgggcttagaggtggttgtaatggttgcgcttttgttgtgcatagcacctagtaatagctgtaggaactagtgtttcctctcaagggcacgctgtaggatagtactagaatttaaagtgcatatagggatctgagtaaaatatagatttggattcagtctggcatggggcctgagatcctggatttctaagtggttccccattggtgccgctgctgctggttgtactggtctgtggactgcactttgagtagccagactttcgggagcagtctcttggtgataagaagaggacccacacggggacaatcagaaatgttagcaattgtgcagtaaggagagaggagagcctgaggcagaggtttgcaaccttgactgcctgttagaagcacctgggagaattcagaaagctgctgtttggactccacccccagatatgttaacttcaaaggtttggagatgagtcctaggtattggtatttctttttcccacaagctttccaggggaggctaatggaccaccaggctgcaaaactattggtttcatagtgatgggcttaatttcttaagtcagagagcctgtttctaatcccagccctaaattactacacatcattagtaatttatttattttttatttgagacctagtcttgctctgtcacccacgttggagtgcagtggtgtgatcttggctcacttgcaacctcggcctccccagttcaagtaattctcctgcctcagcctcccgagtagctgggattacaggtgcccaccgccatgcctgaccaaatttttttttttttttttttttttttagtagatatggggtttcgccatgttggccaggctggtctcaaactcctgacctcaggtcatccgcccgcctcagcctcccaaagtgctgggattacaggcatgagctactgtgcccagcctcaggattgaggaatttagttaaagttgctgtgcctcctttcttctcattgtaagaggaggcaatcagggtacttaaacttcaaagagtcttgatggagatttgatgataccatgtttgcatcccaaaagactggtgtctaacacatggtaagggtgcagtaaatgtcagttgtaataacaattattgttatgagtattattgttattatttgctaacaaccattcttaggtcatttttttttttcttttccaatctgaccaagatattgtattggttacaagctaaaaccagataaacatgtatttaattttcttaataagtggagaattgtgttaaatgtcttttgggtacatgtgtccttactgggggagtgcttgcttctagcctaagttgcctccagcaagcattcatggaggctgtgattgccgtgagaacaggtcaaaaactgtttttgtttactgtgacaaccccagtgcctggacatagtggttcaacctgtcttggttgttggcgttgaataaatggatggtaaccattccaagtggagatatgtcagctcctgtctgcatccattcatttatttcagcaactgaaaacaacgtaatagtcatttaaaaaactgaggaataccatattttggattatttgttgttccggtgattttgccaagtgtggatttcctttgctaattatggaagtagacaaccaaatctcatttcttgtttgttttttttttttttttcctttctagaagcagctgtgttccttgccctctgccaccatcccactcatacactgtctaaaataaatagctttttctttttctgccctgtcttgtttctttctccctttgccctccacccaatttcctcttcccagtgaagtctgtaataatgtatcagtttacttaatgcaattcccagccctagctttcattgatttttttcttatttgactattggcttatgatttgtggggtagaggaggtggtgtgcatatcatgtgaatggaaaggcttaataattttcatactgtttcataacaaatatatattgtattcaggttcagtgactgcctttatagaatcatgtcagaaagtggatttctatcctgtttcatcttctatgaaaaacggaaaacaagaccttttcccctcactgtcatcccagcaagatataaagatgctcaaatgaacatttgtggaaggacttgacaggtgcccttggaaaggaagcaggattttactcactgatattttgaatatcatgagagttagaattacgaatgagtacacccaagcacgcagtcggttaaggagactttcatactcattgtggacactgctcacaggcaaaattgattgtgcggctccagttgctagagccacggggatttgagaccacagctacatccatctaattcaggaagaacttgaaatagctcctgcattttcagtgggggtaaaaaaaaaaaaaaagagccttttcacatttatcctgaagatggagccatttaacattttggatactttctgatttttaaatttataactttaaattgactttgttttgagacattagtgtttcaggattttatttttccctaaaatatgattgcttcctaaccaacagaaggaagagtagtgtgaatatttggttatggtcatggacacctggggaccagcctgtgtccttgcccatatttccaaaggtcactcttttttttttttttttttttttttttggagacagagtgttgctctattccccaggctggagtacagtggtgagatctcggttcactgcaacctctgtctcccaggttcaagtgattctcctgcctcagcctcccaagtagctgggattacaggcacgcgccaccatgcctaactttttggtatttttagtatagatggggttttgccatgttgaccaggctggactcaaactcctgacctcgtgatctgcccacctcagcctcccaaagtgctgggataaggtcactctttcttgtttacctgtttctgcccatatctgtagactcagaaattatttactaagcatttctaaaatgtgtttagaattcccatcactgatggcttactatgaaggagagcatatttttaaagccatataaaagaaggaatgtgtttagttctgttactcttgtattaatcccttggttattgaatctagaatctttgagcccggatgatcctagagggtatctagtctaccttctcatctcgttcttcaagacttgtatttatgtagctagttgtcatggctggattaaaatatctgtgtttacttatgtaactctcaaaactcactttaattgatctttttagcaagggcctgtttttcacttgcaaatgaaggtgaagtaaatacagattggcattttctgtcctaaacagccaccagctcccatagctgaatactctcatataaggaagacaaaagcaacaacaaattaggggccaaaattccttacttagaagatgagttgtctcaattgggaaggatttaaaaaatatttgtataccactcaacaagccatctggagaccatcatgggctgaactcaggtgagacatcttgataaggtactggaagaacagctgtcttaccacagggagggtggatgtggaaagaaatctagaaacccaaatataacaaggagcccttaaagcagttgtgggcaactcctgcatgcttgagatgagcagtggagacgacagtggggctgtcttctccctttaactatccaacgccgagggtcccaggctctgtgatgatgatgtaggcaatttcttaagaacaagtattgtttttggtagctttactttctagaaggctggatctcagttctctctcccatatcacctgtgtccgcaggtggggagattgatgtttagagctaggtttatctgtataaaggaataattctgatcgtagaaaaactcgaagtactggagacctgaccccatgttgggactctctgatgccttgaacatagatcatcttctgggggctgggctgtagcatcaccctcatctcacagtctgaagtcctggcttggagccctactgggctcagagactgtggtccgcagcccactagtgttatcaatcccatcagcatggatgcctacagcaacaagaaccagaacacccaacagcacctgctgctgcctctccttctcctcttctttccccaccctttcctattattattgttgttattgttaatatttatacatctattggtataaggaaaattaggccaaaacttagtgtatcaagatcaaaacacattatctttcatagtttctgtgggttgagaatttgggagcagcgtagttgggtttcaccatttagtgtgataccagctgtagtattttgtagatgccctttataaagttaaggaagttctttctattcctcggttgtgagggtgtattttgtcatgaaagggtcttgacttttgtcaaattctttttctgcatctgttgagatgatcatatggtgtatgtcagggtttaaagttttttccatgtgtggctgcatttggtttgccagtatcttcttgaagatgtttgcatctatatttataaaatatgtagatctgcagtattctttccttttgattttttgtctggttttgatatgaggataacagtagtctcagatttcttcctcttctattcttttggaaggtatttcgaggtgttagtaataattcttctttgaaattttggtaaaattcaccagtagaggcactggggtctgggtttttctttatgtgaagttttttttgcctactaattcattctctttgcttggtataggcttattcagattttctatttcctcttgaaattttggtagtttgtgtctttccagaaatatttttttcattttatctaggttatctattatttttggcctaaaattgtccataagatacccttataatcctttctattctataaaattggtagtaatgtcccctctttaatttctgattttggtaatttgagttttctttttttttttcttggtcattctcgtctctctgtttcatttttgttgttattgtcattcttcttttttcttttttgagatggagtttcgctttgtcacccaggctggagtgcagtgttacgatctcggctcactgcaatctccacctcctgggttcaagtgattctcctgcctcagcctcctgagtagctgggattacaggcacccgccaccacacccagctaatttttgtgtttttagtagagatggggtttcaccgggttggccaggctggtctcgaactcctgacctcaagtaatctacctgcctcggcctcccaacatgctgggattacaggtgtgagccactgcacctggcctcttttgtttttaatcttcatttctgaaagtttttatattatctatatagcttaaagaccagccaaaaatcagctaagattgtgttcagacaccttgagcactaagaagtctcctgtcctctactgatgggtttgtgtgtatgtggaggtgtgcattgaaatttcaggccattttcaaatctttccaagtatttagactctactggttcctttggtatcacctctgcatctgcacactgcttcaggattaatctgaaatgtatgggctggtaaagtcattggctctctccagttttccatcactgagaatataatcacttctaccaataatgctgctggatatggtcacggccttctacctgaaaacacatgagctccttttggaccatggcaactgagctgccagtactcatagcctactctacccaggcagagcctttgtgttaactagggatgaagccctcatctagaataccaaagagtcccactgttcttgcctaaactccagtcgatttttggtgaatacttgttacattattggaattctttggttgatttttagagtgctgaaattttgggggggtcagttttgtccacaaggattattgctatttggagagaggaatgtctgacttcctcactcagccatagctggtagtcccaaatatttttcacgtgaacttgcatcctattagccaggaaagggcacaacgcattgggaaaacttgttttaaaacagtaaccgtagtctattcctgtggtgggggggaggagggtccccacatattcacattagaagtcttacgtgaagccattggggattttcctcaaactttacccacagcactatggttctacaggataagatcctgtcatctattagtgggtatggagaacattatgtgcatgcagttgacccacaaaatctcagtgatgccgtataattaagatgtatttcttcctttcatcatggtctgatgtgaattgggtctctctctggttgtaggttccttccagccgtggcaatatcatcttgcaacattttggctcagtttccatcgatggggatgccgagatcattggcaattacggaggatgtttccagaaagcattttatatcatttctgatcatactgtattagccagagttcagtcacatggtcccactaaaatacaaggaagactgggaaatgtagtattcctgtgtgcccagggaaaatacaaaagcaaacatttggtgaatatagtgcattctgtttgccactcattctttggagatcctatcacattattaagcttattctctgggaaagaaaattgggatgcagaaatcgtgaatgacttaagatgtgttgttttaagtaagttactggaagattaggaactggaaatatttattggcttctaatttagttttttcccccaattttactctgttctctctcactttcataaagtgttgcttcttaattgacataaataatacgacctaccacagccactttagaataagaatcattcctaattccaccagtttaagattaatgtatgcatgttttctttacagatgtacgtttatataatcaaacagctaatatgcatttgttttttattgtgtttgccaacacgcacatagtcttcatatgtctacattcttattgtaattactatttttattgccacataactttgtattgaattggtctaatatttacttaccccttcctcctattattagacatatagttgtttcaattcattttaacctatataacacattgtgattttaaatatgttttaaaatatatttttgcaacaaatgctgattaaattgcatattctgaccacctgtggacatttaggaacgctgtagttaaatagggtacctctaacttacatcctttatgctcttactgaaacatatgtgaatatagtatagtactatttttacataattcttttttaatgaaaatatttagcttgtgaagaatagaacacattctcaagagttgaatgaacctgttaatgtacttttatcagctttgtaatgcagtatttcattaaaatgtgtttatactaatttagtagtatggggcgaaggatgaaaagaaacccagaaatgtcagatcatatacattaattcactgacaaatgtttttgagtgtttactaagttccaggcagtcttttagaaactaaatatatagcatgaagaaaaatctttctctcaggaaatttgtgttctattgggtgtcaggtggcatgtgaggatacaatgtttgtattaaaaacaatgtattaatcgccatgaagaagaataataaaggtaaggagggctgggttcaatggcctacacctgtaatcccagcactttgggaggccaaggcgggcagatcaggaggtcaggagatcgagaccatcctgggtaacaaggtgaaaccctgtctctactaaaaatacaaaaaattagccaggtgcggtgccatactcctgtaatcccagctactctggaggctgaggcaggataatagcttgaactcgggaggtggaggttgcagtgagccgagatcgcgccattgtgctccagtctgggtgacagagcaaggctccatctaaaaaaattaaataaataaataaataaataaataaataaataaataaatgtaaggagaataggatatgttcgattgggtaagggatgctgttatatatgagagaggggtctgggaatacatctctgatgtgtaacatttgtgcagaaacatggaggtggtgaggaaaagattcacgtggatgtctagaagatcagaaagaaggaacggccggtgtaaagacacctggctgcagacttcttgtcatatccacagcaaggagtttagtgtggctggagcctggggtaggggagaaaaagagacaagagtggtaccacatgaggtgagtgttagctggggtagaagctaggaggggactggagcatgtagggctttgaaggtcatagtatggacctgggatttagctttgagcaggaaaagaagccattggaggatgtattagtccattttcacactgctggtaaagacatacctgagagtgggtcatttataaagaaaaaagtggtttaatggacttccagttccacatggctggggagaccgcacaatcgtgccagaaggcaaaaggcatgttttacatggtggcaggcaagagaaagagacaaaggaaagggatttccccttataaaaccatcctatctcatgagagttattcactaccatgaaaacagtatgggggaaactgcccccatgattcagttacctcccatccggcttctcccataacatatgggaattatgggaactacagttcaagatgagatttgggtggggacacagccaaaccatatcagaggatgttgagcacatgagcaacatgacatcatgcccatttaaaataaatactctggctgctgggtggagaataggtgtgggaaaggatggaaccagggaatccagaaggagacattacactcatgggggtgagaagtcgtggtaaatggaacagaacttgcaggtgtgagaagtggtcagagtttggatatatttccaaagcaaagactatatgatcgtatgcttaggtaatggtttgaacgtgagatgtgaaagagagagaggggtcagtgtttactatgggaatttttattattcttattattttagacagagtctcgctcttttgcccaggctggagtgcagtggtgcgatctcagttcactgcaacctccgcctcccgggttcaagcaattctcctgcctcaccgtctcgagtagctgggattacaggtggctgccaccatgcctggctcattttttttttttttgtatttttagtagagacggggtttcgccatgttggccaggatggccttgatctcttgacctcgtgatccacccgcctcagccttccaaagtgctgggattataggcatgagccaccgcttctggtctactacaggaatttaagcttgagcattcagaaaattgaagtgctagttccaagatggattgcaagagaagcagctgttcagggaaagagagagagaagaaggaagaggaattgcaggtttacacttgtgtgaattcggcatgaggtgcccattggatttccaaggagagatgtcaaggagacagctctgtgcgtctgtagaacaaggaagaggtttgatatggagatatagatttaggactttccttcttatggatggcattagacacctttagacaggaccagctcacatccttcaccatgtgcacaggctctaatatattcaacatttaaaaaaattaccctgtgactctatttcctctccatctgtcactctctttctctgatttcctttacaaaactctgaaataaaacttgtctatatttgctataatttcttttccttccattctctcttgaattcattccaacaaggcttccctcctgcccaccttcgaggtgatcttatcctgtttcaaggcgttcaataccgacaataagctgattatctccattttacaatgaagaaaccgaagttcagaggggttaaagccacttgagtattcaatagcagaactcaaaccagagccttgctttcctttcctatccccagcctgtctctttccactgcatccttgttcacgatgaaatcgtgtttgcaaacaagggcttggaaggtgatcagcgtgggtttaagtaccaatgtacacagagcatttaaaaaattcctcatagctaaatagaatataatatttcacccctatacacttgtgggtctaaattgttaatgtctgttttcttacaagaaataaaacttggagaaagactgtggacttgttccttaaaacactataatttcatgtaaatcattaaattttttaaaagtctgtgataatgacatggttgatgagcgtgagagtaggagacaggaggagagttggatcttctttccttgacatcctaaagaagaaggaagacaggaacctttcagagcatagcaacagggtgtgttaccctccttagagctaaggacaggcagacccacatcttctttcttacctaaatagctatgacttaaagtcaatcttgtactgctgtggcattattatttctctattctccttggatgtgtgtttcttgcaacggaagtaggaggattgtccagaggatttgaaaaatatttttttctgacatgattatatctgtatatgaattcatttttttggctgtgatctgtaaactcaacaaaacaatgccaaaaaaatcaaatgtggtgaagtgctttttttaactcctgggttcgtcatcatcagtctaaaactcagtcatttatagactgattcatgaagaaatatacaactgatgactctgggttagagtgttgttccaggggatgatttttctgtgcaagggaatttggagtgagtttgaagaaggagaggttatgaattagtaaagataaatagagaggatcatctgcatatggggaatgttccatgccgaggtgtgagcacaagaatgaatacattgttcataagggtctgtaaagatacttgcttggttagagagtagactgcagaaacagataactaagaatggagatggatatagtgaggagaggggcggggaggagtgtgaggtcagggaaaagaactggacattgccctagcttcacgttgaaagcagagatagggagagtgtggcttggtgtggaccatgccataggctgtatttggatggattatgggttagtgtgaggaaagactgaagtcaggaaacaagatggaagctccatagcaatgggcatgtctggagatgacgttgaccttgcctctaggaggggagcagtgaacatggcaacattggtgccaatggggagtgaaaaggagatggaagaagaggtcaatcctccatgtgggcagtattgggcatagcagaatatgcagagaatgtagggtcacactggtgaacaaaggcccccgagttgggagaaatctaatcttcgctcaatactctcgtggttcaagatcctcacaagtcattggatgtttctgaagctccattgatctctttatttgggtatatttatctgtgtatctagtcagtgatactgttgaactgtaatgatttgatatccatttggcatgtttttgagcatcagttatcatggaccagtagaggggatgcaacactatatcagagagacacttttatcgtagatgtatagttagaaagttattgtcatgcttggccctatcatacaaagccctgatgctttcatgggggaaacaggaaccctttggatgacctgtatcaggtcatagaaagcattctgccttctagggaagtgagttgggatgacgatcgatgttttcttggagagatgctttggtctaagccatgagaggaggaaagagtagaggagggatattttaagctaaggtgataacagcatgcacaacacccctagatgtgacgaggctgagaaactagaggaagggtcagggcagagataacagggataaaagattgggaatttaggcggaagtcagacagctcagcattttctaagcttttctaatgatggggaatttaagaattactgtaaccaaaaataactagctctcacaagtattgtgtaaggtgtctctggaaaacagattggagaagacccagctggaaccaaggatatcagttaggagattttcatattaatccaggctggagatcaggatacaggtggttccagtgggaactgagcaagtaggtagttttaatcaaaatttagaaggaaaaatgcaccttacttggtaactgcttggatttgatggcaaagtgggatgtagagagtgggagacggaggggcaggctaggataacattaacaaacgtttgccagacacccagagcaaagtcagctttcctctctggctctgatacgaatgtgaccattgttaactgtttggcacatgtgttaaccttagaatgttaccagtgttaactgttttgcacatgtgcgtgcatatgtgtgcacatgaatgtgtgtatttaatctcaactattcttattttgccatgaaattatttaacacacatgtgctgtgtgtatgtatatgtgtatacactcatccctcagtgtccacgaaggatcctcactaataccaaaattctggctttgtgggatccacgtatacaaaaagttttccctctatatttgtaagttttgcatcccatgaaaactgtatcttctatgtatgctcagttggataaaaaatccatatataagtaagcctgttcagttcaaactggcgtgatccaagggtcaatagtttacgtctacccacacattaactagtggctgtttcaaggaggcagactgagtgatttattttcatgcttccttcaattttttctaagtttttaccatgagaaaaaaaaaaattttctccagaagaccaagaaacaattagagctttgagaagaaatttatctgctgttattgattttgttttagccaaaaaaaaaaaaaaaaaaaggctaaacataaaatacagtgttcgtaaacctggctggcaacctttctctgatgttattgtctatttcagacaacgcaaagaggtgtatgaaaccagaaaccttcagctatgaggaaaacaaaataacaatcaatatattttgtttctgcttacattttctgctaactccttgtttcccagctaccagagagctgtcaacttcaggaattaaattaaaaagtataaagctgtgaatgaaaaaatcttggaagtaatgagactacactgaatgaagtggaggcgaaaaaatggaacacagtaaatgggcacctgtatcagtgtcatctttaaatgcaaatgaaaatgtcccaaaccttcctaccgctgatactttgaagcacatacagttcatttttagccaggtgtatcagttttgcattgccaaaagtagtagtggactaaaacaccagtctgcttttcttttattaagagatctgtaataagagaggttgaaagaaattttgcagtgccaaatgagactccaagtgcagtgcaagatgaagctagtcaattctgaaatatttgaacatgtttatttatctaaccctctatgaacctgggcacagatgctaagtcttccatgttttatgtggtttcagatgacctctgaaaattacctgtgccattctaaaccaccaaatggttccattttccatctgttgtcatgcaattgttttgcttaccagcagctgtcagatggatattacaatgaatgctttcatagcaaatgttacaacatcaaacataacaagcattgaggatgaagctgatggcacagggagatacagagagcttaccaaaggactggaaagggggccctggagtccgcatcaggacactgagtgccattcccggagtgcattcaagagtctagtgcgcgctggttcacaggtgtctctttttgccaactcatcataaactcctcagctgttaatgcagagtcgcttgctgcaacagtgacagagaactgttgggttgccggggctaattgctatttagctctttcagaagggttaaatgcattggttagcttgctgaaggtttgggagatagcttaggtgcgggagcactcaaaccacagggacgtggctgtcccacctgctctcgttgttgggggcattttaactcatcacctgatgctattggaagtagctataaaggacagctggtggttgcatttatttggagtcttaattcacctgttgtctctctccagttgtggttgaggttagaacactctgactcctagaattcgtacattccactaaacaagtaatatatgatattttttaaaaaaattattccatggatattttctccctttctgtggtttgtcttttcacatggttaaacatatattttgttgtgtagaagctttttcacttgatgtgatcccaattgtccatgtttgctttggttgcctgtgcttgaggggtattgctaaagaaaatctttgcccagactaatgtcctggagattttccccaatgttttcttgtagtagtttcatagtttgaggtcttagattgaaatttcagtgaaagagataaacattttgtgaagttatctatgtttgtatatgtgtgaattcaggtgtgcagttttattattttttgctcaaagtggaatactattttgattagtaccctcaaaccgaaatagtatttatgaagtccttagtgcatactcctgtgcttcaaattctgtagatgttcaataagtatttaaatcaatgaatgaatgaagggcagttatttgaatgactccattttggcttcatgtcttgtttggggatgttgagttcaaagttattacatccaaaccaacactaagtagtaatgttaggatgtgtcctatagacgttgttctgtatatagtatcaacagaattatgtagtgtcaggtatgtagcatccggggtcctacagcctatgtttgaatcctggctttatgcaacagactaggcaacctggaatggaatgaactacttagttttctaatcctgtgttgattatttcagaaaattaggataataaaaggacttactccataggattgttatgaagttgaatgagaaaaatcgacttaaatctttcagcactgcctgtaacatataagcacttgatatatcgtcgatggtactattattatttgcctaacattttgcttttggggaacacacagccaccaatttcccctctcagagatgccacttgacttagtctctgttggtcccacccttaaaattattgaaccacgtgctatcaggcatattgcagcaaaatatggtgctcagaatatcatggcttatgtattttatcttgctggcaaagaattctaaaaggtttaaagcttaaattagagcccacatttaaaccgagttgggagaaatgtaccatatgcctctccatcttgtgtgtggtgtgactgtaagtgagagtgaatgacaacacgccgggggctccagccaaaacttgaggccggcagtctaaatccagatcgggcagcctcccagcctctcccgattctgtctgcttgtgcatttgaccttgacagccaaggtctgtgtggttcctctttgctttctgtcattaatcagtcctgaagcatcttctagacagacagcttggttggattgaataatgcgtctgtggtttttttttttttttttcttcatctgatacaggcatgagttaaactacagtcgcctccattgctgaacttggctattgggctgggcagtattttcaagcggtgttttacctgaaaatgttctataaatgagttctgaatgttgtcttctccctgtcatagtgcctgtgattatgataacccacccttgtaagctttctcctatagcagaaattgttgccagaggaaggggagggatggcatgtcctttcactggcaagtgaggccagattttgactttgagtcactcttgagaatttagggggtggtcacatggtactgtgcaacaggaagtgatatttatcatgataagtgatgtttaccatgccccactttacaactgccgtgtatctcaaatgttatgagtataccactgaatgcattctttattggagagaaaaaaagttagcaccgtatagagaaatatatagttgctagaactgagaaagggtaagaaaacaagagtaatctgtaatttttttgttgcatggtccaaaaggcaatttctgttgcctttttatggtgatttggagtttttaagatgttttgacttatttaacaagctggaaactcatggcagagagaatgtttatgacttaccgaaaatcttatggaagttcaccacagagctttccttggaatgcaggtatcgagacttgattttcagaattttgcactagatttcctaacagaaacctcgtgatttgaaggggggagaatcatctctgcaattatgtcactgctaagctgacatagtaaccaaggggttagtatcagccttggaattctgtaaatatgtcttgggacaaagtggtatggaactacatctagtagattgaggaagaaggtcatggaattagaacatttctgttacttctaggcataattttcaggactaaggaattcagcatgagctgcatctgcctcctgctacctcctgctctctcccctgtatcaataactattaattctgtttccttccccatcgcaatttagtttggaagatgtcagtgctatttaacgcagcgagatctccccagcacacccctcgggaccagtccttgggtgttgggagggcattctaccctattatctgtagggtggctgtgcttgttctcatgccacatcaaaattggcattggtagctcgctaatgagtaggtagagatgggcttggcattttgtcttctgaaggaacggcagataagatgaataatgtcattcttagttctagttttgtctcttcttactgtctttatttgagcccctctacctccctcatttcttcttccttccctctccattttccccttccttcctcccaacacccccatacacatgcacagctcacacaccgttttacctatctcttaactgacagctttaataaggatggtcactaagcatcttcttataatttatgatagaaaatggtatgcaaacttcagagatacggtggtggagatccaagtttatatcttgagtctaccatgtaactctcaatatgtgctctagacgctctgtgtctgtttggttatctataaatcagcaatgataattgtactgacctcataaggttgttgggatgagtcagtaagattatgcatgtgaaatgcttagcacaggttgtcatgcactaaaagatttccgtaaacattgtttattatcattaataaaaagcatctttattgagatccatctcataagatgcaacaccaaagctaatatttcataacagacaagcactctttgagtgatatattatgtcgaaattcaattaaatgtcccaactcagtgtgttggaactggtagcctgaaaaagtcccattcatctgatggctgtgaaataatgagaatgtttatctttgttccatgaagaaatgtataattaaagcagtttgtgacgtacctcccgaagattcatctctaactctgtaatacatttagtgatttcaatgcaaatgaatcgtgttggtgaggcaatgtgttcatcctatgtccttatctgttctttgaaaacctcatccaaggctctggggactctcgcagcagattgaaaatccccttgctggcaacagctgattagactgaggagagacatgcatggggctggccaatcagattatctcttcgtgggagttaagaaatttgacacagccccagtgtccatattctttacatatatatacattatatatatatatatatatacattatatatatatactatatatatatatatatatatatatatatatataaaattcagtgagaaggttagtaggaaatgaactctaggaggacaagagttggatagacattatcatttactggctaagtgacctagagcaagtcacataaccctgggaacctcggtttcatcaatggcaaagcaaagatgctaataggggctacttttaaaaaataaagaataaacacaataaaacaggcaaagcattcagtgacttgggcagcagtgagtgtgcagtaaatgctaaacattttgaattgtattcagccttcatttttcagcctgatttttaccttgattctcacattgaaactgcccatttctttgggtattttgggtcttttcctgttttaccctccccactgggtttgtcactgcacatccctccttccttttgaaagctctgttcttccttcattctcctggtaaacttgccgagtctctgcctcattgttttctggctttttgcattgcctcatcttcctgtgttcacacctaagcgaagttgctctccaaggttctgacctccgcctcttggctttccattgtgttttctcatgggtgacctaattcacacaacatgcctctaagctgatgaagcctagaatctcattcctgtatactaactgcctcttggatgtgtcttcctggaactcacacattctaagtaagtggaattccacatctggtcatcatttcataccgttccttccctcatcctctctcagttgatggccctcaggtcctcagtttagaaacttgttgttcaggctctgcagctcccccatctcaacctgaggtcctgcattacctcctgaagagccacagaatccagcatttgccttattctcactgttctttgtgaccagttcacctctcacccaggctgctgcaacgagcttctaattggcatttcttctctttccccttcaaatccctcatgcttgaaaataaaaatttggtcatgcctttcccctgtttaagtgttttcaggattatgaccaagcttagtaacgtgacttgttcctctctgctctcaggaacactccttgtttctctctttcaagaacagcctatttacagttcagtgcacgtaatgagcctgtactcatttctctgtctttatgtatgctgctccctggacccaccccattcccttctactatcttggcctgaaaatgtctacttatcttctaactctcgattcagaggcagccttcctccaggcattctttccctgagtgccactggctctttgtctcattttctgggttagggtttcttacattcatgggcactccaaatactctatccctatacatctatcttgatgcataattgtaaatactgtttatctgtccattttcaactttacgtttcgtgtaccttcccttgagggcaagagctttatgtttatctctatccttagtgattaatatggtatgtcatgtgtactaggtgcttaatatctgagtgactactagaatgaatgagtgagtagatatgaatagttttcaagatttttaggaaaccaaccctatttaacttactctgtgatgaatcttttagttcattcttttttaattcatgaagtctgcattactctaggccagtttttccttgcccccaaatctttcagatacggaatcagagaaacataagatgttagggttcacagttttgcaaaatgctgatgtaaaatacccaggagcaaacagatggcttaagaaaggtattaatcatacgacatattttcctttataaaatgccttcttacctaccgcctttttatccccattataggttttctttcatcttggcaatgtttagagtccgccatcttgccttgtaagccagtcttattatagcatttgtgctgtgcctccattttaactcttgacttttgttgctcccaccacacgttccttaaaagtcaatcaggagtttatgtatctttccgtcttctggactgagaaaaatttatggcctttagtagatgctcgttaggtttgtagaatgggccgggcgcagtggctcatgcctgtaattccaggactttgagaggccaaggcgggccaatcacctgaggtcgggatttcgagaccagcctgaccaacatggagaaaccccatgtctactaaaaatacaaaaaattagccaggcgtggtggcacgtgcctgtagtcccagctacttgggaggctgaggcaggagaatcacttgaacccgggtggtggaggttgcagtgagccgagattgcaccattgcactccagcctgggaaacaagggagaaactctgtctttaaaaaagaaaaaaaaaaaaaggtttgtagaatggatatgtgctctctctgaggtcatggggtgagcagggatgccaaaatatgcttactttgagtcacggaagcagtagccatttaagagccttcaaagggccagattgagtttatgtgatttaggaatcatgatcctaacacatctccagaaagagataaacgggcttgagaagaagcagagccatgctgggaaatagattgggtggaatttaaatagaagtctggatttgaagtaagaatcataaagactaggagtacttgtaatattcataataaaaataaatcctatgagaaccattaattaccatacacagtatgcttactatgggcctggtactgggtcaagtgctttgcattcattctcacttagtgcttcaaatagttctacaagttaggcttcattgtctcccttttcagatgcagaaactgaggcctcaaagagttaattcagccatttaaggtaacaaagctaccaggagtttgaattcaggattcctaagctcgtgctttttttacccctgcaccagaggaagttgtgtgcaggtctctgcatctgtcaagttactggatatgttattttgagcgagtgacctaacagggcttcagtttcatcatctatgaaattgacaggataacattatctttcagattttttgtaggtaatttaaataatttgcagaaaacgtttaacacattgcatgggatacagtagacaataaatctggacttttattaacgataaataattagcttcccattctgaaatatttcaatatggatgcgtggctgcgacttaaaaagccaaatccaccccccaaatgtgaattattgcctaactcggtccctgaaactggaaatagagaaataacatgcaattccagcagtatcaacattattattttcatttttttcctgatgctgtcagcttgttatttgtgctatttctttgaataatagaatttattcaggcaatttatccttaatacaagcgatataaatggggctatgcaatccttatatatcatgctaataatgtctggttcatcttttttttttttctccctgtttacatatggagacattgatttcctactccgtcctgtcttttattacattttctgcatcgaggtcatctctgtccgctgcctacactggattccagtagctgaagttgtgtaacatcattcagtgacattcttaaagcatctactatgtgctttcttcaaaaatgtgtgtattagagtggaataaaaaagaagaaagacatatataattgctgtcctcagatatatgttaaatccattagttaaaaatgtccacctagccagtgatttaaggacaaatagaaagctttatattgggaggttctgaaatagtgtcagttaaatgcatgcatgtcaccagaggctgtggatactatgcatacgtcttatttcttcttcctctgcaccctccctctggtggcccccaagcatctcttggtgactccccaaactgagatttctagttccagtgtttttctttttttttccaagcttgagactcatattttatcatccgtatctcccactgacccctggacacccttcattcgttgtgtctcaaactgaaatcaatacccctccaccccatccgcaatctgcaccatggtgaatcacatgtggtttcagcttacccatgttggggacctgcaagccaacactgggttgcttgttctatcatccctgctccacctgagcacaattaatggttaattcccatcaactaacttctctataatttcttgaactcaacctggtgcttctgtttcccgcaaagacaaaaccagataataggaacagtagaggaccaggatcacctgtttggtgcacaatgagtttctttttttttttttaatttttatttaagattcaggggttcatatgttgttttcttatatagataaagtcatgtcatggggattcgttgtacagattattgcgtcacccaggtattaagcccggtatccaataattatttttttctgctcctctccctcctcccaccctccatcctccaccctcaagtaggactcagtgtctgttgttcccttcgtgtccatgagtttccatcatttagcttccacttgtaagtgagaaaaagtggcatttggttttctgtccctgcattagtttgctaaagacgatggcctctatctacatccatgttgctgcaaaggacatgctttcatttgtggcttttctaacacattggaccaaaaggtctttaatctctttcataataatggcattgaattaactaatacttacctgacgcagataatttaacttgtctacatattcacctggtcctgtgcatttcagacttttgggggaaggatgaggggggtgacaggtgagttctcatcatttggcagccacttataagtgaaaacacaaggatgatttttatcatgcttcagacagaccttctgaggttagcgccaagacaagggtattgaatgtgcacacagaaaaagaaaagctaatttgagtagataaaaaggagaaagaatcagcaagacttgatgacaagatacattcaagggaataacacataggcaggaatgctctctaaacataatcagcatattacatgttttgtctatgactttgtgaatgaagcccacgggagaccttcttaaagaaaataaagagggagactctttttaagatgttaaaatagaggacaatgaatgcttttgcgatgagttatctctgtggaactgtgtgaccttgagcatgtcagtaacctctgtgggacttaattcatcttctgaaaacaagagattggattagataattcctaacattccatgcttttaaatagacttttatgattaggaatttggcaggtagaggggtggaagcataacatttaaaagttggtggtgattgagtcgagttagaagtgggttgaattatttttggaactaaagtgtacccttgctgaaatatagaataataatgagtctagtattaatatagcctggcttaagtataatactaatataaacaaaattatattgagggaaaatgatgtttatagagtacaccatcaagatgagctctagaaaaaggaaactaaaccttctctaaacaggtttttttttccctatcatccgcttctttttacattatcattatgttttccaggctggcagatgaatatcaaatctgcttttgactgaacattttttaaatctctctgatagaatatatatattttttcatttatgaaaagcaaataggtcacgtgttttctcttctgcagcaaagaaatatagcaaaagtttctatgctccgttccattttcttattgaaaaaaatatttaatataaatgaaaaatattcatttactttttgaacaaagtttcatcacagatctcttactcgggagtaaatactggttaaaacaagctaaatgcacattcttaataatttaaagtcagagaaccagccatgtgtaaaataggtgtatgttcacataattgactacagtattttgctacatggttaaatgcatgatttcccctaatagaatgccattgtggtctacatcacattttctagttcatgaaagtcaaatgagctgtgaccatagtctcccaaacttaatgggaagttcattttgtgacttctgagtttaaattgtgtctttccaggatgaatcagtagatctaaagcacattaatggatcacgtcaccaaaaggtctaatcctgagtgactaaaatggtagttctaattcagatttagtgcttttctagcacattggaccaaaggtctttaatctgtttaataatatattggttttgtattaactaaataatacttacctgatgcagataatttaagttgtctacatattcacctggtaccgtgcatttcaaacttctttggggagagatgagggggtagcagatgagttttatctgtgaaaaccagtaaagaagtagaactttatagacaggggctcacagtatatatttttaaaaatctgtatgggatgcttgttagcacaacaaatttacacactgctctgccaacactctcagccacagctacctatcagaaggttatgaagactagaagaaaaacacataagttatgtcctggactgtgcgaacactcatgagcacagccagaaactacagctggatgttcaccgacagccagctatccaaggtttttgaccttggacaatgagcaggggttgatggagatagccaggcctagagatggcaccatttggaagatacaaatggagatgtctagagggtgctggcagtaagcttctgcaaggaccccattggaaagggagccaaattgtttctgttatctcagggaacaccttgattctgaaagacagtgagagagcataaggctacctaagacttctggaaagatgaatacaactattaatatcagagctgcggcctcaagaacagccgggattctccctaatgacaagagggtggacggtctctctgcatccctttcctcaagccttttgttcaacgcttttcattgtatgccccgaaagagagcagttttaagcatctgcgatgtagtagggtcacctgatgtgagtgagagagagagagagagaaagagagaaatgaaatcaaatggtgtgggtgattccagttgccttcttgttagcaagagtgtataccatcagttttgcgataacacaacatatgtgttcctaaaaatcaccactctgtgtaaaatcacacaatataaaccatgggacttaaggggaaaatgggattaaaagcaccacactaaaaagtttcatcagtgacacatttaaaaaaatacagttttacacacgttaaatgattaagaaatacataaatactacaggagagataaccctttaccttgaagaagttcacaagtttgcttggggaaggacacgtctgaagggttgtgtcttgtgtgttattgtgatgggatagacaaggggacttacctgaaaccagatggtaaatggtaacaccagatgtgggtgggtatgactcaggaacacatgctgtgaattgacgtagcaggtaagtgtttgaggtgtgtgcttgtgtgtgtgtatttgtgtatttttatgcagctcatttttgctggatagagttttcggtgttaacttagtgaggtttttttttttttttaagtgaaatcgagcatgagcaaatgtgaaatccgcattatgctcaaatcgttccctagtttttttagctcccacatatgagtgagaacatgtgatatttgtctttctgtgtctggcttatttcgcttaacataatgtccctccagttccacccatgttgttgcaaatgacaggatttcattctttgtgtagctgaataatattccattgtatctatggtaccacagtggctttcttcattcctccgttagtggacatgaaggtggcttccattccttggctattgtgagcagtgctgcaatgaacatagaggtgcagacctcttctttataagggttttcttttctttgggagagagccagcagaaggattgctggatcatatggtagttttatttttagttttccgaggaacctccatactgttccccagagtggctatactaatttgcattctcaacaacagcgtataaggattcccctttctccacatcctggccagtattcattattggacttacagagatagagtggaatgatggttgccagaggctgagaagggtagcccggagtggggagagattggggatggttaatgggtgtaaaaatacagttgatagaatgaatgaggtctaatgtttggtgtcataatagggtgagtatagttaactatattttagtgtattttctaaaataactaaaagagtggaattagaatgttcctaacacaaagaaatggtaaacgcttgaggtgatggataccccagttaccttaatttgatccttacacattgcctgcctgtatcaaaacatcacatgtaccccgtacatatgtacatctattttgtgtccatgataattaaaaataaagaaaatttttaaaattgttccatactctgtcaactcatggacatacatttgcatgttcaaaacaagcattatggaattgactacaacttagagcatgagatggggcataaatattgagggtcccctaggtcaactcaggtccccattgtgaacatgtcagagtattggaagagaccacagttcccctctaccttgaatgcaaaccagccccttcatcatgtgcccaactgcattaaaaacaaaacaaaacaaacaaaaaaacataccttgagttgggagaaacacatagctatgtcagatcattaaccagtttctaacggagcaacttcctagggaagggtatgtttgaatccactggatgtttttgctttacacatttatttagagcctaattttcacatggctgtgtctctactgttctcttatctcaggtatcgatgccctgagataacttcattccaacaatcaaaacttgtctaggaagacctgattgctctgagagatttgccttgtgatttgatcatttcttgccatccccattgactggcgatcttcatggcagctttaaaggtgctttgaggttattcaatccatcttctttcttttagaaaggaggacaccgaggcttggagggaaaaaaagacttcactcaagaacttaagacaaaggctgtttcacagataactcatgcacctctagagttttcttatggaaatgcttaacagtatccctgttgggtcagtttctttcttttatgctgaaaaaaaaatcactttattgaggtataattggtattaaaaagctgtagatgtttaacgtatacagcttgataaattcggaggtaactatacatccaggaaaccatcaccataatcaatgctgtatatttgtatttatccatcacctccaaaagcctcctcccacgttctttatgtaatttattttttagtattgatttttcttttcattttgtttctgagacaggatctcattctgttgcccaggctggagtgcagtggcacaatcagagctcacggcagctcaaatattcctcctgcctcagcctcccaagtagctgggactacaggtgcatgccaccatgcctggataatttttcatatttttttgtagagatggggttctcactttgttgccaaggctggtcttgaaatcctgggttcaagtgatcctcctgcttcagcttcccagagtgctgagattataggtgtgagccaccgtgcccagcttaatgttgattttccttttgtggtaagagcacttgaaaaaaaaaatccagcctcatagcaaatttttaagtctacaacacagtataattaaccataggccttacattatacaggagttctccagagcttattgcattactggagctttgtaccctttgactgacacttctgtacttcccccttctccaacccatggcaaccacggttgtactttgtggttctgtgagttttgatgatttcagattcctcctaataatgggatcatgtagtatttgtccttctgtgtctggcttatttcattcagcattatgacctctgggtctgtccaagtaaatccaaaaaggatttacttcctttttaagactgagtaatatcactgcatgtatgccattttctttatccattcattgttgatggacatttatgttgtttccatatattggctattgtgaatagcggtgcaatgaacatggaaatgcatatatctcatggagattctgacttcagttcccttagatacataccatcatgggaatgcaatcaaaaccacaacaggaggtcaccgcacacttattgggagggctgttatagaaacaaacaaaccccccaaacagatgataacaagcgttggtgaagatgtggaaagaagtgaacccttgtctcttgtgtgttcatagaaacataaattggtgcagccacaatggaaagcagtttggaggtggctcaaaaacttaaaaatagaaatacatctgatgcagcagtctcacttctgggtctgcttctttcatctattgtgtatctcaaggcaaagcaacctgcctatgcctgatccctgcatacacaaacacagagaaatcatattaactctcaacctgttggtggctctgccagttctgttttgtttctttttttttttttttcgtgaatgactaacaatctaccatcagaaatgacattcataaaattatttctttctacagttatttctttgtttcttttcatctctaaacatgtcttattaagtacagggtggggagaacacagttattcctattaccactgatgttgttgatactcaactttggaatcttcccttttcctcccctaccctcacctcatctttcaccaaattcttcacaaggagagttttacaagctttaaactgcttccattttacagtggggaaaatgggaatacaaaatttggacatggattggtaatttcatgagtcaatgttgcgacaagattgacagcagcttctgtgaccactcatccagatgtattactgaaaacatgagggtgcaatgttgtggggaatccacctttgttatgtttttttctagaagggcctagaagcttctgaacttgctaggcacttgggagaaaattgattaaataaaaataatgaaatccatcccaccaacaaaaatagactgaattattgtttaacagaaattggaactaatgttctagggaggttatttgaacccaggcatagaagtgggagcatcatgatggtcagggaagaaagcaggtgacattagagactaatttgtaggcacatatacagtgtccttaaaatgagccatttatggggtaaagaaaagctgatcaaattgagatattttagaaagtatgcagtgtgaaggggttgatttctttataatgtttttaattgagttggatgaccttattgacaatggatgccttttgtcagcacgttgtgtgtgtgtgcctgcatgtgtgttcctcataaacccgtagctttctgcaaaaagggcattccaaaagaaagaggtgaaagaaaaatgcataaatgcacgataacacacgattaagttttgaccccatagattgttaaccttcaaagctaactctgcagtagcacaatattattagcaataaaaggaatttgctttgcccttttttaaattaccataaaccgattgactgagacagaatgatgttaatatttaagaagtaggacactagattctattatctcagaagctctgtcaccaggccctctctgtagtcctgttatctaattattgggcttaaattgcattagtgtgctagcaatttgtctaccattggaaaagtaattgacatttgggttactgcttcatatatgggagacttgctagctagttccgaagagtcctcttctgtcagggcagattagcttaatgttgcctagaagaaagggaagctctgtgttttaaggtatgctgcctctgtagctggttgcaatttggtattaaaatttcagttctgcatcaaagctgataagtcacctgagatgaaattgaacaaggttgtcgtgacaaagtaattaatggcattttttgactttcagatgactttaggggaagcacacttcttctctgcgtctgcttctgctgccatgtttataaatatgtatgcacatttacaaaacatctttaactgttgtcagatgtttctgcaggctccagatttatggttcccctgaattaaatagcaccaggtacatttggtgtacagcagtgatctggcattgacggtaaaggctgtgagtcttcataatatttcaatcatattttgcttctcctgacaccacacatcactgataggcactctctcttttttctatttctttgtataaaaatggaaagtggtgtgtttggttattctatttctagactttttttctgctcaactggttttggtttgtttaagagaagactttaagtacattcacaaatattttgcatttccctttgaacaagagcctacgagatcatacttttttttttttttttttggctatgtggagagcgtacctggaaaacagatgattttgatgtttttgatagccagtgcacctgaaagtcacaggcttctttcacttagatctggagtatatgtattctagggtcatctaaagagcagaacatagagatagccagccactattttctttaatgtgcaaactgaagatgaggctgaaaagtattcagaaattgattttaaaagttgatgtttctgtcttttaaggcacaggtcaaatctgactcaggaagaaaacttcttactatgatttgagcctcctctcttgcctctctcccctggctcactttagcgttcttggcttcctttcagttctatgggcaagccaggctctttcccgctgccaggacgttgtgtgtgctgttcctgttacctgggccgctctttcctgcttactttgccaagctagttacctcctatccttcaggaatctgctgaagcatcatgtccttagaggtctggttacttcctgctctgctccagttgttctcaatctcagtgtgattgcttccttctcaattcttgctatgataaacaactaatgtatttactcattttttgtcatccgctttcctcaccaaaacacaggctccctgatggcagaggtatcatctgtcctccttgtccctatatctccaggagctggcgatattaaatgttcaatgtttgttgaatatattaaattaaacctttcccaaatttccaccacaatacattttttaacttttcattttgaaataattatacactcatcagaagttgcaaagataatacaaatgagtcccatatactcatcacccagcttcccctgttgtaacctcttacatcagactagcacaatattaataccagaaggtgcagcaggctctccctcccttttactttaatggtgggtgatttcaacaggcaactgttatttgcttaatgtaatccttcgctattttatattttgggacattttatctccccttttctgatgcttccttcaaggacaacatcagctttttcagcacatggtgagcaccttgtaatacacttaattcttaagatagtgaactggaatgtgatcagaaagctactttttttttttttcaggtgcacttgcttaaaaaaaaattaaaaggtaaacagtctcaagttttatttggagttgctgagaagtttacccagcacacattttagctatgaccccctgcattcctgccaagcaggctcctgacttgggtcacccatgacagtgatcaaaattaaccctgctgctgctggactctttcgtttccctgtcttttccctttagctttctagtgctgttagtggcttctgagactctccttgttcagtgaagcattttgcataaggcacactttatcttttatctccaaagaaatggcagttaatgcaatctatagaaagccataaatgaggctgataaaattatctagcagccaaaaggttgctgcactcatttatctctgcataattcagaagctaaacgacaagattaggaagaggcaatccgtttgacagaggtgttactggaatgatgaaaatcaaggtggtttttgttttttccctcttacattttgtggggaggtggttaagagagggctgaagaagaagagattcaaggagaactcggtttctaaaatttttctcttgggcccaaaacatacctaagaaacagattgccatatattaatttaattatttgcctattgaataataatgcccttcccatttgatgtgcagattgtagaaaggtgacagtagacattttattttattttatttattttttgagacagggcctcactctgtcactcaggctggagtgcagtggtgcgcatgtaagtaactgtagcctcaaagccctgggctcaggggatcctcctacctcagcctgttgcgtagctgggactacagatgtatggcaccacatccagctaattaaaaaaaaatttttttcagagacagcctgttgcctaggctgagtgatgaaattttaaaatgtgactccaaattatcggtttacttcagaattttttttaacattagggagatgttgtagtgattaatctcccttaaaatttttatgtgtgtatatgtgtatatatgtgtgtgtatacatatatatgtgtatatatatgtgtgtatatatatagtctggcggtcaacagttcctttaatttctctgcataaaaactaaatgatagtatataatgaagtgtaacattataattatatatgttatgttttatataatgtagagtatgatccattttttgtaaaactataagtttaaaaaaatactgattactgataatgagtgatacatatttctgggtgatgggatatggaatttttttttaacttttgctttatacatgtgtgctttgtttaatttttttgttgaaagcaaacacctattgcattgagggaatatattacaatcattgggaagagtattttgtcaggggtagaagccgtttatttattcattcagcaagcatgtgcttagtgtaaggtgtgtctgaagttgagtagacatttagtggagggtaagcccaaagagtccctgcccctttggaggtcaaggctttgtctgtccccatctgggaacagggactcttacagacacaattctctcccctttatcttacaaagtgcctgatgtagatcaatcaacccatgtccgctgacggtgttgtgaagaaatacgtagcgctgcacagtggccatgttttaatcgttctgcaatttagaaattcaaatgaatggccactgctttaaagagtcagaaccttccatatttaaaaaaaaatatgcatttctggttcttcttggaaaattggagtctggccaaacactgcattcccttcctatcaaggcaaggattgatgtgaagtagtggcttctgtcttcgcatgaggtatagcctatgtggttttccccagtccccaccacttcctagagtgttccccctacaaggaggctaagtatctgtttatcttcaggccatatattgtgttacacttgctcacttcccccattttttttttgtgacccaactgggtctttgaagcatttatgctttttgtcctgtatcttacaaccttgaaggataattttgaaaatgtttgtgttataaaattggaaactttgcactgttttgagaagaggagaggacaacatagaaagcaggacaaacctgtgacaggagaagtctcagcatttactttaaaggtgaaatctgagcccttactcctcaagtagggagtttggttggtgtgaagctgctggagaatgtgaaggcatcttcacaaacaagcaaaacaccagggaagaggggccacgttttgtggaattaacctaacttttcagctgtctttagcagttggggttacattatgttcccctgggttgtgtgtgtttcttctgcatcaggagagatccctgcccaccttcagagaaacttaataataaacaaagaatgtacatccaaacttccaaacttccttgttaatccgtctatttccttagttgaggttgagcttaatgccgtctcatctaatacacgtaacctctccggtatcaggggccaaggccaagcaggcaatttgcagataaagtcaaacataattaagcagtaaaaactctgaccatacaggtggaatgaatgaatccaccaattgtgatcctgccaccatcctcctgccctaaaactcaacttgcttttctcctgagaccttctgaatagcaggaaagctaagcacagactgtctgatcttcagaaagggaggggcaagccattgtcactggatgattgaattattccttgtctggaagcaggtcgtgaaccagatgatgtctcaggttcttccagcctgagaggttttagctgcttgtcctacagtgaggcagagggaatcgatagaaacatggtatgaaggtctatgctcagtttcttattagtttcattgcttaattcctgcttaagcatctgctgctattattggtgacaagagcttgtatttctgtctctagactttttgtttgtttttttactttaaaagattttatatttcttctccatctaggaacatgacaaagttagaaatcttacaaaggggccaggcatgatggctcatgcctgtagtcacagcactttgggaggctgagaccggtggatcacctgaggtcaggagttcgagaccagcctggccaacatggtgaaaccccatctctaccaaaaatacaaaacttagctaggcatggtggtgggcgcctttaatcccagctacttgggaggctgaggcaggagaatcaactgcacccaggaggtagaaattgcagtaagctgagatcacgcattgcattccggcctgggtgacaagagtgcaattctgtctgaaaaaaaaaaacaaaaaaacaaaaaaacaaaaaaaaaaaacaccaaaaaaaaaaaaaaaaagagaaaggaaggaaggaaagaaggaaggggaaagaaaggaaaggaaggaagaaagaaatcttacaaagggatcagacacagtggctcactcctataatcccagcactttaagaagctgagacaagaggatcacttgagcccaggagtttgagaccaggctgggtaatgtagcgagaccctgtctctacaaaaaattagctgggtgagatggtgcatgtctgtggtcccaactacttggtaggctgagctgggaggatcacttgaaccctggaaggttgaggctgcattgagctgtgattgtgccactgcactccagtgcctgggtgacacagtgagactccctctcaacaaaaaaaaagaaaagaaaagaaaagaaaaaaattaaaaaaggaatcttatgaagatctcgtaataatgcctgattcttcaaagacatgggcacagacttgtcagctccaggcagtccttaagtgaacggtgcaatagccctagaggtgtcagctcagctgataccactttctcttaggaaaacacaaggtctttttttgtgttttctttgagggggccttgcattccaagtgtgcagttgagaaactgaacgttacaggatcagctgaaccaagtagagggaagaaaccctttggttttgacactgaagaaaacacacatagcactggggcaaactactgatggaaaacatcaagaaagatcttagacccttactccaggggatgtggcctaacggcagactggacagtaaccatgagacagagtgtttttgcttccatgagacagagtgttttcttcttctttttttttttttttggttagtgcctgaaatctagttaacttttttttttttttttttgggatggagtctcgctttgtcgcccaggctggagggcagtggcacgatctccgctcactgcaagctccacctcctgggttcatgccattcttctacctcagcctcccaggtagctgagactacaggtgcccaccaccacacccggctaattttttgtacatttagtagagacagggtttcttcgtgttagccaggatggtcttgatctcctgaccacgtgatccacccgcctctgcctcccaaagtgctgggattacaggcgtgagccacctcgcccagccaatctagttaactcttggtcttctacatgtgttagaatggttttagctttattgacagaaaatttgaataagggtagcttcagcaatatgtcaggtccccgtttgtaaagcaagctgagagaagtacctcttttctctctaggtatggcctttcctatctttgagtttaggatagctattaaaaatggaaagttacactgggtcttgtaattgtgcttctaagaattgattttgtacataaatgtgaaacctatcaaataaataacattccatccacttaaaggaatacatcttttatttatttatttatttatttatttatttatttatttatttatttttaacagagtctcgctctgtcactcaggctggagtgaagtggcatggtctcagctcactgcaacctctgcctcccaggttcaagtaattctcatgtctcagcctccagagtagctaggattacaggcacacagcgccatgcctggctaagtttttgtatttttcttttttagtagagatggagttttgccatgttggccaggctagtcttgaactcttggcctcaagtgatctgccaacctcggcctcccaatgtgttgagattacaggtatgagccactgtcctcggccaatatgctgttaagaatgaaacaaaaatctttatatggtattgacgttgaaaaatacctaatatacattgttaattggtgaaaaaagttgtataatagtatatatactatgattacttttatgtaaaagaattgtatatagacacatttgtataggtaacatactatatatttttaaaatatgcaatacatatgctatacaatatttaaaattacagataggtacacatatatgtgtatgtatgcatttataaagcatatatccacggctgggtgttttggctcacccctgtaatcccagcactttgggaggccgaggtgggcagatcacttgaggtcaggagatcaagaccatcctggctaatatggtgaaaccctgtctctactaaaaatacaaaaaattagttgggcatggtggtgggcgcctgtagtcccagctacttgggaggctgaggctggagaatggcgtgaacccgggaggtggagcttgcagtgagctgagatcgtgccactgcactccagcctgggtgacagagtgagagtctgtcaaaaaaacaaacaaacaaacaaacaaaaaaaaaacccactaatatgataatggagtaatctgcgtttttataattgaagatttccatagataagacatactctttaattttttctccaagacatatgtaccctatttgtaacctgaaaaaggtaagaagaagagaccaatagtaaaaaaaagtctgttattaacgaagaattgaagggccacctacttagaatagtcgttttacataaagaggcagacctgaacggccttttcccttaataagtgaagtatgttaattttatattcactgttgtggtcacctggagacatccctgcgttgtaaccttgtaggcttttaaaaagttaagtcacatcttctgtgccaaaaagtacctcattttgaactaaaaccttcaaaatggaagtcttgttattgagtttgatgtctatttattgctatatatttgcatttaaatacagaaactatatatttttttcttttttatgacccagtgtgtctttggggatagctttatgagctctttcttgaacgcttaattatttctttctaggtggctttgtcataggctgtcatgcttcattgaggtatcagctcagctgatctgttccactttctcttaggaaaggcaccattttggggccttcagtgggtaacagatttctgaagcttctcttagccccattctggcaacactgggctgatttacaaccggcaatatggaaaacctcctagacagctgcctcagctgcatttgaactactgcctgagagtctctggctgccttgacactctaacagaccctggcggcaaggcaggtaccgccttctgctatgctgctgatcattgctgaaaagttgcgtaagtcatgccaattgtttataacatgtatttaagccgtgtatgaacctgggagtcatgagtctgtgctcttatttcaatgtaataaagagaagaagaaatactggatggtttaaatcattctgtgcttaagagcaaagctgagaaccaccccaacttgtatccctctccatccctttgtctactgagcgaaagcgcattcaccatgctcagtctctcactctaagccagggttctcaacctcatcactgttgacatttggaactggacagttctttgttatgggaggggatggggtcaggggatgtcccatgaattattggatgcttagcagcatcccagctctctacactctagatgccagtacaacccactctcctaatcatgagaaccaaaatggctctagatattgacaaatgtcccctgggaagcataatcacctctgcttgagaatcactgctctgtcagatgtcccacccatctctcatactcaaataagtgtttctttcactccaagagcatgagtgggtgccttgttcctagttcctcaaatgagacaaacccgttgtcattgagacgttgcatgtgtacctctctccttctctcccactgtctccatctctctcatgtttcccttcttgtacccaccagccctacattgatgtcttgttcttcagaatctttaatatgctagtatgcattaggaatctccaaggatgaaagagtaggagggagagggagaaggagagagagagggggagagggagaaggggagatggagaaagagagtgagggagaaagagtgagagtgagagggagagggacaggaagagagggagtggggagagggagagagggagaaggacagagaaggtgagagggagagcgacagggagaaaaggagagggggagagggagacagggagagagggaaaagtggagaggaagagagggagatggggagaaggagacagggagagggggagagggaggggggagaggcaaagtgggagaaggagggagaaggtgagagggagaaggagagggagaaagacagggagagggagagggacagggagagagggagaaggagagagggagaaggggagagggagaaggaaagggggagagggaaagagggagaaggagagagggagaaggagagggagaaggagaaggggagagagaaggagagagagagagagggagaaggggagggagagggagagggacagggagagggggagagggggagagggggagggggacagggaaagagaaagaaggagggagaaggcgaggggagaaggagagggagtgggaccgggagagaaggagagggggagagggagagggagagggacagggagagagggagagagggagagggagaaggagggagaaggagagaggaagagggacagggaaagagggagaaggggagaggtaaaaggaaatggagagggagaggggagaaggagagggagagggacggggagatggggagagagaaggagaggagaaggagagggagaggagtagaggggaagagagaaggagaagagaagaaggagagggagagggacagtgagagagggagagggggagagagaaggagaggaggataaggagagggagagggggagagacaaagaggggaagaaggagagggaagggagagagagaagggcagagggagagagggaaaaggagagggagagggagagagggagaggtagagagagacagagaggggagggggagaaggaaagggagagggacagggagagaaggagaaggggagagcaggagagacagaagaaaacaggcagagagggaggaggagagggagagggacagggagagaaggagagaaaggaagagagggagagggggagagggagagaaggagacagagtgtgcatgcccatatttttttctgagtttgtttatttcccatgaacgctcccccaaatcccttgggactagcagttgtaaacacaccattgagaacattgcattcctttcttttcttctagatacttttcctccattaaccttgtctttttccttcctgtagatttttgcagcacattttgtctctccctcccttatggattgtttatcctgggtgatgatctgtgggcacatctcattccctaggtgcacacagctcttcgaaagcaagtattctgtggtatttaacccagcctgttttcttacatggagaaaggactgcataaacatcccaatgggttgaatgtgtttataacccagtatgaatcaactcgccacatgcccactgaaaggatccacaagatggttgcagtggagtaaaaggcagtgataactctctaactgggaagatcacagccgtaaaaagaatgagatcatgtcctttgcagggacatggatggagctggagtccattgtccttagcaaactaacacaggaactgaaaaccaaatactgcatgttctcgcttgtaagagagagttaaatgataagaacacatgggcacatggaggggaataacgcacaccggggccttttggagggtggggagttggaagagggagagcatcatgaaaaataactaatgggtactgggcttaatacctgggtgctgaaataatctgaacaacaaccccccatgacacaagtttacctatggaacaaacctgcacatatacccctgaacgtaaaataaaagtataaaaaccccatacagattttaaccatctactagacagaggtgatttcttttattaggctgtattccctctgggtcctcacagagaaacaggcatgagaccatcacgatggctgaaagaacagattctagttaatagttttgccttttgccaacaccattagctccccctcttaatccgaactgctgtatcgctgaagagagtgaccctctgtatttggcttgattttgttgtcctgagtagcctctgctagaaatatccacaagccacagcttcagccttcgagtgagcaaaagcaaagtatccaacaaactcaaatggtaactcaatcctgaaatgctgtaactttgatttgtattttccttctttctttattttttattttttcgcttagacagatatccccttctagctgtgctctctgatcccacttttgtttgtctctttatttcctctgcctactctgcctgaaaactaaaaagcaaattcttttatttctcacgtatatgcctccgaatgatttattttttaaaatgcagcttcacttgaatgttgactttttgaaaactttccctatttcactttttttttttccgctctcccttggaagctcttctttgataatcaggctggtcttctgttctttctacttttcttctgatcgttcaccttttgcccacttaaactgaagccctttggtgtatgcttggaatttcggcagttcaagttcaaaagaaagccctcttcaggtaacctgttctgacatatccgcatcttaacacaaagctttgctagattaatgggttggctaaaaacgtctctttgcttcagtcatagtcacctctgtgtatgagggtagcctcgtgtctattcatttaggggattcttttttttttttttttttgtagaattcgtctgaatctagaagcaaatgttattttattgaatgtcccactttcagagatatatttgagaacaaaaatgttgccaaaaatgtctgaatactaccgtatttcctttattggagcatgcatgtgttttctgtattttaacttttctgaaaagagggaagctgaaaaaaaggggaggatgtctcctacagtctcagtgatctctcagaattgagaaaacgtgataatcaaacatttcagtattatcgggaccttcctgggactgagcacacgtgttgaggggagtaccagggaaataaggagcatggtgaggagttaatttgcagtttgattccccctgctcctttgcatccagaagaagactgtgcgcctcctgtcccaggcccctgggtgtacccacatcgtggtgcatcactttgcatgttgacgggctgagtaacctgcttgtctcttgggaccacttcatttctcactgtgcttcagtatcgcacagacacctgacacctagtaggccctcacaaatatgttgcataggctgggcacagtggctcgtgcctgtaatcccagcactttgggaggctaaggcgggtggatcacttgagaccaagggtttgagaccagccgggcgaacatggcaaaactctgtatctagtaaaactacaaacattagcctggtatggtggcgcatgattgttaatccgagctactcaggaagctgaggcatgagaatcacttaaaccggggaggtggaggttgtagtgagctgggatcctgccactgcattctagcctggaaggcagagtgagattctgtctcaaaaataataaaataaaaacgttgcatgaatgaaaagttgtgtaatcagttctgaaagaaattttaaaaggaatgtgtccttccctttggtgctgttagaatgagtcccatacacattatttttaaccagatcatttgttgagcccacgtgcattttcagtagaataatattaaaaatgcctgcccattctccttgagtatgccaggtgaattctagagtcattcattgagctaagactataaacaggactagtgaagtctttttatttatttatttatttatttatttacttatttatttattgttttttgagacacagtctcactctattgcccaggctggagtgcagtggcacaatctcggctcactgcgacacctgcctccagggttcaagtgattcttgtgccttagcctgccgagtagctgggactgcaggcacccaccaccacacctggctaatttttgtgtattttagtagagatgggattctaccctgtttgccaggctgatctcaaactcctggcctcaagtgatcctcccacctcggcctcccaaagtgctgggattacaggcatgcaccactgcgccggccttagtaaagtctttctcttgtttttaataagaggaaagcccagcttttgcttcacctagttcacaacacgcaggatatcattgttctacatggaaaatttgtgtccgtggaattaaataatataatccctgggaacttccactggttcccggtctccttcttcagatattttatctgctaaatccgaagtcggaatctcagttaagcttattagttaagtcccaaatggagacaattgaagccagaaaaaaaaaaaaaagaagaaggagaaaaagtcctaattatagtttttcttcttaagtgctgcatgcaagtatgaatagggtattaactgtggttttcaacataaaagcataatagtcagtagcacgtatgtcaaaatgtaggcatattagaggctgttaggtgactcaggggccacatctgtggaacaggtacatatttatcttgagataccgagtcattaagaggggcaataaaaaatcaagtgtaaattgagagcaaaggtcacaatctgtggttggtgattttttatatgtctagcaccagcccttgctactttttctttagaaaatgagggccgagtgcagtggctcacacctgtaatcccagcagtttgggaggctgaggtgggaggatcacttgagcccaggagctcaagaccagcctgggcaacactgggagactgcatcactgcaaaaatacgcacacaaaaaagtaatagttatcctgcggtcaccagggcccagctactctggaggtccaggaggtcgaggctgcagtgaaccatggttgtgccacgacactccagcctgggcagcataactgagttgggagggaaaaaagtagaaaatatgtctcggtcaagtctgagcttcattttctattgatccagtcgtggtcttttccaaggaaattattgtatggagtgaactcgggcaattcacttaacctctcaattgctttatctgtaaaatgagaataggctgagcgtggtggctcatgcttgtaatcccagcattttgggaggccgaggtgggcagatcacttgaggtcaggagttcaagaccagcctgaccaacatggtgaaaacctgtctctactaaaaatagaaaaaattagccagctgtggtgttgggtgccagtaatcccagctactcaggaggctgaggcaggagaatcacttgaacccagaaggcggaggttgcagtgagccgagattatgctatcgtgctccagattgggcaacaagagcaaaactgcatgtcaaaaaaacaaacaaacaaaaaagagaataaactaattctcgtatcgattgtgataatacatgaaaagctcttagcacaaatgtaacataagtattcagtaaataggtgtccgtgtgtgtgtatcatccatcatctactatttatctttctgtcttcatctgtcatctgtctgtttctatatgaatatataaatgtatttatctatatttttctatatgtacatatataagggtatttatcatttatctgtatatcatctatctcgatataggtatctatatgtgtgtgtatatatatacatctctgtgtgtctgtgggtgtgtgtatatgtatatatacattcatctatccatttatcgtctatttctccatacaaacagacacacataacatacatttactttcttgaattgctaaattgactaatgcagatacatgttcatttttgtcccatagatactaggcccacccctttattctttaagactcctttaacacaacctgttggatttagaagactccactgacactggagggattgaaacaagagaaaaggaggaattatacttggtaatagctttcatttctcctagattccctcagtcctgtagactatattgagttataagtctttgataatttgtaatttgtatcattaatatctctcagtcagtgagatcttttgattaaccaaaacacagtgaaatttctgaaaagcctgttttattgtagccataaactatgtttacagagctgtttcttctaagagcttcaaaatggtttgtggtgtgtgtttactgtagatgtatttttcattaaaaagtaagataatgctatgactaaccgcccccccccagtggaaaataatgaagaaaacaaaagcattcatcacagtacaatcagcattaaatttgtggtgcctttcttccaccctcagatgtattttttaatttatgtgcctatgatcataatgaacatttaacttttttaaaataaacattgtcctatatgaaccaagtaatctagtctctataatcataacttaaccttaacttgtaatggctatcaaatacttcactctgtgtgtgtgtgtgtatgtgtgtgtgtgtgtgtagctatataacatttaattgtcattatattaggtgaaattaaattttactctttttattctaaataatgccccaacgggtaactttttccatatttaaaattatctctttaggccatatttccagaagtgtaatcataggattagggaaatggaaatatcttgcacagtactttacatgtatttccaacttacttttcaaaagggtcatagcaatgtatataactactagcaatgcatataaatgctagtttctctacatcctcaccagccttgggttttataattactttacattttcctaatagaaactgtatcactgctgtttaatttgaatttcattactagtgaggttgattgtttttatatgcttaatctctgggttcatcttcctaatagaggcctgccttgtgttttaacaattcagctgcccagataacacttagagagccatgagtaaaagcactctgttaagcaaaacaaaagccacatatttccaaagactgtattgtataatttcaatatgagtcagtattccaatgtgtcatccaaacatttcctatcatttgttaatatgatcttaagctaaattaatgtattagtccattcttatactgctaataaagacatacctgacaatgggtaatttatgaaggaaagaggtttcactgactcacagttccacgtggctgggacacctcacagtcatggcagaaggtgaaggaggagcaaagtcacgtcttatgtggtggctggcaaagaaagcttgtgcagaggaactcccatctataaaaaccatcagatcttgtgaaacttagtaactaccacaagaacagtatgggggaaactgcccccatgatccagttttctccattttgtaccatccttgacccaagggaattattcaagatgaaatttgggtggggacacagccaaaccgtatcaaccaatatatgagaattgatttatttactttagtccctatcataagggaagcagtggtccttcttcatgtttcctcatgtcactttttaatgagcaagtcatgcacaagacaccatatttaagaagtatggaagggcacacagtgaaagatgagtgactgaagacatgtttatttccagcatgatgtctttccaaacaactagccaaatatgtagtccaatggaaatgaatgttttagactagagagatatttcttttataaaatacaatgttatgaaataactctcgtgggtctttggtattcaggtgtggcaaatactgttaatttgtaaatcaaaattatttctgaccttcttctataccttgctgtcttccgctctagaggctgaaagactaatttaaaaaatttcatgcaagcttgaaactttctggagacaaaaacataacaaaaagggttagacaagagtgatgtacgttttcccttccctccttctgcttgcctggagcatagaagtgataactggagctgtgacaattgcatcatgaccatgaggagaatgtcaggaggattgcagatacatcagctctgacatagcaaccatcggcttctagatgaggacttccctaactttagtgcacataacaatcacctgaaggctttgttaagccctggattgctgggcccctgttccagagactgtgattcagtgattcagtaggtcttgggtagaatgtaagaattttcttttcttttattattattattattattattattattattatgctttaagttttagggtacatgtgcacaatgtgcaggttagtcacatatgtatacatgtgccatggtggtgtgctgcacccattaactcgtcatttagcgttaggtatatctcctaatgctatccttccgccctacccccaccccacaacagtccccagagtgtgatgttccccttctgtgtccatgtgttctcattgttcaattcccatctatgagtgagaacatgcggtgtttggtttgttgtccttgcgatagtttactgagaatgatgatttccaatttcatccatgtccctacaaaggacatgaactcatcattttttatggctgcatagtattccatggtgtatatgtgccacattttcttaatccagtctatcattgttgtacatttgggttggttccaagtctttgctattgtggatagtgccacaataaacatacgtgtgcatgtgtctttatagcagcatgatttatagtcctttgggtatatacccagtaatgggatggctgggtcaaatggtatttctggttctagatccctgaggaatcgccacactgacttccacaatggttgaactagtttacagtcccaacaacagtgtaaaagtgttcctatttctccacatcctctccagcacctgttgtttcccgactttttaatgattgccattctaactggtgtgagatggtatctcattgtggttttgatttgcatttctctgatggccagtgatgatgatcattttttcatgtgtcttttggctgcataaatgtcttcttttgagaagtgtctgttcatatcctttgcccagtttttgttggggttgtttgtttttttcttgaaaatttgtttgagttcattgtagattctggatatcagccctttgtcagatgagtaggttgcgaaaattttctcccattttgtaggtcgcctgttcactctgatggtagtttcctttgctatgcagaagctctttagtttaattagatcccatttgtcaattttggcttttgttgccattgcttttggtgttttagacatgaagtccttgcccatgtctatgtcttgaatggtaatgcctaggttttcttctagggtttttatggtcttaggtctaacatttaagtctttaatccatcttgaattaatttttgtatgaggtgtaaggaagggatccagtttcagctttctccatatggctagccagttttcccagcactgtttattaaatagggactcctttccccattgcttgtttttgtcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggtgatgagggctcttttttggttccatatgaactttaaagtagttatttttttccaattctgtgaagaaagtcattggtagcttgatggggatggcattgaatctataaattaccttgggcagtatggccattttcacgatattgattctttctaaccatgagcatggaatgttcttctgtttgtatccttttttatttccttgagcagtggtttgtagttctccttgaagaggtccttcatgtcccttgtaagctggattcctaagtattttacaaattcttaggcagtgctgatgttgctggtctatggaccacacttggagtagtaagatgctcgattcattatgtgagaacaaaaaagccctatttttaaagtcactgcagttggtgttgcttgtaccctaaaaaaagtgaactgattcacctgctaggtctgcgtatttctgcttcatatgtaccacctactctagaaagagatgagattatcaatctaattgaatgtgtgtgaagatgacagaagcaacaatcagatggtcaaaagcagattaagaatcacttacttggccaggtgcggtggctcacgcccataatcccagcattttaggaagctgaggtgggtggatcacctgtggtcaggagtttgagaccagcctgaccaacatgggaaaccccatctctatttaatacaaaaaattagctgggtgtggtggtgggcacctgtaattctaccttcttgggaggctgaggcaagagaatcgcttgaacctgggaggtggaggttgtggtgagccaagattgtgccattacactccagcctgggcaacaagagcaaaactccatctcaaaaaaaaaaaaaaaaaaaaaaaaaatcactcactccaggaatttggggctgtccccagtcctgtgtaggctcctttccttctgggaagtgatggactacaagagaggtagagaacagtggaagagtttgaaggtgatctttaacaatggaaggaataacagctacaatcccaatacgtgctaactgaactgctaactgaagtaggagagttatatatatatatataaaatagtgcccctgttctgaaagcttggtatcaaaagctgcagggtttgatgtttagcaggaaagcattgctataacttgcgtatcttctaaaaaatgtgcccacatcctcccggtttgccttgggaacagagagaacttggttatgaagcccctttctccaaggattaattgaatcaagatcaaccctatctggaatgtacatttaatacccgggaatgatgtcagtaatatatgtaagagatttttatattagataactgctcattaaaagtcaatcctttcccccagggttttaaaatagaaagtattcaccttttgcaaatgaggatagtgaaatttactttaacttctgccacaatgaaaactggaagaaagggaattgctcacaatacaatataactccaccaaatttgcataatttaggcataaaatgtaataccctgctcacactcttttgtcttgaatgaaattggttttcaagtaatgtggggaatcataaccagctttaacaaaatggatcatgtcagaaagcaaaagttcctactagcctaggagacatgactgaagtgtgaatgcagtgtgcaacatctttacaaaagttgttcttgtgatttaatgcaaaagcctttgtagactttacagaaacactgaagccgtgctttttgatagttaatgggggaattaaccatttgaaaccttaagacaatctttttctaggattcttaaaatcatgggattgtaacaattctaaggatgttaaaagtgatatacattcctgcagttcctttccaaagatcacagagttctttgtgtaaattagtatttcccaggcctggtgcagtggctcatgcctgtaatcccagcactttgggaggccgaggtgggaggatcacctgaggtcaggaattcgagaccagcctgcaacatggtgaaacccagtctgtactaaaaatacaaaaaaaaaaaaaaaaaaaattagctgggcatggttgtgggtgcctgtaatcccaggtactcgggaggctgaggcaggagaatcacttgaacccgggaggtggaggttgcagtgagccaaaatcatgccattgcactccagcctcggcaacaagagtgaaactctgtctccaaaaaaaaaaaaaaaaacaaaaaaatatttccaataaattttcagcaatgtgaagtaagcctgtctatgtctttcctgtggcacaggtagtgaaactgaggtcaggaaaaggagtgcattgcccatgaccactcattgaagcggtgttcaagttttcaaggcacagactttctgaagcatattgtatgaattggtttttgatatattatggatagtgatatagtaaaggtatgaaagtcaaaagaattactcattgaaagcattggcctccaagagcattttctccccaaacctcttaaggggtttatatgaagtttaaatgttgatgttttccattatcttgctggctgtaggctttgaccctcactttctttcatctttaaaatgaagttgtaacagtatatgcctcatgtgtttcctgtgataattcaacagttaaaatgataatattgtggctggacatagtgccacacacctgtaatctcagcagtttgggcggtgaggcggctggattgcctgagctcaggagtttgagaccagcccggccaacatgatgaaaccccatctctactaaaaaaaaaaaaaaaaaaaatacaaaaattagctgggtgtggtagcaggcacctgtaatgccagctacttgggaggctgaggcaggataatcgcttgaatctgggaggcagaggttgcagtgagccgagattgtgccactgaactccagcgtaggtgacagggcgagactctgtctcaagaaaaaaaaaagtaatattattattactgcctcatatatctttttgttgcagacactattagctgtctaccctggccctcctcagaggtgagcatgaaccagaattccctggaggccctcttaaaacgcaccctcagagcgtttgattcagtgattctaaaacggagtctaagaatttgaattttttaaaagttctcatgtgttgccggtgctgcaggctttgggaccacattttcagaaagagtgttttctcttgtgaccattctccaatgttctgtgtttgttaggtgtgacaatgggtccatctagagcaaaaacaaacaacagtagcaaaccttgatttctcagggttttttttgcatttgggagtggccgtggagccagtgatacagaagtggaagtctgcagggtagggacagaagtgagcttgtacacaccttccagccacacgcccttctcctttcaggcttcctcttgcctggaagaagtatgctggtcagaaagtagggcagccatctatgaccatgagtccagaagccacactggacaatggaacaggaatattggagcataatgagttcctcaagaatagctgaagtagctctatagggccaacctccaaacttgtgttttgcgataaaaaatgaatatgtggttactaactatagaaatccttaactgaattatttctctcaggtacacacaaatcttttggacttcttattttaacaaaaggagaggtaaacagtagggaggttcctcaaaaaattaaaaatagaactaccatatgattcagcaacctcactgctggattatacatccaaagaaaatgaaatcaatatatcggagagatgtctgcactcctgtgtttattgcagcactattcaaactagccagggatatggccaggcacggtggctcacacctataatcccagccctttaggaagctgaggtgggtggatcacttgaggtcaggagttcgagaccagcctggccaacatggtgaaaccccatctctagtaaaaatacaaaaaatatctaggcttggtgacacgcgcctgtattcccagctactcggggccgggggagcagtgcttaggtgggagaatcgcttgaacctgggaggcagaggttgcggtgagctgagatcatgccactgccctccagcctgggtggcagaatgagactccttgtcaaaaataaaataaaataaaaactaaacaaaatagccaggatatggaaacaacctaagtgtccctgaacagatgaaaaggtaaagaaaatttttaacacacacacagacacacacacacacacacatacatatacatgccatgaaatacaattcagccttcaaaaaagaaggaaattctgccctttgcaacaatatggttgaacctggaggacattatgctaactgaactaagccagacatagaaagacaaatgctgcattatctaacttatatatggaatctaacagagtgagactcatagaaacagagtaaaatggtggttaccaagggctggtggctggcaggggagagttgttggtcgggtacaaaatttcaggtaggcgggaggagtaagttcaagagatctattgtacaatatggagaaatcatagttagtaccaatgtatggtgctcttgaaaatcaccgagtagattttaagtgttctcacacaaaacacaaggacgtgaaataatgtatatattagcctgatttagccattccacatgtatacatgtttgaaattttcatgttgtacctgataaacatatataattttatttgtcaattaaaaataattagaaacaaacaaaagtagaggtgaaggaaaaaagttcttggcgtttatattaaatgatgcacaaatcccctgctgtgccccacaattgttggaggacagtgggtggatgagacacacagaatagactcttccttggcccatcttattgagagaccatgttgtgcagcagtgtcatcctctgagacgtagttaagataaatgacatctccttaccttttaccccccgagactataatgtcattctgtagtctgaaaggtcatttgtaaagctcacaggattgctttagctgttaaaatagagagcaaaactcaaaagcaaacctctttctccaaggaaaatactatactttgaacagtctcatcgttctcctgtgattctaaaccagttcctctgcacgcagtgcagaaactagatctctcctgccactaggctcacaaggactcttgtggatctcgttttccccctatcttttgtcttacagtttccaccctcccttttgttctgtgtgtttgaatcaagaaccggcaaagcccacaatgatgtttgtgagcattaagtgacgcaaacacaataaaggattttgcttttttgagccgctcataaaaagagataaattgctttagctttttatgcatgtagaaaaatagagtatgagctaatagtactgactgaagaggaaccaggaagaaatttagtatgcatataaatttaatgcaaaataaaaagccaaatgtaaatattggtttccttccagattttcaaggcttaaaaaaaaaaaaaataagattttctttgcttgttatatttctgctgatggaaaacatcctttccactgttggaaaatgaatagttataaatatagaatacatatatcttagactcggtggtctttaaaattaagagtttggacttttcttttgatagaatgtggcatgtagcatatcgcatgtcttagaatattatttgtcctcgcgaaagtgatcctcatcccttattttaaaggaaaagaaaaggtatgattctccttttgtgcattcagtacacaaaaaattgcctgttatctagggtgtacttgactatggatctccttttaagtcaagactacacttacatgatggaaataataatggaaaattgtagataataataaatatatttttactccatcttcttcttaaaagactttatcgcagagagcaaatagcttttccctttgcaaaaacaagatgctagaagcatagaagagatgaagttaagcaattagtgattggaatgagttgatcttttaatttttttaaataacaataatcaccaatctcgattggacacttactatatgcttggtaattcatgtgtattaactcagttaataattataacaatgttgttataattataaggaaaaaatatttattatctccgtttcacacatgagagaattggggctttaactaatatgcctctgatcacgctattattctgtggagtgctcagaatggaaggtcagaccaccgcgttctaaaacttttgcttttaacctggtagtgtattagtcagtgtctgctgcatcaaaccgccccaaagcctagaggcttaaaaccaccatttattcaactcacaattccgtgggtcaacagtttggactaggatcagctgggtggaggagtgagcagaagtataaagaggtctgatgagggagtgagattagcagcttaatttcttcacgcataacaattcaaggggaccttcatttgcctgattgagcaaatatcttatgcggatagcttaaggaaagagctgcacacctgggctgtgaccttctgggagatgaagtccaaggacatttttagatatggatacgcatagtacaaagagatggaatagaaatgctaaagaaacatatacataaactccttggtgtggatgattcactcactgactgtatcgtgtgccatcctttatgcagacagtgtcaaatgttggtagaaaatgaagtagatgtagccctctgactttataggggcttgcagtctgggaggagaaatagtgaaccagtaaactgttacatcagtgaccacttgtggtacatgttaggtatgaaatagactatccagatagaaactaattaaagaagggtctatttgggtaagttggccaggaaaggttttttggacgaatgataattaagctgaaatctgaatgttgagaagggtacagtcaaggaaaaggaagtcggggctgttttagagatagaggggtgtgtgtgtgtatgtgtttgtgtgtgtgtgtgtgtgtgtaggtgtgtgtgtgtgtgtgtgttccttataagccaacaggtaccgaatttagtgtaggtctaagggatatgttgaaagatgaaggttataagtggaggtttccgtgtttaaattcagtgatgagactctctagctcttctcattttcttaaatgttgcccaaagaatcccataaacatggaaggaatcctacccaggtgctatataaagataaggatagggagcctcttggagatataattgaggagcaccagatggggagtaagatttggcttctcatgttggcattaacgctaatttaccatgtgtccttggcaagggcactctgcctgtccagaatttagttgcctaggctacagtgattgcctgttctgaatggttgatgagagctatgtggagaaaagagtctgaggccacttacaatcactgtgagccagaattctgtaattgattaggcatgtctgccctggacttggaaggagcaagtggtgttgtgtatgctgtatatgtgccattctctgatggccttttattttccagcacaatgttttctatggcttttatgactaattggaaaaattctgtagctttccagtttttttttttttttttttttgtcctggtattttaaaaatgcagcaataattgaaaacaatgagggaggaaaataaatacatcaaaacaatagtctgtacacttacttcaaagggatcaaataaagcaaattatgcacgggagggaggtggatttgtacttccctcgtttgcaatattattagtgtgattaatatacaaagaccaatatttcctgaaattcataatttgccctattcctccgtgagctttgtgtttcccagaataatcatgctgatccatttccttaaaaatgtattgaatgcctaagtgctcattttgcaagggcagcagcataattggacacagtggggaaacagcagagaagtggtttgcttcctgaggagaggagaatgtggtgtgagtaccggctggacggaatgtcacaccaggagggacctcatctctgcaccagtgtcactgagcagaatgcttaagggctatttatggaattagggctggaaaactgcagctaattctcaaagaagggagggcttccctggattataaaatatgtgttcttttgaataatgggaccgaatgagagtagaatgtttcagcatttttttcctaacatgacagccctttggggatcctggtgattttacaactggatttcatcttcatgaaattctgttatgtgtgatcgtttctgctccacccttccccttaaatagtcactttaaaagcatctctatcttgccttggagattgactttcttgttccagttgtctagaaaagtatttctatagtgtgagctttagaaactaggaacagaggaggaagatcggagtccttaggttcaaacctatttaaggtccgtgctctgccttgtgcctgcctgtctctgagtttctcttaatgcttttccaaaacagttcattaatgcagtgacctcgaggtcttgctcagatttgcttccacttggactggtgatgagaattgctggtgaagctgggtccctatgtgtttgcaggtctgtttagtagactcaacttctgcacatgtagcatccacatgtccagtctcttctgtgagatgtggacagcgtcagtgccagcataagggaatcagggtttgagaactctcaatatgggcagggtagccgtactgtgtaaacccatggagcgccattcccattgaattctacatcgtctgctcatcactatgtaggccccgatacagatctaacagggaaattcttgtagtttactgaggcagggccagctgctgggtgagatagagagagatgaggctggaaagtgggtatgagcccgatcacaaagcaggttatgtattgtgattgggtttggaatttattctgaattcacttgccgtcagtggcatttcagagaggcccctttagctgcacttgaaaggatgagttagagaagccccaaactggagggaagatacattaagacatgattgcagggtgaggtttctgttaattccttgcatctctatggctagcaccatcctgatccaaaccaccatctcccccgggtggttgcagtggggatctgacgaacccctgcaccccactcgtccccacctccacaccgcaacccaaacagcctgattatattaccccataggcagcctttcagggacagggagttcacattgctctcaggaaggagacaaaaatccttcgtgtgggtggaggcaaggtcttgcaagatttaaatgtcctcaccctctacattgttcactaagtctccacaccacaccagtcgccttgattttttatcaaagaaatggggtctcactgtgccacccagcctggagcacagtagagcaatcatagctcactgcagcctccacctcctggcctcaagtgatcctcctgcctcagcctcccaaagtgctgggattacagacatgagccaccatgcccatcccaactttattttttttccatccgtcctccatgttctctgtcactaaatgtggttcactctctctggaactttcctaaaccattttattacccctgtcttagtctattttgtgctcccataatagaatacctgagactgagtaactgataaagaacagaaatgtattttatcacagtttcagaagctgggaagtccaagatcgaggcaatagaaggttccatgtctggtgagagctgcatcctctggaggggaagaatgccgtgtcctcacatggcagatgggcaggctggccaaacactgtaaagcttcttttataagagcattcatcccactcatgaggggaggagcctgtatgaaccagtcacctcttaaagcccccacctcttttcaccatcacagtggcattaagtctcattgcccttcaccacgcacttgtttaacttgcttaatttttatttattctcaaaattcctgcccactgtcaattttttacagaagctaaatttcccctgtgttatctatcgaaaagcaagtatctctcctttttggcatttagttcagttgtaaatttacatttgtttatgtgattctttgattattatcttccttccaaaactgtaagtcccatgaggataggggctatttttattggatccttatcatttacccttcctgccacttagcatggtgatgtctcataaccagcagcattcagaaatagttttgaaagaatggataagagacagtagaagtctgaatgaaggcttcaggaataggagcagagaaatggggtggatgtgtggggttggtactttctgtgtcttaatgttctggagaataatgactctcaggtttttatctgggtgactcagtaatggtggcattgtaaacttaagtaggaatttttgaaggaaaacaaggttagaaatgaatacaacaaaggggccttttcatggtgaagaagttctgcatcttgattttggttgaggttacatggatctatacatacacatgaaccacacatacgcatgaactacacacagacacacacacacacacacaggcacacatgcagtgaaatgtgaacaaggtctgtagattgcactagtatcggtttccttgtttggatatttggttacaggtttggaaaatgtttccattgggggaaactgggtaaattgtgcataggaggactctgtaccacttttgcagattcctttgagcctgtaattatttcaaaataaaggtaaaaagagagggatctaaagattggcagggacattggtaaattcagtttgcaggatatggaatataatttgctccttacagactccactaagacctcacctctcctttttgactcaattattggcctgaaattcttgttggctcttcttgcattctaagagtgcagggctctgctgacctgtccacctggctttgttttcacccttcttccatgtggtcattcacatctcggaaggcctaactcccctcctccacacagaatgaatcacaaggtgcaatacttactttccacctattcagcagcataaaaagtccaagcaggtaggattccctccctttccaccagccccagctgtctgtctgtctgtgtgccatgccgcatatctacccagaggaaaagaggtcatcatatgaaaaagacacttgcacatgcctgtctatagcagcacaatttgcaattgcaaaaatatagaaccagcccaaatgcccatcagctgagtggataaagaaactgtggtgtgtgtgtgcgtgtatgtatgtgtgtgtgtgtgtgtgtgtgtgtgtgtgtgtgtgtatacatgatgggatatttatacatatatatatacttacatatatatatacacatatgtatatgataggatgctacttagccataaaaaggaatgaattaatggcattcacagtgatctgaatgagattggagactattactctaagtgaagtaactcaggaatggaaaaccaaacgtggtatgttctcacgcatagtgggagctaagctacgaggatgcaaaggcacaagaatgatacaatggactctggggactcaggaggaaagggtgagaaaggggtgagggataaaatactacaaattgggtgcagtgtatactgctcgggtgatgggtgccccaaaatctcacaaatcaccattaaagaatttactcatgtaaccaaccacctgttccccaataacctatggaaataaaaaaaattcaaaaaataaagtaggaaagaatgacactgacaaaatctataggaaatgggaggctatttgctggactagagtttctcataggcatgatttattccattgcttaaaagcaaaacatattccatactttatttttctaataaagaagagcaacatctgacttttactgagctcagtatgcctttgttgttgaaagagcaagctctggagtcagccctgattgaattcaaatcctggcaccaccaccttgaccttgggaaaactactgcatctcactttgtcctggtcccatttgtgaaacaggactaatagtacctaactcataatctgtggaaatcagctacaatgatgagctccaagagcttagcagagtacctgaaatacaggaaatacccagtaaatattagcctttattatgatgtttatttttttttttttgaggcagagtctcactctgtccctcaggctggagtgcagcagcgccatctcggctcactgcaacctctgtctcctgggttcaagtgactcccctgcctcagtcacccaagtagcagggattacaggcacgtgtcaccatgcctggctaatttgtttatttatttatttttgtatttttagtagaggtggggtttcaccatgttgtccaggctggtctcaaactcctgagctcggatgatccacccacctcagactcctaaagtgctgggattacaggtgtgagccaccacgtctggccttattatgatgtatttttgccagatgctttttgtgtgttatgtccacacgttttaaaaatgtatccgtaagagcaactttacccattggatattttattcctatagtgtaagtgaggaaatagaggctcagagtattcaagccatatgcccaaggtcacacagtggcacattgtaccatggagattacaactcaagtctatttggccccattgtaggtcacaatattctatttcatctctaaacaaactcaggggaccctagcattataaatgcaaaagaatgtttaatgcagataattcctcagcaaaatggagtgtctaaggaagtcttcgggtttgcttttgttctgcctgagccaaaatcatggtacttactaaaatcttactggaagtccctaaaatcttactggcaagggtacttttattacgaacacatcttcctataaatttcgttaggtatttcgtctttgttatcttgctaaagcagaaggctgttgttctggaatgtgaaatttatgaaattgcaatgttagaaggtggaagtaaatcctacttttccctgtggaagaagtttgagaggcagtgcttgggcaagtttcatccttatatggccaggtctgaccctataaaggtgaagggctattatagtggggttcagagaggtaagccaacgtgcctcaggttacctaactagtaactgagccccactttcatcagttctaaaaccagaaaaagaaatacctgccttattgggaggccaacacaggtggattacgaggtcaggagttcaagaccagccttgccaagatggtgaaacctcgtctttactaaaaatacaaaaattagtggggcgtggtggtgagagcctgtaatcccagctacttgggagggtggggaagagaattgtttgaaccagggagatggaggttacagtgagccacgatcacaccactacactccagcctgggcgacagagtgagactccatctcaaaaataaaacaaaataaaattaaaattaaattaaatgaaattaaattaaacaaagaaatacctgccttatggctggatgcgttggcacacacctgtaatcccagcactttgggaggccaaggtgggcgggtcaggagggcaagaaatggagatcatcctggtcaacatgtgaaaccctgcctctacaaaaagtacaaaaattagccgggcgtggtgatgcgtgcctgtagtcccagctactcgggaggctgaggcaggagaatgacttgaacctgggaggcagagattgcagtaagctgaaatcgcgccactgtactccagtctgggtgacagaatgagactctgtctcaaaaaaaaaaaaaaaaaaaaagaaagaaaagcctgccttatagggttgttgggaattagaaatgtctgtgaagtatctgccacttagatgacataaaaatattgctattacagtgatggcattaggtctgcattcacagtggaattacagtatggccaggcatattataatgaaggtttttaactttcttagaaacgaaatttgtccttttgaaactccctcttcaggtttgcccttaatccaggaacctctatcacattacaggcgcccagcagcacatcttaatatatgttaattccctttatttctgatactggagaatttaaatagtgactctcctcgtaggatgcctcctggcatggtggaaattgccagaagacaaaataacagattttatggtacttcgctgtggtttttccatatgtccaaaccctatccgtagctttcatgacccagataaagtgtcattaagtatgtattagtgattctcaaccctggcttcaaattcgaatcagttgggaatgcattaaaaactatcaaaatttggccgcactccacaccaaacaaatgagaatcccagcagctttatgctttttttattctctggtttttattgtttgcaatgtcttgctcttgttacatttttctgactgactatttttttaaaatgtttttaatgtttaatttttgtggttgtatatatttatggggtacatgagatgttttgatatagacgtgcaatgtgaaataattttatcacggagaatgtggtctccatcccctcaagcatttattctttgttttataaacatccaattatattattttagttatttaaaatgtaccgttaacttatttttgaccatagtcaccctgttgtgctgtaaggtagtaggtcttattcattctttcttactatttttttttgtacccattaacttattttttacaagctccttagttaagtgattttaacatgaaatcaaaggtaagaacctctaatataaagcttaccctaaagcccaccccattcccacagcatacactgtccaccatcatgtcgcttattcaatgattggaataaataacggtatgaatgaatgaatagccctctaggtcactaaatgatggtcatcttgtgctttgctttgatgttcgtcttatctttaatctcccctcgcagacttgagatacttcttacagtccttgttggggttatttctgggccccaccgtgtccgaagggaccacagtgtccaagggagagtatatggtcagtaaatgcttgtcatatgaatgaaaaatttatcatgaatacccgtcccatggcactcatggcagaattgttaatggagtcccacctgttaagaataacttattcttctccaactgactctttttttttttttttttttttttttttttctgagatagagtcttgctctttcacccaggctggagtgcagtggcacaacctcggcttactgcatcctccgccacctggttcaagcagttctcctgcctcagcctcctgagtagctgggactacaggcacccaccaccatgtccagctaatttttgtgtttttagtagagacgggggtttcaccatgttgaccaggctggtcttgaactcctgacctcatgatccgcctgccttggcctcccaaagtgctgggattacaggggtgagccaccatgcccagcctccacctgactgttaaaacattttctttttttgaattgatacgacagactttattgacatcataaaaataggtacgtgagtgtctgatatagtttgggtagttgtccccgcccatatctcatgttgaagtgtaatccccaatggtggggggtgtttcggttgtgggagtggatctctcaaggtgggaggtgtttcggtcatcggagtggatctctcaaggcttggtgctgtcttcatgacagtgagtgagttctcatgagatctggtcatttaaacgcatctcgctctactcctttttccatcattgccatgtaagatgccatgtcctgcttcaccttccgccatgagtgaaagttccttgaggccttcccagaagccaaacagatgagagtgccatgcttcctatacagcctgcagaaccttgagttaactaaacatcttttcttcataaattacccagtctcaggtatttctttatagcagtgcaagagtggcctaacacggtgtcctatatggggactaattgtctccaaggttattgaggtagttcttcagcttatcttaaagtaactgttggctttcatctctggatggtgtgtagtgtgggtgggaagaaccaactaagctccagattagttgatgcatggtgagggagtgaaccttcctcccctccttgcttgaaggtaccccaggccctcactcaggcatgaaggtgcaaactcactctttggcacaattttcaaactcttcatcatcttatactttgtctgcaagtacaaacccctactgaaacttcaccccaggccctttcccaatataaaccttgcttgaccacatgcagctgcccacaattatcactgacttcatttttatgattttctttttcctaaaaaaaaaatgccattgctgtagggaaggggttcacatttgcagaacactgacgtcttggctacttacaactcagccacatttggacttttctattccatttggtcagtctccaactctttcttgattcacctgatattttcagtcagaaatatgcacacgttatgcagttttccctttttcaatttactttctcaccatgaagttcccattgacctctccctgttcactgtactctgtgacatcacacattgtgtttctaccgactcaccctgatgtttttcccctttaccgtagatactccttctgaccacctcctctgatcaatacttcgcattcataataaggtgtattgatgtacatatgcacaaaacatctttcataactactcaacttatccctcctggaaataaaacccaatctcaacagtctttggatatcaataattaatgtagaggaaagcccagcaccccaacgcccctgccagagataaaaataagcgaaatatgcaaattcccgttcagacggggcactattgtaatgtgcaatgaagccatgcctatttaaaacaacaacaaaaaatgaatctggcctatggattgctggaatgttgctggcacaattcttgctgtcctcatgggtggcagacgtttaaaatgtggaagatgaaacatactgttgtgagcattgaacatcgcattacgaacgtgctcatggtacttaataaattgtcaaaaataataagactgctgccaagtctgaaagctataaatagctaaaaaaaaatcagacatgactgctgtggattcttttgaaagataattttcctcgtaagtaatttctatgagcaagagcaatacacagttagatggtaaagtctacattcctggctcctgaaatgaacagcctgtgaattagaatgctcccaaagacgtggtgttaaatagagttgcaactacagggtggccattacattaagtaatttaatgaacactgatactgaggaaataaatcaaatgcaaacaatcaacaccaatcaaggaagctgagcatttcaggcacttaaaatgtattaaatgagtgtttcaatcacagtgggtagtttttcacaaactctcttaatcagctagcatcattctcaacaaagtgcccatgcatgtaaacatggtgaactgcaaaagcccaacacattgacacatggacacttttaggaatggaaattctgcttagggttttcactgataggataaacaacagcagataaattgggaaaggtcagtggaagtcaatgttgtgaaacagaaaagaacattcatattttgcatgtagttaaaaaaataagaatttcaaacatagaataaaatttgaaattgaattccaggcagctaatgcacctcccaaaggtggtttttaatgtatctttgcgtaaaatttccattcatgtataagtcctgataggtgcatctttatttgtatatttattatgtgtacatgttatatgcatatatagttatcagtactataagactgataagtacattctctctatatataagtatatgttgtttattcaaacaggatcatatccaagctcactgcctttgctacttaatcaaatatctatcatgatctttccctatcagcctgtataggtctatggtctattgcattctgctcaaggttttcttttttttaaaaaaagtctttattttattttatttttttgtggagacaggatctcactatgttgcccaggctggtctcaaactcctggccataaataatcctcccacttaggcctcccaaattgctgggagtacaggtatgagctacagcgcctggcctggttggaataatattttactgtatgagtccatcatcacttatgcaactctctgcttgttaggcatttacgttcagtttgagagaggataatttattgcaaacacacacacacacacacacacacacacacacacattccttaaaatgtattattttatttcattctccttcaagtattagcattgcatctttttatagcctgtgaaactagggaagagagaggttaagtaatttgccagaaggcacccagataataaacacataacccttgttttaagcccagatgtccttttaattctgaccctatgcctttaatcactacactgaaggttgagtttttaaccaatgttaaaactttatcagagtcgtgatatatgtgtatacacttcaaaagatgtgtatgtttggaaatattgaagaaatatatgtccttgttttgttttctttctagagaaaaagccaggtacattactgtaatcaaaaggggtttctgaattgtaagagatactatcattgttaacagagagtgaaggtaaatattcccactcatgtaagagtcttatgatattcttattagtagctgcagttggataaattgatatttatacgtgtgtctgtgtgtgtgtgtgtgtgtgtgtttatgtacagtttcctctaggagaaagctttttcatttgaaaacattaggtgagttagaagtgctttgcttgttctttcatttccactctacatcttcacatctttgaagagattttgttctttgtactttcaaagaattttagttgaattgggagaaataaaagtattttgattctttaaactccaagtacttctggaggtttggaaagcatattccaatgttcttccaataatgcctgttataagtgcacttacagtcatggtgctgctgtttaagcttacggtttatgaggagacctgctttccagctgcagcctccctccctccacactcctgagggaggcatcttctgtgttatcctgcccaacagtcagtcctcgttcagcaagaagcagggtatcatgtcctctaatcatggtccgtatagactcgggtcaggtggacccacctcagattcccctgtggcccgtaacccgggcctgtctcatcagagcatcccaacccctgacctcagtgcatggcttggggatgagaacctggttcagccaggctggtgccactccattcagaaattgctgggggccctagcaccttggtttggttggtaggagttgtgatggtgggaacttagagtcgtcatggctccagtgatgggagatcctgcctgagatgaaagaccatccagaggggagtatatctgagatgaagagaggacgtgtccagaggccattgtatcaacactcatgttggatctgtaagacacccttcaatgtttagttgtataagccagtaaactccttctcattacactcctttaatgaagttttagttggattttcttgcacattatctcttagagccgtgagtgatgcagtcttctctcatttagggagttgtatttccatatatcttgccatctttactaaattccttggagaaactttgactttttaatataaaataaatacagtctatcactccattatcccttctagtctaccttctcagtcactgtcaacatttttttttttttaactaaaatggagatttggttatatccctccttccagcaaaaatgttagtggcatgccatttcctgcagaatgaaatccacgtgtttttgtttggcggtcaaggcctttggacatctgctcaacccagccttcaaatctcagtgtctcactcacctgcagtctttgttccagggagatcagagagtccaccctagctcaagatagcatgccctctgcctctagggataacatggtctgcagtgcaacatctagcaggttttacagttgggtatccaagtttggcgtgtgtctctgtaacttcatacttttttgtttttttgagatggagtctccctctgtagcccaggctggagtgcagtggtgcgatctcagctcactgcaatgttcgcctcttgggtcccagttcaagcaattctcctgcctcagcctcccgagtagctgggattacaggcatgtgccaccactcctagctaattattgtatttttagtagagacgggatttcaccatgttggctaggctggtcttgaactcctgacctcgtgatccaccttccttgacctcccaaagtgctgggattacaggcgtgagccaacacacccggcaaacttcatacttttgttcatgcttttggtgtgctgttttctccttcacggatttgtctctcctgctggtctgttttgccacattctggtgtcctttggcaaactgaatacccagttttgttttgttttgttttgttttgttttgttttgtttttcgttctggagtccttagtacctctgacagtatgatatttattatatttgatcagagtaccaattaatattaatattcttcctcgtcctcttgtttgatggtttcttggcagaagctatatcttccctgggatgcagaacattgctgaatcatagtagaaactgataggtgtatgtgaatgaactcacaaataaatgcgtgattgaatgaataatgcactttttaacctctatttctttgtaagcaagtcatgtgggttcatgaatataagcagaaatgatggctttaaattttttttcttatttgcgctttcttgtaggctttcattgctttaatgaaatctggccctgaataccttgccaaatacgttttccttgaggatattgataatggctttttatggttatttaagactccctctaaggccatgtatctgcaccaataattccagttttcatttatctattcattcacttttattaagcactttgtagagtgcagaccctggaccagaccacagcagaccaatgacaagatagcatgccctttgcctctagggataccacggtctgcagtgcaacatctagcaggttttacggttggacctgtttctttattgccctctacacactaataataatacaaataaccttctgtgtgctagagtagtggtaggtgctttgtatgcactcttgatgattctcttaacaactcttagtggtgttagaattctttcttcatgaagcagggcacaaaagctctgagaactaaagacacctgagaataacatctgcagctactcagcagtgaaacaagaatttaaaccaagttgtatttgaagccaaagccactacactgtaattccattccttggtcattccctgccttcatcaggatctccgcttggttttgttgagacacagagtatcttattctcatgtccttattcatagctttaagctctcttaagcctactcaaactatttcagtcaaaatatgcagtttacttttccctctcttttttctaaatgctctttaacttcaatgtcccagctttcttagaggtcctgtatatctgaataatcagaattattgtggttttaagtaacagaaacccagtttacagtagttttaacaaaacaacaaaacccaaatgactgtaggatgtattgaatcatggagctgagatcctcatcatggtggctcacagaatcaaatgcatgactcgtgaagtaagggtgtctaaggctgtacctcaagctttgtgactggaactgatggcttggagtttctgggacattctctcttgccaatatctacttgtttccagctcttagtgggctatagttactcttgctgtagacagacatcctccaagtagccaaggaagagtgagcaggcaattccaacattttatcttttaagcatcatgatctcccctttccccaaaagcaagggattgcaagtaacagaaccccatgccagctccagcataaaaattcctgggaaggactccagttggcttggctttgagctcacccatcacccaaactttgaggctaggaagaagagtgttactatgattggcagctctgtggtaacaccatgggttggaaaagtaattggccaaaaggaaaaggggtgattccaccagaagagagaaaatgagaaaatatgccaggatgcaaaatgttagatgtcacagtcatctatggaggcaagtgtcagactttgtgttagtataactgcggactggatagggagcgtttgtccaggctggtgctgccgcggtctctatcttgtttcctaaactccagtccattgtaggctgggcattgtggctcacgcctataatcccagcactttagatggctgaggcgggcggatcacctgaggtcaggagtttgagaccagcctggccaacatggtgaaaccctgtctctactaaaaatgcctaaaactagccaggtgtggtggcagatgcctataatcccagccgcttgggaggctgagacaggagaatcgcttgaacccaggaagtagaggttgtggtgagtcgagattgcaccattttactccagcctgggcaacaagagtggaactccatctcaaactaacaaactaaaaaaaattctgaccactgtagcattggtcactttcaatcatatcaaggtttagatcagaaatgatatagctactataacaattaaattcagtatgtgaaattgcaactgtcttggaaacgtcagagactcactttcttccccttgtctcccaggatcttgctggacgtgtaatagttacccagccttcaatggattgaggagcaacccaggacagtggacaaagccttggtcttgaatcacgtggtctcttctcttgttcagactttggcagctggtcacatgtgtgatttggaccctattacatcaaccataaaatgattgaagaaccagacatgctgtctttttcacagaagattagggagaggcagttagctcatgaatgagaaaatataatataatttgaacagttctgcagtcattaagatagtggtagtaacagccaatatgcatgttgaatgcttagtctgtatagcctgttgtgccaagctttgtgcaagaattactttattttatctgcaaaacaaccctacaggagtcatagttattatctctgtatcagagatacaaacactagagcatagagaagcaaagatacttgccaaagtcatgtagcaaaaacttgtcaaagctaggattcaaactcagatcctagtccttccccaccaggcaaggctgaattactctacagagagagagtgagtgcgtgcgagagacagagagggagagagaaaattctttcctagctctgccttatttctctggctctgatgataggaaagcagtggccacattgtcataagctccagtcactctccaagatggcagaacattccaacactggttaatggctctgggatcatcccatattgagggacatccatccctttgtgttctgacattgatgttactgtcagttgacagtgagctttatcatcaatcccttcaagtacaaaaggccactgttcagaaactgttattaaaagcagcctctctttttaaaagccgtctctcttttattccttccataataggagccagtgtaccagaagaggctgaccttaagttgcgcctgtttagttaaacaaacaacaaaaaaaaggaaatagaataggttatgtttttaatgtatttaagattggaggcctagaattagaatggaactgggggtgggaggagaggtggaaggcaggataggaaaaaagagaggtggccttggattttctttgcttttggataatgggcatttctagttaaatcaacacagtctatttcacagcctgtctcccggtgatgtatatactctttggacagtgttgtgggctgcctaaagatctcttttagccatgggacatgggtataaataagctttatgtagtcacagctactaagagcaatgtgcgtagagtatattctgaaaggagagggcaggatgctcattgtcatggcggatgaggtcaagagagaagggggaagatccccgagggatgcaaattggggagggttttaccaaacaaacttcctccagggtttttattcacattttaatacactttggggggaggtattttaattttaaaaagatgcatgtgatggaggggtgatttgatatagaggttaagtatgggttttataattgggcttccgagattcaaattcagctctgccatgtatgagtcaaagaagtcacatgcatattatttaacctctttgtgtctgtcttcgcatccatagccacatgcattagctgtgaatattaaatacgtcaacacatgaaaagagcttacaagagcacctggcacacggggagtgctcagagagcatttgctgttattacttgcattgtctgggtgctttctatgtacgaggtactgaaggaacagtggtggatgagacagccacagtctgcctccatgagccgtatgttcatagattaaaataaggcaacaaacataaattgatcattatacattttgagaatgctgtgaagggccctcagttgggattagtccagcccccactcccctccccaccaacctactcaagatcgttaagaaagacttccatgagaaggtagcatatgggcaaagatcaaatgcatgaccagctatgggaccaacacaccaatggaaggaaacagaagatgcataggttttgagagcaggaaaaaaagagacttgtgaccataatcccagcactttgggaggccgaggcagatggatcacgaggtcaggagttcaagaccaggctggccaagatggtgaaaccccgtgtctattaataatacaaaaattagccagacatggttttgggtgcctgtaatcccagctactcgggagactgaggcagagaatagcttgaacccgggaggcagagattgtagtgagccaagatcgtgccactgcactccagcttgggcgacagagggagactccatctcaaaaaaacaaacaaacaaaaaaacaaaaaccagaggagagactggtattttagaggacctgaaagcagccagcataggtagagagtagtgatcaggcagggagtggcccctgtggaggtaaggcatgcaggcaaaggtgagatctagccagggcatccatgccaagtgatgacatgattttaatcttagaatgatgggaaaacactgggaaggttgaagagtgtcctgatcagcttcacattttttttctttttttttttttttattatactttaagttttagggtacgtgtgcacaatgtgcaggttagttacatatgtatacatgtgccatgttggtgtgctgcacccagtaactcgtcgtttaacattaggtatatctccaactgctgtccctccccactccccctaccccacaataggcccacattttaaggttactctggcagtggagcaggaaatggcttgtaggtgcggtagaaaggccaaaaggaggttcttgcagctgactaagcaggaggtgatgttaagttagcccaggcacgtggcagggtgagaacagccccttgcagataaggcatgctggttcagctctgtgttctcttcaccctgcttacctaaccaccttcatctgctgttgcttagttgcttgctttcaccaggctataagagcagggactatctttttttcccttcttctttatacattctgtttctagtcctgtgtcaaactcaggctaggtgctcagtatgtgtttaatggatgaaatatgcagtccactgctcattagaatgtttaattttgcaagcccatattattagaatattaagcgaactacctcatgactaggaaagtcactcctcttgacattgcaatgtttgtgatgcggaggtgggattctagattatctttatgtcaaagaaaatgagcaatgctatggaccttgggcagagcacaggcagtacatggcttggcaatgtattttctgtaggaagatgtccccttagctccttatctgtggtatttcaaccaggagccctagttaattttcatgcaggagaagcctttgaaacccaggcctcttttatgctctgggaagatttgagaggggtcatccctgtttagattggttctctgcaccagtcggggaagcctgccggctgttctcagcatggagtatgttgcagagaggaaacagaccagagaaccagggcacttcccagcttgaatcaggcctgtcttgtgtgggttcattattttgttggaaattaatcccccaaatggcagacatagtatatttgaatgtgaactgaccgtgcattgcttggccaagtgagagtggtttttggattatccaacctggttgattgtccctgtctctgaacccttccattagtgtagataattgaaagatacctgattttgttttttcacacccaatttgatgtccttatggcgtttgagatggggtggggagtgtgagatggtcagaatcagcttgctgtcatttgcaatggaagcggtgaagtttgcaaacagcagtaccacttaatgagagcttgtcatgatatagccattgtgttcagctcttaatcttaatgaccacattcactcctcacaacaaccctacagtaataataacactagcacttatttggcatttactatgtgtcaggtgctgttctaaacactgacaagtattaactaacttaactcacaaaacaaaccccagagagtgagagtcacatggactaggatctgcacagcacccttgatattaaactggggggaagccctgcttgtgacatgggtaccattattattctcctgttacaggaagttcagaggggttaagtcacctgcccaaagtcacacagtcagtgtgtggagggggcaggaactgaactaaggtccttaggtctccaaagtccccttgctttcttttcattgcagcagcctaagaaccaaaagttagatatttattatacatgggtttggggctctttacagtatgatagaaaaatatactgctttgctaaagcctccccctaccccttggaggtagggggagagagagagaaaaagagagagaaaaaaatgagaatagcaatgccagctaaaactctgctcgaagcacagagtttggtgcatcagtacatgtgagttaagggaacaaccaaattacaaattaaatgaatgaaaaaactggacccaaactgatgcttcctcttcatgctgcccctaatgacgtagctggagtcacttcacttcgggacttctcaaagccctgcctctccttgccagagatttacgtccagtctgaggatcgtttaaacttcctcctctgtccaggattctgtgaccttacttacaaggcggctgtctgctttctcctaaattctgtctcctggttccgaactcattatttctgatccaaccaattctgtaatgtcagcctgtgtaacataatggaaaaacaaacttagggtaaaggaactccagcgagaattttaggtctccttgcttgatggaggttcgtggccctgagcatttctaagcatcctcatgttcttctccaacttcccctatgacagtccagtcctccacatggggaagagaatgttttatctgtacctgtctttggttttgcgtccctgcacccatcccgcaacttgatagaaaaggcagagagcccttctgccatttcttctctcaatacgcccccaccctaaacctgaaaagaagaaaggtaaaatgggctattcaatgaggagtctaggtgttgggaagaagaatctatttcgaggatctgaaattggaacctgcatcagaccttaggataaagataattatcatgtgcagaaaattcaattaaaaacaaaacaaaaaagaagaaaaagcatcttccaagttgttcttaaagtgtagttttgcaatgactatcactgaaaagtaagtgtggagatctgttcagttctgtaattgagttgggaagtcgacccgaaggaattccaaaagccccagttggccagaagaacaggatatgataggatgctgttgatctgctttcgtttccatgccaaggtgttttgttttgttttgttttgttttgtttttggtaaacttccattcatgactgtgtacagccagaagccagtaggacaacagtggctttgtaaatttgcaacagatattcaaacaagataagtacataattagcatggagcagcagatgaggtagtgtggaagatttaaattctgcgtagggaattagcaaacagttcctgataaccacattctgaacatgttgctgttcgatgggtgtgaatggatcgtgtaggcacagcccatctagatggctaataatagaagggattgttcaagaacaacaatgtattgtgtgcttaccatgtgacaggtaatatgctagactacttagtgatataatgctttcttcgtaatatctctgtgaggtaggaactattataatccacttttacagataagggtgctgaatctctgattgttgaagggacataaccctgccatctctccttcttgatctatatatgtatctctatctatctctatcatacacacacttacatctctaatgaatggcaaagcttggatttgaatacaggtctcatctaactccaaattctatttctcctagaggaagttcaacatgagggatttcgacaaaaaggttgttaaaagcagtctgattgactttcacctaacagatctttccttcatcatcgccatcattttagctctctgcaaagtcatcacatctgtcactgacgttgcacctactttgacacaagctgtgggctacgcaacttgcatgcatgaactcctggggaactcacagcaaaccttcataggtaggcaccattatcctgatgtctgactcaggtgagaagccagaggctcgttttccaaagtcacatacgtagaggtcctgccaggacccaaatttggtgactctgagtcctacattttgcacttttataaccacacactcttttgttttccaatcaaagcttgatcaatggttgatgatagatagatagatggatagatggatggatggatggatggatagatagataatagttaaaagaaatagatgtgtgtgtgtgtgcatgtgtgtgtgtgtgtgtgtgtgtgtatatatatatatatgtacctatacagaatatatacctgtatccatatctatataaatttggaattcaaaattgtgctgtctttctctttcttctgagtcgtctgaccagcttgctgcatttgcagccgccacagtgcatttaactccttgcttgcattggtattcctctttggagcagccccgtcacaacagcaattggaataaaaccccaaagagtagtgcagagaatataaatgggttatttttcacctcaactcaagtaggacagaactcttataaagaaccagggaacaaaggttccatgacaaacatacaccaggggactttagctctctctgatacagcctgtgtgacataatggaaagacaaacttacgatcaaggaattccagtgagaattttaggttgccttccttgatggaggttcgtgggcctgtgtgtttgtaagcaccctcgtcaatagcatttatcgaatatctactctgtaagtgaggctactggatattgcctgtctgtataggttatcatgcagtgagcctggatccatgtgaactaaacagatgtattcagggagaacgtttatctctctaaataagcaattgtttatcaacaatataaatatctatctacataagtgattgtttttatcaaaatcatgagaatcattaaagagaatttacggcaatgagattggaaataagagctttctggataattaaaagctgatgtgaaattaaatcttttattttcaaaggcagagtagcagagtgcttaaggatatgggattggtaataacccttgctgagtttgaagcttgatcccaaggtcataccatcttgggcaaggtgactatgtattcttaaacttggtttattttctgtggtaggaagacattttaacatctgtgcaaccttcataaacctttgactgatgcaatctagtctctgcgtgaaattccattcaatgggggaaagcaatacaaaatgttaaaactgaacattttttaaattttaaagcattttgaaaaacctcttttaaaattaacataaattaaaacaatatatttctgtcttctgaaaaatatacatgtgaaaggaaattcaattcattatttttagtaacacttctcatgtcctctttcctgccctgttctctgggatttacatggtgcaacaactttttcttggctttccccccatgcccacccccactgtctaccgttgacccattcagattctctccctttatttcccagattattaaaatatatatggttttggccttttttcagtcagtgcttttattccttctcttcttccttccatctctcccaccccttccttttatgtcattcttaaagttcagcatcacatatgtccgcggacctgtttttcagctcagcaggctggggagagagataaacaagaaagaaagtctgtggattagaagggtggtgagaacctggaaacatttccatatcaatactttttggtttaatcaccccatttgctttgacttctacctgtcaacagcacacaatgaagaccaagccacagagcctccattcccaggcatgggaaaactctgtgggtagttgagatgcagcagtacccaggttcacttggggcccttttctccatggtcctgataggacagatgagatgcgaaaggatggctggtattttgctcggccaagaggtgaaagggcacaggacaggaggagagtggaggaaatgcaagttggtgtgaagctgtagctctggtgagaataatgtatgagatgagtgcatgcatggtgattttgactataagacccaagaggacccctcctcatacaaatggatacaggtgggtgccaacaggaggaatgcgctgttcagtgtcctataaggttagcaatcatgtcagttttcaaagtccacagagaagtggtgcctgtggtcaacctggaagtatgacggattggataaagaaaatatgacatatatacatcatggaatactatgcagccgtaaaaaaagaatgagttcatgtcctttgcagggacatggatgaagctggaaaccgtcgttctcaccaactaacacaggaacaaaaaacgaaacaccgcatgttctcactgataagagggagttgaacaatgagaatacatggatacagggaggagaacgtcacacaccggggcctgtacttggtggggtgcaaagggagggagagcgttaggacaaatacctaatgcatgcggggcttaaaacctagatgacacgttgatgggtgcagcaaaccaccatggcacatgtatatctatgtaacctgcacattctgcatgtgtatcccagaacgtaaagttaaataaataagtaaataaataaatggaaaaaatgaaagtaggatcatttccacatagcagtctcttatctgtaacaaatatatatatatgtgtgtatatatatatatatgtatatatatatgtatatatatatatacgtatatatatgtatatgtatatgtgtatatatatgtatatatatatgtgtatatatatatgtatatatatgtgtatatatatatgtatatatatatgtgtgtatatatatatgtatatatatatatgtatatatataaggcagtcagaaagaaaggatggtccaagaaggggaagaggttgggtaagaggactgaggcagaaggaggcaggcatgcccaaggtcacctggaacccctgacccttcgagagcagagttcatccttggagccctgggacagagatgtgaatcagagaagttgatgagaccagattgtatggatttggaaagttagtctaagtctttgaacttgacattggttgcagttgtgaattttgaaaagcgattaaaccgatataatcaatatgtcaacatgtgcttaggacaggtgctggcagtctcagcaccactgacactttagccagaacacttttgctgtgggatgctgccctgtgcattttaggacacttcgtagcatccccggctgccactcatgacatgccagcagtgtcttcctctcccgttttgacaaccaaaaatgtccccagacattgactaatgttccctgggaagaaaatcacctttggttgagaaactctcatttaggaagatactgctaagagcagtatgtgggatggatagaaggcatatgaaaccagaagcaagaggaccccttagaaggctgtagtaaaacttaggtggagaagtcctaataatgtgtgcaccccaaagcgtaaaccttacacctgcattccatgagtagatgtgagatttgtaggaactttgagaaagaagaatgactggttggagtatttagcaggaagcacaggggtcattttttgatgtattttatttattgaatgatttggttacttatttttctttttttaatttcattttaagttccaggatacatgtgcaggacatgcaggtttgttccacaggtaaacatgtgccacagtggtttgctgcacctatgaacccctcacctaggtattaagccctgcatgtgctagctatttatcccgatgctctccctccccatgatgtattttatttttctgaatctattaaaaatggcccctcagccaaaggagcaataaattcactcccagcagggatgttagccaaatctcttttccccattcaaattaaaagacagcatcaacaatatttgatgttgaatttcttcttcttctttttttttaaacttttaagttcaggggcacacgtgcaggtttgttacataggtacacttttgtcctgggggtttgtcgtacagttgattttgttgcccaggtttaaacttactacccattagttatttttcctgatcctctcccacttcccatcctccaccctgaagtagacaccactgtctgttgttcccttctatgtgtccatgtgttctcataattcagttcccatttataagtgagaccatgcggtatttggttttctattcctgcattagttggttaaggacaatggcctccagctccttccatgttcctgaaaaggacatgatcatgttcttttttatggctgcatagtattccataatggatatgcgctacattttcttaatccactctatcattaatgggcatttaggttgtttccatgtcttttctactgtgaatagtgctgcagtgaacatacacatggatgtgtctttatactagaatgatttatattcctttcggtatatccccagtaatgggattgctgagtcagatggtagttctcttttttggtctttgaggaatcgccacactgccttctacaaaggttgaactaatttacactcccaccaacagtgtgtaagcattccctttgtgtccgcatgatgttgagtttcttaataaaattcccatgcccttatcccatcatcttttgtaacgttttatttatttttaaaactccttacaattgtccatttttgtctagggtttactcagttcttcactgccagctggccattaaagacatttggaaagaaaaatgctgatgcaactgtgctcttgtacatattgcataatcaaccaaaatagccccagaagtgattatgcttgaagctacaatgacagcaaagatacactgtcattcaccttgaccccatttgagatcatatcatttactcaagttcattgtgtttctaaaacaacaatttctcttagaatgagtgtgtttttgattgtgtgcccgtgtgtgcacatgagcatgagtgcatgtaccgatgaattttacactctgtttccaaataatcttccatcacaattctgtttatctcactcctctgctcaaaaaccttcagtggctccctattgcttatcagatcaactccagggcagtgtcatactgaataccttccatggcccaaactctgttttcctaatttcatcttgtcctgcaatattttctgcatttcactttttaactaagcaggataattgtttaaatgtttatagtatcaacagggggactatagttaataatcattccattgtagatttaaaaataactaagagagtttagttggattgtttgcaacacaagggatgcatgcttgaagagatggagaccccattttacatgacgtgattattattcatttcatgcctgtatcaaaacatctcatgtaccccataaagatatacagctatctatccacaaaaatgaaaatttaaaaacatttaaatgtttataaaaatgaagaaatgaatcaatgcaattccgagttcatttacaacattagatgactgatacagaataacaagatatagactttcttatgctcactttctaaatcaaaattgttatttgcttctgacagggtattcggtatttaattttactatgtcagacaggaaatctagagctgaacatttcaagtgtgcgtgtttatgaatttttcattaattactctgactgaaattggatacaagcctagcttagaagatcacccattgcttatttactcagattgttatccaggtcacctactatccagtgaaatctatcattattcctttacttttgcttgtttcatttgccacatgctttgctggaggtcttttcagtctccctcctctcctctctagccgttaggcagagttcaataactgatgtcttgaaaaacttcatcaggactcacagcctaagcaagtgaaataagctgccttcttggtcagtggagacagatattttcatgtgtctctgtgtccactttcttcttttaaataaacttgtgcaagaactaggtaaaatatctttcttctttctctctcctcaaactcactttgccttcctgattcacctccatgagttcccttttatagtttctgggacttggggagggtggcccagtagcgacgaaagtgcaagtggattggtgactgaaaaatatctgcgatcatgtacgtagaacaaataaagataaaaacactggggccgggtgcagtggcttatgcctgtaatagcagcactttgggaagccaaggcggatggatcacctgaggtcaggagttcgagaccagcctggcaaacatgctgagacgccatttgtactaaaaatacaaaaaaaagtagccaggcctggtggtgcacacctgtagtcccagctactcaggaggctgaggcaggagaattgcttgaacccgagagatggagggtgctgtgagctgagatcgtgccactgaactctagtcttggtgacagagtgagactgtctcaaaaaaaaaaaaaaaaagctgatgaaaataagtccattcccactttcaaatctctgcacatggcccttttaaaacaattcctttatcttcgtgagaaatggcatttgagttttcgaattctagtaaatagccaccactgtaaatctgcaggctcttgatcctagatagccattgcctctacagaaatctgttgagctgagggaaagttctcccattgaaaataattctgtactttacatgcagcctgtggtccctgacaattgatatattgccgcagaattaaacacgcttttctttgtcattgctgggcagagatgactttggtttatgaatgttccagattactttctacctgcctgtctctgctgagtacagagaagtttcatgacccagtgcctccatctgattccagatgacacatggatgaccccaaaatgttgcagccaggttggaatgaagtgggccagattgggaaggacttgactggattgaaatggagtgggctagactgggatggagtggaacagaatggtagagagaaatcagcccataggttttaattaaaagccattgagaaatggcttttaattaaatatctgtattaagatatatataaagaaggcatggcatgcatccaggccaggcatggtggctcatgcctgtaatcccagcactttgggaggccgaggcaggtggatcacttgaggtcacgagtttgaggccagcctggccaacatggtgaaaccccatctgtactactgataatacaaaaatgagccaggcgtggttgtgcacacctgtaatctcagctactccaggggctgaggcaagagaatcgcttgaacctgggaggcagaggttgcagttaggtgagattgtatgacttccttccagcctgggcaacagtgcaagaccctgtctcaaaaaaaaggaaagaaaaaaagaaaagaaagcatgcactctttgagaaaatgagataatgttgctgagaaggagagtaatgttgattttccctctggacatggacaaaatatatctgtgcatatatattaaaattatgaagactatcttttgcttagagtgctatcatcaacttgtataacttgcaatgtgttaaacctctgcacaagagggagaaattacctggaatatacaattttttaaaaccccacaaattacagtcactttctgcctagggttgtgaacagatgactgcaaggagtttggctttcacattcccagtggatgagagaaaaattggcaattgtttcttcccttccaaaaagcagaaaagtcctggcatatcctcattgtgtgtgtttcaccaaaatcagtgtctttgagtcctggtgttagcctcatctttcagtttttccatcttgaggaaggttgtttttttctctacctagtaccaaaatagtacgtcaaagcaaaagcaacttccaaacaactggctgttccagcctctcccagatgtcagatgatgagtgtgattgttttagtggctcagacatgccctgtgagagttattatgactgtacagcagacaaacagaaacaggctgctgagccatttgctgggtcatccttgtcctgggaatcgagccttctcagccagtccatcaagcttcaccagtttcatctctgtaaatgtccacattatggtgttttctttgcccattggatcagcgaggctgtgagtgacagaaaactcaggaaaacagtggcttttaaaagttaaaagtaggctttcttcagtccaggcatggtggcttagcttctaatcccagcactttgggaggctgaggcaggtggatcacttgagatcaggagttcgagaccagcctggccaacatgatgaaaccccgtctttactaaaaataccaaaaaacaaaacaaaacaaaaacaaaaacaaaaaaaacctagctgggcatggtggcacacatcgataatcccagatacttgggaggctgaggcatgagagttgcttgaacccagagacaaaggatgcagtgagccaagctcacaccatcgtactccagcctgggcaacagagtgaggctctgtctcagaaaaacaaaaaaaaaagaaagaaagatggatattttctttttaaataaggtgaaacgtagagatgacaaagacagaggtgcagagactccttgacttcccttctattgcggtattccaccatccagaactcttggtttctgccttcccatccaagacagtggcttgatttcggccatcataccctcattcagatgggcaggaaagagaatcgggaaagttaagtcacatttcctctctttaagggtacttcctggaagctgcatgtaccaatttcacttacatttcattatcccgaaattagtcacatgggtacctctacctgcaaaggaggcttggaaaaaagtagtagatattatggcggtggggggtggtgagtgtgccctgctgaagaattgagtctcttcttaagaaaaaaaggagagatggggaggaatatgacactgtttgcctcatccatattgagggaggcagtgttcactgcagcagcatctcataaacattggttaaaactatgcgtttgtagttattttgctgtcaactggattgcaacatctttcccaacaattgattgctcacttttattttcccactttcattcggcctggattatgttatgttctgggaagaatcggaacaaagggttgagggctgtgatttattatttaaagtttaggtgggaagaataggaacagagaaagatgtctctgccagctgggattgtgtcttgctcatctttgattttccttgcaacctcagtgctcctttatccaaggaagcgcccattctaagtaccagggtcacagtgggcaacaaggcaggccatctcacaaccctcatggaaataacagatcaaggtaagtaccatcaaggagattaatgggatgaagttgcaaagaggcactgaggccgggagagggcccgctttagatgtggagtagacagggaaggccactttgagatgacatctgatttgtagcctgaaggatgagattaaagtcacccactcaaagaaccagggagagagctgtaatgtgcccaagactgaaatggggaaaagtttggtgtgtttaggagaacacagagtgcgcctgtgggttgaaatgggttgaaatgagaaagagatgccttatatagagaagatgtcttatggttctgctcaatattggagggtcatactttctgcttccccaggaattttgtttgaaatccatttgtgtagaagttcttagtcaccccagtcttagctggaatcattctagcatagaattgaatttgagcattgagaattcatgctcaaactgtggggccggtgtgggatggcaaggagaatgatatctatgttttcacgggagggtataaagagagaggctctgataaacacattcaattggttgggggaaaaaagtaaacttatttggaggtacatttctggaatcgcctgatttgaactgagcagtgcagcctccatttatgaaaccatttctctgaatgtttcttttttccaatctgtcttccattctgacagatgtggcatatcttgtgcccaattcaacaagaactagtctccctcccttcctgtctctctctctccttccttggagcttagagcttctgctagtgtctgctcctttcctagttggcatggtagttgctccatttgtttttgtaaattgaggaattttctttttgtttgtaaatttgtcattatctcctacaaagcaccctgccatggttttttaaatatcttgatgtcttcacattggaagcaccactccatctgtgaactagatgcttccatcccaaaatgccattccaaaggagaaagttggaaccaaaagtgttggtagcagtggccaccaccagcaacatccactattacaggattaataggaattaaatctgcttcagctgtgaagtgagccaaagctttacttgcaagtggggctaaaacatttttttttaaggatttaccttaggtaaattgttctagactattttgactttaatttgctgagggtgaatttgcaatggggattcgataaccttactttcatagagtctcaaaacttatagttacacaacttcttctactgcctgcccattgctttgggttccttttcttgcaagttgcaatttgtttggtttttcagtgttctcttggataatccatctggatcactttgactaccaattttgcagcttcctgtcatgaaaggagaaaaactgaggtccaaggaagtatgcaaccgtttccataaccatgccatatccctgcatgaacttggcttgactttctcccagtgaagttgcactgggtatgcagtgggctccagagtcatcaaagtggctgttgcccttaaatagtcattgcattatactgttctcttgttggaaacccgtcaaatagtcttaaactgaagttcaaatgctcccactggctggtaggacagtgagtgatcagattgcatcaggcccatcggttctcattgcttaccattcacctcctcgctcacatcactacagccacagggcccttctctgcagacctcagacccaccacattctcttcctcttcaggaccttttgctcatactctccccaccgctaatgtgctcttccccttccttgtcttcagtaatccggatcactggatagaagccacaccccttggaaagcagtccctgaggcctaagtgccaggcaggtgctcagctcttttttgcagcctatgttgtcttttcttagcatgccactgaaacttctaactatctgattagtttttttgttttatttctgtcttgctcaggaaatttcttttccttgattacctctgagtccatggcatatgacctaacatgtagtaaatgtgcagtgagcattggttgaataattgagcgaaggaactccgagttctgtgtgtgggaaccgactctgataagagcaaacgcttgacacccaacctcgtcctgcctcccatgccgcatcaccctatttccaatattgtgggtggggctgatggttcaaagatgtacttcattccatttcctttttccctacaagccattcaacaaccataacggagacagttatctggggctattttctagatgttagacacgaggaaacctgaaaggaacattatgctcttcgcacactcacgtgtttgtctggttaccctcgggcctctccaagtggccctattttttttttgacattttgtttttttgtttgtttgtttggggtttttgtgagacagaatcttgctttgtcacctaggctggagtgcagtggtgcagtctcggctcactacaacctctgcctcccaagttcaagtgattctcctgcctcagcctcccgagtagctgggattacaggtgagcaccaccgtgcccagctaatttttgtatttgtagtagagacggggtttcaccatgttggccaggctggtctcaaactcctgacctcaagtgatccacccacctcggcctcccagagtgctgggattacaggtatgagccactgtgcccggccagtttgacattttgcatagcttacaacatttattaaacatttaaagacctgaagccttcttaaattagtgtttctcaagcccttcttgtgcaggatatgtgcgtcaaccaccaaattagctttggtgcacccagcgtgggaaaaggagcttttctttaccatgttagctctctcaactgccttccttgtacttttagcttcagcctttttgaaccaactactctgaattcttcagaatccctctgtctctcttccttctgccccctcttctgcccagattcttcttgctccctctcctcctcacttcttgtacatttgaaaaccctgtcttcctagaagagtcataccactttctcttcacatgcagcatccttcctggtattgtgggtccatggtaggtttattattccttactaaacattctggcttctctttttgtggtatttcttactgcaggaggatttttacatccccatcaggaatggccatacatcttacttcagctaatgaaacgtgggggaagtgagatgtgtcacttctgggcggaagctttaagagcctctatctgactcaacttattctcttctcccactgtggagagatcagtgagtcacttctctatcagcctggacccttgagagaagatgacatgtagcaaagccatagctaaaagacagccaacacatagcctagtgagaaataaatcttcactgctgcaagctaccaaaagtctgaggtcagttgttactgcagcgtctagcccatcctgaatgatattccgttgtgtctcagaagccatttctttgtaaaaccttccaagtctctagcagaatctcagaatctaagagtcttagaatctatttactaacaggccagacacaattgctcacgcctgtaatcccagccttttgggtggcctaggcaggcagatcacttgaggtcaggagttcgagaccagcctggccaacatggtgaaaccccatctctactaaagatacaaaaatcagtcagtcatggtggcacgcgcctgtaatcccagctactcagggggctgaggcaggagagtcccttgaacccaggaggcgaaggttgcagtgagctgagatcgcgccattgcactccagcctgggtgacagtgcaagactctgtctaaaaaaaaaaaaaagaagaagaagaagaagaatctatttaataacagaatcctagaagaaccttagaatgttagaatccttaaagtctgttgcttttatcatgtgttcccatggcattccctcataattagtttttttgtctgtcttctgtatgacattcagttctgtgcaggcaggaagcttgattgattcgcttctgaattccatactcttagcagagtgccttatgattggcattcagtaaatcactgtgactgaaagcaaatggagcagtgcaaagagatttctggctccaccaccatcatgaatatttttgatgggataggttctagtgaaaagcggtatccacctctatggaaacatggtggtgtttgaagagttccccacagccacacaaaatggaggcacccacttggaactgaattgattatttatggcaaactctggatcccagtcaggaatctgaaaaagggggaaaaaaatctggggcagtgatcaaaggaaaagtatttggagtatatgggcagaaaaaaaactgtcagagatattaatttaaattcacaattcatacactaacaccgtaggatcatgtttcttaggtcaatgaactctactcatattatttggtgatttgtttgacctctcctgataaaccccgatttcactatctcctatgtgtccctcctcttctgttccttataggacttgaggggtgtccccttggcttcttatctctttctctgtagcctaagagaaatagaccatggatatatccagttgcaatggaatccagttgattcctttgtgaaaacgagcaacagtcctttctttagcagagaagctagagtcttatctgacagatttctttttttaccataagtttttctgaaggtatgggtggaagactgcaaaaccctgaacatcaacaagcttcagtgttgcagatactaggagagatctactcctaaaaccaacaatcaaaacttctgtttttttccctttttcccatgaaagagtcaactgaattcgggtacaagtcgcttagatttaccaagtatgataaccaggtgtgtggctattctgagcatccatagctgaaacccacaggttggacatcctgtgacagtttcttagcctgcaaagaacagtgagcatgaaagctttaaatgggctattacctttttatatttatcccaaactgctaaggtcagcattaaaatttgaccttttccctgccaacccgtttgaagtaattaacccctgtgtcttgaaacacaaggaagctatgactttgttattaaattctcataaagagcctattaatattaaaattgcttcactcttgggctgaatgtattaatggccttgcactgggtaaacacaaaccctcagctcagtgttttaaaatgcatgagttgagggcagagcatgttcttccagctaccttttctgtagcagaacgttatgccttttgtgacagtttcctctccaatttgttcaaatgcttttgttttgaatctgtgtccctagatttacatctctttatggggaaactcatttccctgctagcaggtatggagcaggtcgaatggaggagaactcccgtgatgacctctgctcccatcaccctaatcatcgccttccaggacagtgctcagaccctaactgtcttggtatgaagcacagcttgtgattattcttttagtgggtccaagatagctgtgttcaagcacctgtgaaatgtgcttaaaaatgcagaggtacgcaatccagcatagacctcctgaatcagaattgacagagatgagaccttcctgaatctgcagtataaattaaattctcaagggtttactctagtaaaccctactgtgaacctgactatagttcagtttgttaattcaatcattcaaaatatgcatcgaacagttattatatgccagggtttatggccttgggaatacagtggaaaattgaaagagtcaggtgtttgttcttagggatcttacagttcatcgaagaaacacacaacacacaaacatgcaagtaaataattaaaaatagttataagtggacttctggaaagatgaagtaaacattttttccctgttcctccaacagagaacaaacaaaatgcctaaacagaagtgcagtcttcccgcagtatcagtgggggactggttccaggacagtccaaaatccatggatgttcaagttcctgatataaaatggcatagtgtttgcatataacctaaaaacatcctcctgtatgctttgtggggacatatctctcacttcaagcatttatcattttatttgtgtcatctgatatactttaaaacatctttacattacttataatacctaacataatataaatgctacgtaagctatgtcagcaagagggacaacaacaataagcattagtatgacagatttctcttctctgctgttttcaaaattatgctgtatgcttaagcaaaaattatactgtctgatgtgattggtgaatatgtaagtagtaaatagttgttatactgtcatttaatttgtattatttttattgtattgttatttatttttaaatttttggaatatttttgatgtgtggttggtagcatctgtggatatagaacccatggatatagagggctgactggatatagtttcaaatcactgagtaaatcccaagtcagattaactgaaggaaatccacaccaagtcacatgatagtcaaacttctgaaaagtcaaggcaacgaaaacatcttggaagtaacgagagtaaaatgcacgccatccttataggaggaaacccatttgaaagagaacagatttctcatcagaagccacagagtcaaataagaaatggtgttttccaagtgctgaaagaaaatacttgtcaactcagaattctgtattgagtgaaaatctccttcggagatgaaggagaaatcaagacattttcagatgaagaaaaactaaaagaattggttggcagctggtctaccttaaaagaatggctgaaagaaattttctaaacagaaaggaaaggataaaagcaggaattttagaacatcagcaaggaggaaaacaaaaatagccattaatatgataaattttccttctctggtgttttcaaaattatgctttatctttaagcaaaaattataataccatctgatgtgattcaaaatacaagtagtaggaagatttaagacaattatattttaaatggggagaggaagggaacataaagggagttaagatttccacacttcattcaaactggtgaaaacatagcaccaggctgtgacaagttatgtatgtatattgcactacctagataactgctaaaaaaatctgtaaaaggagattcactcaaacagactataggcaaattaaaatttaattatgaaaatatttcagcaacctagagaaaggcagaaaaggcaaactgaaaaacacaacagaaagaacaaataaaaaaaaaagaataaagtggcaaaattaagcactaacataccaataattacattaaatggcaatggcctatatacaccctttgtaagagattgttagagtggattaaagtatacaacctaactatatgctgttgacaagaaactcctttcaaatttaatagtataggtagactgaaagtaaaaggatggaaaaaagatagagtatggaaacatcaatcaaaagaaagtaggagtagctatattatcagataaagtagatttaagagcaaaaaaaaaaaaaaacaactagaaatagagacgatatgtaatgatacagtgatacagtgtcagtccaacaagaatagcattcctaaatgtgcactcattaaacacagagctacacaatatatgaagaaagaaatatataactcaaaggagaaatggaagaatatcacaattatagtcagaggctaaacactattaggaattaataggaaaactagactgaaaatcagaaggataaagaacaatgcaaccattatccatcaacgaggactaatcaacattatagaacactcccaatgacagcagaaggcgtttctttttcatgtccatgggagatatcctgggccataaaacaaagtttaacaaatttaaaataattgaaatgatacagtgaccacaatggaattgagttataaattaataccagaaagataacaggagaatctgcaaacatttggccactagacagcacattgccgaataaattccatggattaaagaaggagtctccaggaaaataaataagtgtattgggcagaatgaatgtggaaatacatcacaatttgtgggacacagctaaagtaatactgagaggaaatttatagcaataaatgaatacattagagaagaggaaaagcttcaaatcactaatctaaactcccaccttaagaacatagaaaaagaggccgggtgtggtggctcacacttgcaatcccagcactttgggaggccgaggtgggcagatcactagaggtcaggagtttgagaccagtctggccaacatggtgaaaccccatacctactaaaaatacaaaaattagccgagcatagtggcacatgtgtgtagtcccagctactggggaggttgagacaggagaatcatttgaatccaggaggtggaggttgcagtgagtcgagagtgaccactgcacttcagctggagcgacagagcaagaccctgtctaaaaaacaaacaaaacaaacagggaaggaagttataaagatgagagcagaaatcgatgaaattcaaaacagtaaaacaatagaggaaaatcagtacaaagaagaagctggctttttgaacagatgagtaagacaaacctcctgacaaatctgagcaaaactgatagagagatgacacaaattatcaaacagggaatatcactacagactttgcagatgtcaaaaaggtagtaagggaataccgtaaataactccacaaacttatctttgacaacttagatgaaatggaccacttccttgtaaaatacaaaccatcatattttactcactgtgaaatggataatttgaatgtcctataactgttaaagaaattgggtttttaagtttaaacctcctaaaaaataaatctccagatcaggaggtttttgttagagaattctaccagatttagaatgaagcattaacaccaagtccatatatcctcttccagaaaacaggagagaaataagaacttctcaattcattttataaagctagaattaccctgacagtgaaacaggacaaagccaggagaaaaaagaaaagaaaactgtagactaatattcttgatcaccattgactgtaacaaaatattaacaaatagaattcaacaatatataataataattttataccttgatcacatagggtttatttcggggatgttaacactggttcaatatttacaattaaatcaatgtaatctaccctaccaataggctgaagagaaaaatcattcaccgaatcttatcaatctatgtagaaacatacttgataaaattcaacacccattcatggcaaaaactgtcagaaaaacaggaataaagagaattgaatttgttaaagaacacctaccaaacacctacagctgacatgctgataccacaattaaaaatgcaatgtcatgtacaatgactcaaaaaatatacttaggtgaaattttaaccaaatacaacttatatgtgaaaaactgcaaaactttttaaaaatttaaggggagacatcattttcatggattggaaggctcatcatagtaaagacattgattctccccaaatggataaacagatttaatagaatttctgtaaaaatcccggtaagcttttttgtggatagagacaacactattctaaaatataaatgaaagtgccatgaaatttaaaaagcttaacaattttgtaaatgaagtataaagtgggagaaatgagtctgttcaaaaacaaaacttcttatatagctacagtaatccggtgtggcaatggcagatggatagacacatagatccattttaaaaagtgtatagaacccagaaatagacctacataagtatgtccaactgatttttgacaaaggtgaaaaggcaattcaatagaggaaagataacctttcaacatatggtactagagaaactgggaattcttgaccaaaattttacattttatacaaaaaaggctcaaaatggatcattaactttgatataaaacataaaactataaaacatttagtaaagaaaaaagaggcccgttacattggctcatgcctgtaatcccagcactttgggaggctgaggcaggtgagtcacccgaggtcaggagttcaagaccagcctggccaacatggtgaaaccccttctctactaaaaatacaaaaattagccaggcatggtggcttcagcctgtaatcctagttactcgggaggctgaggcaggagaatggcttgaacctggaggcagaggttgcagtgagccatgatcatgccactgtactccagcctgggcagcagagtgagactctgttttaaaaaaaaacaaaacaaaccaaagcaaagaaaacagaaaatctttgagatttaaagctaggcaaagagtttgttgttgttggtttttttttttttttttttttttggcaaagtttcactgttgttgcccaggctggagtgcaatgacaaaatctagactcactgcaacctctgcctcctagcttccagcgattctcctgcctcagcctcctgagtagctgggattacaggtacatgtcaccatgtccagctaatttttttgtatttttagtagagatgggcttctccatgttggtcaggctggtctggaacttctgacctcaggtgatccgcccgcctcggccccccaaagtgctgggcttataggcgtgagccaccatgcttggcctagagttcttagaattagcaccaaaagcacagttcataaagaaaagaaaatgataaattggacttcatcaaaaaaattttttaaatcttgctcggcaaaacaccctgctaagtggatgtaaagggaagcttcagacttagaggaaacttttgcaagccatgtatctgacaaaggaccaaaatctagaatatatgaggaactctcaaaactgaaccaaaaaaatcaagcagtgagcaaaggacatgaagagacattttactgaagaggatacacagatggcaagtaagcacatgaaaagatggtctacatcattaaccattaaggaaatgaaaattaaaactgcagtgtggtatcagtgcacacctatcagaagggctaaaactaaaacagtggcaaccccagtacttgcaaggttgttgagcattcggattacatacacatcgctggagaggatgtcaaatgatacattcccatagccactttgagatatagtggagcagtttctttaaatgtaaacacgcagttatcagataacctagtaattgccttcctgggcatttattccagagacatggaaacatgttcacacaaaacctgttcaccaatgtttgtagcagctttattcataatagatagaaactgggaacagcctacatatatttcactgggcgaatggctacagaaattgtggtatatccataccacaaaatacaacccagtaacaaaaaggagtggactgttgataaatgcatgcaacagcccaacagcctgaatgaatctccagaaaattatgccgcatgaaaaattccaatttatgtaaaattcttgagatgacaaaataatggaaatggagaacagattagtcattgccaggggttgagaggagacagggaggaggaaggaaatgggtgtggttatgaaagggcaacatgaaggatctttgtgcaaatggaaaagttctgtatcttgactgtattagcgctatcatcacgcaatcccctgatatcatactatggttttgaaatcacccttgtgggaggaactaggtaactacacaggatctctgtaacattattgcctacaaattcatatgaatctagaattatctcagaatgaaatatctaatttaaaagggacatttatgatgttaataaaactaagtgctattcagagaatgagcagaaggaggacagttgaactttcctacataggctgttctttttaagaagaagagttggtcattgatccattaatgatgagaaggaaccagttctgtctagtggaaaagcattctggacaacagagtgagacactgataccgtgtgctgtgaaaacttttagctgagatatgtcgctcttgtccggagagtgacatggaaatatccagtcttgcttctacagagagtcacattgtctggtcacacctatcccactgcaagacaatgtaagtgtgtgtacatacctacatctctgagattattttatctgcaagcttcagggcttgcaaagttagtatatagctgagcatggtggcgggcgcctgtagtcccagctactcgggaggctgaggcaggagaagggtgtgaacccaggaggtggagcttgcagtgagccgagatcatgccattgcacttcagcctgggcgacagagtgagactccatctcaaaaaaaaaaagaaaaagaaagaaaagaaaagttagcatctttcaatcagcaaacatttattgaacactcactgtaataacaactggtggtatttctgcagtgcttgactgctttcagaatgttttcacacacctgatctcattcgcatctcataactaccccgtggaatagtaattattaacacctttattttcatttcacatctgagggcactgagactgaaaaaatggtatgttgttgtgtttgaatgtgcttgatatggtagacatgggggagtcacatctgtacatatagtcctaaagtctatatttatttccattgtgtactgatgatagtactacattatttgatataataatggaagggacatacctatttttaaaaaacactactttggaggaattaacagtttactaaggatacataaatgccatagaaaatattagcaagaaatagaagaaagtgattattttgtctgccaattagtatgataaaggtaactgaccttgtgaaataaagaaggaacaatataataatatttaccaaatattttaaacaattttgtcatcaccatttaccaaataaccctaatacttccctccccagttgatacgtgatggcaagccagggtgagtttttgtatattgcattgccttaattcattgattgatgctggtactgcaggtgttggattattataagtttaagctattctttaattgtacagatagtaagtcttctctcattggaggggatggatatgaagggatttaacatttttttaaaatttaaaacatcatttctcattaaataaatacctttttcttttttcctgcagtgaagaaaaacatagataaacggatgactcaaagtggaagggaacaagtgattttgttacagtcgtcagaactgtggccagaatcattttagataaatatgtcaaatgtgtggaatgtcacggaagtggtcgttttttgtcctcccagcttggggcacatgctcatagaaatatgtgttagttattgagagtctttttttttgttaagacagtcccattctgttgcccaagctggagtgcagtggcacgatcttggctcactaccacctctgcctcctgggttcattcaagtggttctggtgccacagcctcccaagtagctgggattacaggagtgtgccaccatgcccagcgaatattttttgtattttttagtagaaatggggttttaccgtgttggccaggttggtctggaactgctgacttcaagtgatccttccaccttggcctccaaaagtgctgggattacaggcatgagcctccgcgcccggctgagagtcgttttttaatgttggattcatatttatcccacacattgactggttatgcagatactggtcgcattaagttcccaagaagttctcctctctgctgctattctttatcacagcatcctgtttatctgtttccccacgtgtattacagtctgtaattatttcttttctttgcttttttttttttattaactatgctccttccaggaatgaaatctccatgaagacaaggaccatgctcattttattttgtgctttatattcggtacttagatcagcgcttgccacaggacaagtggtcagtaaccatttgtgaaatgaatttgatttaaataaatgtacatttccagaagaaatgggaaatagacctacctggttaaatgagtgtttttatcttaaccggacatgggttatcactttgtaaactaaaaacaatcccatctcagtactgtaccagacacaattgccggaggttcagaaaataattaaagttttgtaatgacttataaattgcattattaaaaagtcaattttcagctgggcacagtggctcacacctgtaatcccagcactttgagtggccaaggcaggcagataacttcaccctaggagtttgagaccagcctgggcaacatggtgaaaccccatctctaccaaaaatacgaaacttagccaggtgtgatggtgtggttctgtagtcccacctactcaggaggctaaggtgggaggattgaatatgggaggctgaggcagcattgaaccgtgatcgcagcgctgcaccccagagagagtgacagaacaagagtctgtctcccaaaaaaaaaaaaaaaaaaaacctcaatttttatcaggacacagaggctcacaccttttatctcagcactttgagaggctaaggcagaaggatcgcttgagcccaggagttggagatcagcctgggcaatagagtgaggtcgaggctgcagtgagccgtgattgcaccacggcaacccagcctgggctacagagaaagaccttgtctcaaaaaaaaaaaaaaaaaaaaatgtccattttccaaatccgtgctgactccttggatcccgaccgctgtatataactgctggtttcccctacatttaatgtgcggtacagagaagaggggtggcaatgaagacgtgtgctagagacatacaagattctgattgcgattaggattactttagaaacttttgatctgctgggattgagtcatgattctgtaaagcccttgaagaaatacggttaccctcgtgtaagctgtctttcacagctcacttttacttggcccggagtttaattccaagtaatcattgggtaggtgatgaggttccgcttctccttgagctgaacgaattaaaatgtgaagttcccttactttgtaagtgggtaggagttcattggacataggccattagtcacttaatttttatgccatataaatggggcatctctttgccattttgcatgaagggactttgtggaaagccataaagaggggcagtaaatgtgcaggcaggtactttgtgaccacgttgcccctttcggctcagtccccttttgagggatgattcgttgcaggcaatttcctgccctagtggcagggagcaggcatgtgctttaaaatccttccttttaagaatgattccttgccctgcaaggttccttcaagttatttttttttttcgtctccaactgggggaaattgtaggactcaccaaaaaaaaaaaaaaaaaaaaaaaaaaaaaaaaaaatagaggcacaacacaagaagagtattacctaatcgcatgaagcataaatctgtgcgtcacctcctactttaataaattgctctttagtttcagaattggtgaatctaagtgggcacccaaagaagaaaaaaataacaattttccccttatctctgaatttctcttttgagctttttcgtagattatcgtgggtctctacaaagatttccttttccttctatttttaggttgttaaaaaaaagtcatactgtgtacttttttctcataatcctttatttgttatttaaagtataaataaatcatagatatttgcatacagcttagagcagagtaggtggggggttattttggtttatatcagagaaaatggaaataaaatagaaactcgatattgtttaaagacagcttaacagcattgtaaggttcataaaagcccaataagctattcttgatcttaaatcttaaatcgttggtgattttcatttagattttttttaatcaccaagaaggttgagatatgtctaacccgttatgtgagtttgaaacaaggtttgtgttctattttccattcctttggtctaaaattttattagacatttttcttagtgcaaaattaattgatcctggtggtgaggtggtgataaatcattgcaggtggggggaaattgatttttataccacctctcacttatttcaatcttagtggaattaactctgttaggttctgggggtgtttatgggtattataaaacatttacatcttgatgtattaaggtacttgagtggtttttagacattattaagggaattatgttaggattagtctggttatcaatttctgtatctggcacctagctaaggaaatggctgttttatcctcattagagccataaatagaattttattaactagcacgtaccaagtgccaaggctggtggtgaaaaccctttctgccttgaaggggagactgtagattcctgagcatgagacgttaaatgagtaagtctttgacaatctgtaaacagcttcctctgcagaagagtgccctgttgccttggagtttgaaaatactgcaggggataaagattccatggaaactttaaacaattgggactgatggatttaatccctctgatacgcttgtgtaagtctcactgaatacagatctgattatctattggccttggagaaggaacactgagactgtccatatggaagattattagggagaagagaaacataaacacactattaactattaaccatgctgtatatttgatctttactgaggctgttgatgtcagggcttggttttatttatctgaattttcttttgccatcaagattagttttaataggcttagacaaaacctggctgaaagattataaacaaaagataatgataaatggtaatgttcccacttggctgggatctggggagagaggaagggagattcataatagcttggtctaggtgaggattttttttttaatgatctggaagggaaagtaaattgcatgctaatgaaatttgcagacgatattaaattggaaggtgttgcaaataggagcgtggactggggacattacagaagcctatcctaagcaggttagaaatatgagcagaaaagattaaaacacgattcatcctagaaaagacagactaatacattttgggggtcgggaaagggggataccctgaatcttgcaatggaactgatgggaaaactcagaaggaaaaatagggaccagaggtagaggaagctacaggcagtctgcagggtggcattgtccaaagactctctgttggtccgtggcctgagtgggataagctgcatcgtcccagaatccaaggacagccgcctccctccgtcctcgcttctcacaacttctggggctgcctttctgctgtctctgtctttgttttcctctctcttcctttttttgttctttcatatctatcagctcacccacccctagtctgtagcatttatttctggtacctttagtaggagaaagatggagacagattggagacaagttggcaatgaagagtgaaaaagattaagggaaggggaggattgatacatgaggagggattaaaagcattgcatttgcatcatgcgtccacacagcatccagaggaggacataagcacacaggcacttagacaatgtaatgtcgcagtactcaggaaggtggccgtggcattatttagccccacgagccagaatatagccagaagtaattaagatagggaaattatataaccaaaattcattgcgggagagaatgagggttggaaacatcacggtttatgtgtttataccggtcattacataaaccagtcacatctgaagggctcacagctacactgaacaggggcttgcttaccaacagaaaatcccgaggacacatactacagagagtatgtggctatttccttttcctttgagattttttgttaatatatatgtctaggagcgtgctcagtctaacatctccaaagcagatctgcatgctagcaatgctagcaacatatgtgtgtgtgtgtgtatgtgtgtgtatatatatgtgtgtgtgtatatatgtatatatatatgtattacatatgtatgtatatgctatcaacatgcaggtctgctttggagatgttagactgagcaccctcctagacatctatgtccagtggaaagagcagtggagagcattgggctaacatgtattgagcagatggtgggggatgttagtaatgagatataaattgatactgtgcagccaactttcagaggtgcttactccatgcccggtgctaggacaagcaccttgcagatgtgatcccacggaattgtcaccataaccttcagagatgggcactgttattgatcccatttttcagaggaggaagatgcatctcagagagattatgcacaccgggaagtgttactctgcatagaagtaggggacagccaggattttccacaccaactccggagcccacgccttgtaataccacgttttgctggtgaatccctaattcagaaaattaccatgaatgtgtcatgggagaaaacagcttccaccgagggtgtgggccccaaagtgctttgttctggaattcattgcaggggagaggaagagacttcagggtaaaagaaacaggtgaggtgtggggacctttgcattattttgtgggagaacaccgagtaaaaaatagtggcggtggtgttggtagtaacggcaaaaacctcagttacttttgtgccgacgtaataacaacactattcataacattaacagttgaattttcagagcatttgctgagtgctgtggataatgttggtgctttctaagcatttttcacagactcctcttagaaagcctccaaggaaagtgaagattaggaggatgaagtaacttgcccaaaatcccgctgccactctgacttgatccaggttggaacccaggcaatttgacaaggctaccccactgcccgcctgagttgaatagagagaaaagtggaagaaaattaggccgtactgcacaccagagagacagaaacgggtgagcgtttgttattgggcaaaataaaaatgtaccactctatagagtggtatcatattaactgttcctgagtagagaaagaatattatctctgtaccatgagaagtaagagttctgaattaaaggtatcacctctaagttttaatttttgcagaagctctcttcatctgaattcacaagtattgactgtttcttgggaaaaatcccagattgcgcatagaccagcatgcttgatctctgagacagatggacatgctgtaatcttaaagtgaaaaatctaaggaaaattttacaaggtaatttttgtctccttttctgaacagcaagtttgacacctagctatggcttcagggccttctcattccttgtaccttgtctgttttttttttttttttttttttaattttactttaagttctgggatacgtgttcagagagagtgtgcaagtttgttacacagataaacatgtgccatggtggtttgctgcacctgtcaacctgtcatctaggtgttaagccctgcatgcattaggtatttgtcctaatgctctcccgcccattgcccaccacccccgacaggccccagtgtgtgatattcccctccctgtgtccgtgtgttcttattgttcaattcccacttatgagtgagaacatgtggtgtttcgttttctgttcctgtgttagtttgctgagaatgatggtttccagcttcatccatgtccctccaaaggacaggaactcattcctttttatactttgccccttcttttaagaggtctttaaacaatctcttagcttcctatcagcctgtaagtcttcagaaccaaggagagcaagctctgcacatcaacaaggtctaataatttcttgagcatttgttatttgccaactacttcattaagtactttgcatctattgtctcatttcattgatccttacaacctactcagttcatagttaagagaaccctcacttgaagagatgaagaactctgtgtaccattgtcaccctgttgcaaagtgactgagtctagatgtgctcctacatctgactctaaaacccttacgcaaccaaacatggtggcccctgcctgtaatcccagcccttggggaggccaaggcaggaggatcacttgagctcaggagtgggagactagtctgggtaacatagtgagactctgtctctacaaaaaagtgaaaaattagttgggcttggtgactgaggcctgtattcccagctacttgggaggctgaggtgggaggatcgcttgaaccccggaggttgagcctacagtgagctgtgatggcactctgtacccaacctggattacagagcaagacctcatctcaaaaaacaaaaacaaacaaataaaaattaaataatatccttaagcctagccattctttcctactacagtgaatgggctaaatttttatttattctgtttttatcccagtccttctcaagcagattctgccattgaagtggaaacattaacaatcagaggcctgttttcttggtgttatggcactggttgaacttcacgtagtatacataggtattacccagcctcaaaaacaagcaaaaattaaaaattctctccagaactcaggtgagtgaaaaatgggaaaggatgcctaactttatagatattgcaccagttcatccctttgtccctacgtgccgttagtatagtgacggagtttcacgttggcacccagagatccttccagaaggaatatgcacatacccgcagctacttttgtttttctttctttctttgcagtactctaattagaaattgtatatctgggaagtcctctgtggtttgacagtgagtggcagagatatggccaaattacctgcaatggcacttttaatttattttctactcctggcttgcctcacgctaaaccgactttgtttctgaagctgttcttatttggagggaacaagaaaaggaaggttttccaagtacaggagtgcaatgcagaaagttcctttttcgtgttgatcttagtgagctgtggatggtgctggaatggatggagagaaagggctttgcctgtgtagcttgtttttaacattattccataaagagcactgacaattaattagactcacacaacatctaggccattggtactgaagtggtagatggtaatcactttgccccatttttcctattatctacttagcagctacaaaatataattctgcttgcaatttatattctttttcatgctttggctttgctattggtactgaaattaaccagtttgctcgatctcttttcctatgccgtcaggacagctctggggtagttcagaaatcaattttcaatcagttcacacctgtacctaaaccaaatcccaatgatgcttgctggtaagctgccgatatttgaaagagtcactgtgctaatgaggccctcacatataatatctgcataaatggaagatgtcattcacaaccagtgttgaggacagcagcctgcagaactgcaggtgggtgggctgcgaagttgggataaatgtttcattcatttaatgccatttttatcacctgtttgcctgaggaagacgccatagcaacaatattttatagctttaaatacggtgttgatgttttctggagtcaggaaaagttgggtatacttacagaaagtggagaggtccttggtttctttcatgccactttgtaaagatgaacaactattcaatcacggtgcagaatacccctgaccttgtgaaatcaggggagaatggaaattattttcccttctcagtcattggtattcagctaggtggtttatgctaggttgtcttagaggtattgtgactccgttcacattatatacgagtgcatggagaacacattgttcttctcattaaaggcttattaactgcagtttgtgaaatggagtgaaaacaaatacgcttccaaatggctggcatgtttcttatcctcttgcctgacacagaaaaccccagggtatcggggaaattcacaggaacaagggcttcaaagaaacattcacagttagccagtcttaaaccgagagaggcaaggaaatcgcaggaatgttgatttcttcgttgttgtttcttttcagatacttactgtaggagtcaagaaaaatgaaaattaaaaataatggctaaaagtatggaagaatctgctcagtggccctggataggggagaaaagggggtcccgttaatttgcaaatttggaattccagatactaaatatgttaagcttagtaggaagtagattctgcataagcctccatgacaaaggcatttgattagaaatatgaaaagaacctcagaaaggaaagtttaagactatatctggaagtatgaattctgagggcgtgtgaactgaataaaaggagccatatacattgtggtagcaatgagtgcagtcttcatgctgacaggagtatttctaagtttatgggagccaaacaccctgaaatcccacatctctacatatggcaaaaggttttcatccctaaaacacctcttgggtgttgccgagtgctgattccatgcacaaggagagacgtggctgtttctttgcctcacagattctgagatgcataatagcttctgctttttgttctggtgagaggtttgctttttaggatgtaaatgaccatcacgttggcttgaatctgttccctgcttttcctgcctatccatccttgtatatcctgcaacctccatggctaaggacaatagggtctgttggtaacctcagaggagattggattgtaggtagactctgtttctctcctgtcctctttgtgactgctctagttgcagtggagacatcggatcccatccagaagcatcttatttacattgatggcccattaacacaacatgtaacccaagaaggaacgcaacaataaatcatcagtcacataattaaataaattgaggcttcttgtgtaaaagtgggataacacacagtcggcggagcgttatttagttcaagccaagctaatattgttagagcaaacattaaggcaggtgacgaggctgcatcaaaatattaattatacaccattttggcactgataataaatgttcacgtatggccctctttccaggagaaatgctgaaatatgtttcaaagcaacgctttgaataattcaataaattattggagtctcagtgggagagctcgactgacatgaaagtcatggcgtccatttttaaccccccatccctggtttcttctcttctccaaagggctctgaatgccaagtctccatgtgtcttaaatgtatcattaaagacacattcccagacagtgagaaatgcagtgtcgataacttgggaagagttcagaaatcttgactcagatgtgtgagaacttttaaaatcacagatcttggcatgaggccaagtctgtgtcctacagcctggctaccttggctgagttgctcaaagtctctgagcatccctctcctccttcatacattggaagtactagtacctaccttgcaagattgttgcaaggaatggaaatgagatatgtgctacccttagaatattaagtttggggagttctggaagatagcagtcgtctccttaataagtgtggttgttactaactatttttacagatctgacttctccatagccttgcctggactccgagcagaaggttactgtgtgttcttttgtttacccactggactggagaatgatccaacattgctctaaaacaggatactgcacaggctcacctgggtagcagattcattcagcctagccagtaggtctttatacaaggaagactagacttggaagaacttgataatcctaaataatattatttatttctattccttctctatctccctgcactagaatgcaacatctgtaagaacaaggattacatttttcccatacatggcaatatttgctcagcaactatatagtggtagagttgacttgaaggatatatttaaaggaatcaatcaagagtgaattagttggggttttaggtgagtctgaaactcaaatgcctacagagatctacagattttgagttgggctgggtataaaatgataagggaacagcatagttcatggcaaaccaaagaaggcacacctcacccaagggtattcagagtcatttgatcattaccaacgacaggcacaaaaaactccatttgaatgcaaattcagcctccaagaatgaactttgtgaacttactgttttcaagttgaagtgggttaggggaacacagtgactaatgactatttaaaatggccaacgagtgccaccaaaaatagtcatggtgttgccagctctatcttgtctatttgttcggacttgaagtgatcttcgttgttttcccagtaggaaacaaacttgctaagaatcctgtattatcattggtgtttgccaatatgatatttattaaattagccaatggatgtgttttgaggacatgtcatgtgtcaaagatgatgctaggtgttagggctgcaataccaaatactagattattcacaggttcatgaggctcatctagcatcattctcacaactgctaacacagggcagtgcctgattcatagttagactttagtaaacatttgatgaatgactaaatgtgtaatcagaacaggaaagtgaaaatcttgcagatcgccagctcagagtatgtatgcatatatacataaaagcacacacacatataagcatacatatatgtgatacatatgaaatggcatattaagaccattctccatttatcgtcatctgattgtctagaattaagaacatttacctatatgtggaggaactccaaaattattatgctattgtttctaatctagaaagatctttaggaaatactggtagaacttcacatcttcagataagcttttcagtctagcttacccatgctttcctgtcctaaaattttctaagttttgatatcttgctaaagaaaaaatgaacagtgttaagcgttggtgcattttgcgtacttcaaccttttctgtctataaacaagcatctgtaaggcacctggaactctgctaacatggctcacatgttccactttgtgacttgatgtaactcttagctgcgtgcagcatccaggtgagatgtgaagctctcattcagtttacaaacagtaaaattactgtgtcttaataatgtatctctatgttgttgaaatttatggagaaaatgtttgtggtcaacaatgcttatcagaatggtgtgaacggtttttttatagcgatgtttatcaagttatgttgtgcatatgagtcatgtagagttgatgcttgggaaatcttgttaaaagaattgcttaggagatcttgttcaaatatagattcagatttggaagttctgggttagagcctgagattctgcttttctgctgaactgcaagtgatgggatgctaccaagtcatggaccacactttgggtagcaaggattttaaacaaataaggtccatgcatcatacatactattgtacatacatgattttgtgacaaaccacatacatgtcctatgctagatactgcgtcatttttgttatctccagtttacaggctgaaaacctgaaactcagtcaggtgagagctgttgtctgagttgcacttctgggaaactgcaaaattgagatttaaacccaagaactctgacttcgagcacatgttgttaatgtccctgtatgttgcttactgtctctgctggtacagctgaagcaaggtcttaggtctctaagcagatagcacctgaatacgcctgtatgcctctgtgcttggctgcattgtagagtgtgtttttagtaatacctgcttggggtactactgaattgaatagggttggaattctggatctaaggtctagtggaaccaacagcgaattctggacattagttctcaaggcaatgcttctcattgagatgctgtcacccccaggagggtatagaccaacttctttagctccagtggtgtgagaagagtaagcagggattgagtgtgtctccagaatctgaacagaatgagcttttatcatttttaccaactatgcccttgatttgtgttcaagatagagaataacttttggagggggttatttctggaataaaaagggaatttacttatctgtttagtgatggggatgatctttcctccaaatcacaccgtggaacagtctttgatcagtagaatttttctttgcagatgtcacagaggtattcgttccttgacatttttggaagtgtggatataggatggaaaggtttggaagggtggaggtaggatggaagggtggatataggtgttattctttgcaccatcaatctacctgtgactggtgatgcaaagtataatgcccttccctcccaaaagtgtaccctttgcagaatcagtaggaagtgaggaagtaactccttttaacttggatgttagcagtcatcatcctaatcattccctattttaatcacagaaataaaaggaagaaaatcattcttgagtcggctaatgctatgttacagaaccatagctattcattggtaatagctggaagactgttctcttatgcccttttaattgagtgtctttccgtcctctagctgtccaatatctgtttaatccacaaacaagactaattttgactcaaaacatagctggccctagtacaagaagatgcattgagcaataggaattataaaatgaaaaggtaaggatggttgcatcctggggggaaaatgccttcccaggcaatttgagcaaacaaaataatgcaaatgtcttctgaatgtagtaaggagttaaggccatcagtaaaagagagcaaattgaatgaataatacaaagaatcatccctcagtaagagaataatgatttcatgaagcagtgtagaaagaggagggagagtagagaaatctgaatgcctttgatagttgagaatgaaatggaaatgtaacagcttcacaaggtgaatatggagaaggggtaggagaagaggaaacaagatcattagagataacccgtggttttaagcaaaatgaggggaagacatttagaaatttgtaaaattgtgaccacagcattttttgacagtggaggaggaggggtatgtagcttggatcgttgtatttagaaactaccttttttatgaattttgctgcattacctgaaagtgagcattagttacttgtataataagcaccaaaatagattgttgtgagcatagcagtgatgtccgtgtgaataacatgtgcactaagaacgaaggtgaatatggagaaggggtaagaaaagaggaaacaagatcattagaggtaacctgtggttttaaggaaaatgaggggaagacatttagaaatttgtaaaattgtgaccatagcatttttggacagtggaggaggaggggtatgtagcttggatcgttgtatttagaaactaccttttttatgaattttgctgcattacctgaaagtgagcatcagtcacttgtataataagcagcaacgtagattgtcatgaggcatagcagtgatgtccgtgtgaataacatgtggagggttagataattgtatgtggaaaagaaagggacatggacaacatagcggtcatcctattgtgtctaaagtgaatttagcacacatgggcgaaaaaggaaattttacgtatcaggtgttcagtgaatattggaggtgtttgttgtggtggtggtagtttttactattctgtaaaatgcacagtttcaaataaaggatattgttatttccactttaaaatacataagaaactaagtaagttcttcttgataccagaaaggggtccaaatccagacccctagagagtgttcttggatctcaggcaagaaagaattcagggtgagtctataaagtgaaagcaagtttattaagagagtagaggaataaaagaatggctactccatagagagagcatccccaagggctgctggttgcctatttttgtggttatttcttgatgatatgccaaacaaggggtgtattattcaggcctcccctttttagaccatatagggtaacttgctgatgttgccatggcatctgtaaactgtcatggcactgctgggagtacagcagtggtcactctgattgccatcttggttttggtgggttttggccaccttctccactgcaacctgttttatcagcaaggtcttcttgacctgtattttgtgccaacctcttatctcagcctgtgaattagaattccttaaccatctgggaatgcagcccagtaggtctcagcctcattttactccgctgctattcaagatggagttgctctgattcaaacacctctgacattcttgctgagagccgtgagttctcttgctggggttagatgatatgagatggtggaggccgcagggacggaattgtttcttttctagatctcttccttagtttactttctttcttccctttgtaaaaggaaaataaatcttgggacctcaaactcactaagccaaagggaaaagtcaagctgggaactggttcatgcaaacctgcctcctgtttttcttcctcggtgtaatggctacaaagatggaaagctacatacctccctcacctcttgcccgcctgaggcaaatgcatatccaatggcatcctttgccgtattgtctacattatcttatgtaaacatgcagattagctgagacagacaaaggcataaataattattttctcttatcctccaacatgaaaattgtatacttctcttgatcttgccctttcccctttaaatattgaaaccttgaaaatcatcttcttagaaaggtattagacctgtctcccaggcacatgttcttaactttggcaagtaaatctaagatgattgagacttgccttggtcattttccttgattaacatgtctttataatctttcaaaagttatagactctgtgttggaatgaatgtgtgtgtgtgtgtgtgtgtgtacatacttgtgtgtgtgtagtttgggtctgtgttgtacaggagtaaaaaaaatggctttatgtccactgtcagtgaatactgctgtgcctttgcactttgactttaaacaagagaaggtgtaattgataaagaaactagaagccaggcatggtggcatgcagctgaagtcctagctacttgggaggatgagttgggaggaccacttgagcccaagaggtcaaggctgcagtaagccatgatcacaccactgcactctagcctgggtaagaaagtgagatgccatctctaaaaataaaatagaaaaagaagctgaatttttccaataaagtcccacatccaactgtctggtggaactaccaccaatggcttctcattggtggaaacagttccacagattttttttttttttttaagaaaaacctaattgcatgtgaatttttctcagacaaaagtagttctaagagtttaccaagaaattaaagttcttcaataattcagtgtcaaatacatacgtttgaatactgaaagcagcctcttaatatccatcttcttattggctttttgtcttgctttgccttgtagatttttagataacgtctaaaggaaaacaacaaaatggttgagggggaacctcatggagtcaatttgtttttcactgtggaaaatttctgtagtcagactgatttttgctccttctaggcgaattgttatatttgcacacattgtcaaaaagtcattgaactatctattgctggtgactgcacacatccctgttaccagctctgtagtcctctgggtttgggtgtaaaaagagttgcctgaaataaatagttaactgaaactcagcctgggagctacatttctgagcacttccgttttctacttcttacaaaatacagttcaaaaaattctagactgacattcaaagtactttttcatctggctccagcctgtttcaaccttaagtacacacagtgatataccgtaggctaggacattgttgtccccagggtacttacaatttccttcctgtcttcatatctttcccccacctggaggaatgtctaccccctttagctccaagtcttatctactcctcatagccacactcagatagtagtgattaatattcatatatattcactatgtgctttacatatgcagaatctttcattttcatagtaccctattaagtgggtaatattgtcattttatagatgggggaaatgagaaccagagaggttaagtaatgtgtaccaaatcacagagctaagaaatattggatcaggggtataaacctagacactctggcttcaaagtctgcctccttaagtattataccagacagcctctcaatacttacatctgccatgcaactgttcttcatcttctccagcaaaatttaagctcgctttttccctcaaatattcctatcgctctgcccgggctcatcattttctgttttgaatatttgttattcattatgatgagatgaatgcatagcctgtctgccaggtccttggataagctcttgggatgcaaagtcaaaccattttctcccttcagggaactgataatctaggtttggagaggggcaagcaataaacatctgtgaggtagatgattatgtgataccttatgccgtatcttagtgtcttttaatagaggtgtgaatacaagatcatagaaacatagggaagaggggctagttcagccctcgtcgcctggtatgggcaggaagactctactgagaaaaggtacttgatctgaactttgaagcatgaatgtaattttcctaaccagagggtccaggaataggattccagtccaaggaagtgggatgaataaaacctcaaatacactctcttcatatgccaatgttcctggatgggtttacaccatctcagaattccagggtgagcgggggggtggtggaaatagacgaattgcaggaatttttactgtaagagtaaaggaaaaacatttcagtgaataaaataaagatgtaatgtttgccttatcctctaaatatttaaaccagagatcaaaaagtcaaatttcaactaggtgtggtggtatgaacctggagtcccagctactcaggaggctgagacaggaggattgcttgagcctaggagttccaggctgcagtgagctatgctggtgccactgcactccagcctgagcgacagagtgagaccctgtctctaaagaaaacaaaaatagattttctgcatggggccaaacaggaaaagggaaatgtctaaaggcaatagagatgggtggggcctggggagagcacagactcttcctgaaggaagcatcagcttgtaagcttattagacttggagacacaaaaatatggtcccagtatggttagatgagttggatttgtagatatttaatgttgattgttaagccctggtaactttgcgtaaattgttttaagcagtgagtggttcacatattttatatagatgggccacttagataatctcacttgcagtttgtggtctgtgatttagaccaaacaggcttagctcagagtttctgtgaaacaggtaacactaagtatgaaggtgcctgcttgtagaccaagtctaatccgtcagcaattcctgagtgcctacttgatgctgagccctctgtgagatcctatagagtctactaaagtaactggatgatgaagagggctcttaggttaatgcaagtttagaaaattgtgttttggcaattggcacataaataccaggttgtccttttgatatcactctgttaaaatgtataattctggaaatgttcctcttgttttgagtctctgatggagaaaataatgagtagcaacagaatgcatgtaaataggaggaatgtgctgtggtgctgcacatttacaccgttccctatcatttaaggagaccagctgataaaaaaagatacatgtttatttcgtttgttccttccctaaccccaatttgctgtgttattcttccggattttcaggaggaatcggcataggatagtaatcagcattgttttcaccgtgaccatgctttttccactatactctctttctcccactctctctcctccaagtccatttctggcaaagagctcttaagcagtgagtttttttttttttttttttttttttttgagacggggtatctctctgtcggagtctctctccatcgccaggctggagtgcagtggtgcgatctcagcttactgcaaactctgcctcctaggttcaagtgattgtcgtgcctcagcctcccaagtagctgggattacaggcatgcaccaccacacccagcaaattgttttgtatttttagtagaggcgaggtttcatcatgttggccaggatggtctcgatcccttgaccttgtgatctgtccaccttggcctcccaaagtgctgggattacaggcataagccaccgtgcctggccccttaagtgtgtctttatagtagaggtttgtatgctcagccttccagcctgtggagctgtgtgctattaccaagttttactctctgagtacatagcctgtagttgggtttgaatattaagtgtcaaattccaatacaccaatgagagatttgaagcaaccagcaggtagcttctacatccctaaaagctgcagagcgctgtctgtgtttatgagcggtctcatttcacacatgtccaatgactggaatgaagctggtgatccagtgtgtgatgctgaaggtaccattacctgcagctgtcctctttcctgaaatgaggaggggacaggggcaatggctcaggaggaaaacgtgcagagcccgctgttcacaaatgtgaaggttactccagagagcgccgggagcgatttgtcagctttgtttgcaaagagatagggagtgaaggattgtgatccttggcaccgataatgtcccctgggccacaaactaatccagcaggacacctgatgtaacacagctattttattcacatatgtctgtatggttatcatagagggcaggaatggaataacaaggcttaggagataatcatcaaacaacgtctccctcttctgtaaaggaagctgagcccaggatcttcatcctttcagccgtacaagcagttgttcttctcacagacatttatcgagcattttgctacatgccttgggcacggttggaaggtccctcacttcgcagagagacctcatccatggatttagtcactcacacgctcatccattccccagacactgcttatgaccttggtgccaagttcagtgctagattttcaaagaagaaaggggataaacatttggctccggaagcagaatcctggctttattactaaaaagctgggtgatcttttctctagcagcctcactatacttatctggaaaatgggtataaaggcagtttcacctcataggtggctgttacgattaagcggggaggggatgtacttttttttttttttcgaggtggagtctcgctctgtcgcccaggccggagtgcaatggcgggatctcggctcactgcaagctccgcctcccgggttcaggccattctcctgcctcagcctcccgtgtagctgggactacaggcgtccaccaccacacctggctaatcttttatatttttagtagagacgcggtttcaccgtgttagctgggatggtctcgatctcctgaccttgtgatccacctgcctcggcctcccaaagtgctgggattacagacgtgagccaccgtacccagcctgtgtattttaagaatacttagcatatggcatggcactgttagtgatcagatccacatgagtttacttgccagaggaagtccatgcatgtgttaccacaccgaggtaccggtacagaccccaagagagggttcttggatcttgtgcaagaaagaattcaggatgagtctgcagagtaaagtgaaagcctgtttattaggaaattaaaggaataaagaatggttactcgatggagaaagtagccccaagggctactggttgcccatttttatggttacttcttgatgatatgttaaacaaggggtgggttattcatgcctcccctttttagaccacagagggtaacttcctaatgttgccatggcatttataaactgtcatggtgctggtgggagtgtagcggtgaggaccaccagaagtcagtgttgtcgccatcttcgttttggtaggttttggccggctttcttactacaacctattttatcagcaagatctttatgacctgtatcttgtgccaacctcctatctcatcctctgacttagaatgccttaactgtctgggaatgcagcccagtaggtctcagcctcattttacccagcccatattcaagatggagttgctctggttcacacgcctctgacacatggatcacaatttggagagcacggataggctctcatggatctgctgtttcactgtggcttaaatcccagcctctacttactggtggccttagcattactgtgaccttgggcattttataaaatgcctgtgaatgcctctgaaccgagtttcctgatctgtaaaatgagaatagtggtgatttgtacagtagtcagggaaatactgggtagaagagggcagttccttggcaaaggcttcaccctcaagcctggatacttgtggccttaaatagcaacagacattcctgttgctttttggcccaccacacccccctatcctatacccatataaaccccaaacacccagttccagaaggagatgaagagacaaacagaagggcagaagaatggcagaatggcatggcagaaagaagagagggagcatctgaacgctgagaggagttcagctggggacagtcagagaggagattggccactgggtggcgaaacgccagaggaagatcatcttcccactccatcccctttccagctccccatctatccagatgagagccacctccaccgctcaataaaacacctgcattcactatccttcaattctgtgtgtgacccagttctttcggggtgctggagaagagctcaggatgcagaaagctgttgcactggtcctctgcatttgcaaataggcagagggtctgctgtgcttgttaacacttaagccatccgtggatggcaaggctaaaagagcacactgtaacacacgcccagttgggctcctgcagctgtctgtcatcatgctccacctcctgtaaggggtttgagcagtggcagcaattgaagagatgagccacacccctgtctcatgtcctgcgagggggtcagggaactctcttgtttcaatggtagtgtctgtgaatgcagttctactgcacagggtgctccatagacaccctggcttgtttttgctttccatcacactgatgtgttagtcatacctcacacagtcactcacagctccccaagtatatcccattgttatgcacttcatgtacacaatgcatccctaagacataaaaaacaatcatcaatttatttgacaaagtgtgctttgtttataagttttcacaataatcagagagtgactgctggtaagccttgatttcttttcaaattcagttgaacgcagctgtaaagtgcctgaactttgcctttagctaagcagatcctaatgggttcagttagcattgtatatgcatgtgattgaccaaaaccttccttctgggttggcaacagcgctcattaaaaagtgaaaatacccttagtgttaatttaccaagcagtgttcgagaatgacaagccatctcaagagactgttttccaaaggttagcttttgaaattaaacaaattatggtgagtttacatatttgttggatgcaagtgcaatctgatatttaaatggatcatgccaccctttggatgttcatggaaaatttggaattatagcctattttggttttttgatgatctgacattcctcatgtggtgcttgagaggttaagaacccagaggggagccttggtaggcactggtattcattggtgacagtggatggaaaagaatatcaggatcttgacccctttcctcgtgctatttctgcccttgtctctgatacttcatctctgttcccaggtaaaaggcatctgccaattgcaacccacagtcttgtttgcaaggaaagtaaccccaagcaatgcagcagctggtggtaacattagaatgaaaggggcaggctgaatactagcaccatgggaaagaaaatgcaagtgtccgatgcaggggccttagccccacaaactcatctgaaacagtggacccttttcctatttttgctcttccgtctcttcctcagaggatgataaataatgtgataaccatgttatttactgacatcattgttaaatggctaaagttgagcaggcagatctaattcttttaaattcatcaattcatgtaattctaaaaatagcgttttgagatgagtggcagtatcatgacttccatattacgggtgtaaagattgaagctcagagaggtcgagtaacttgcccaaggtcacagcgccagcacatggtgaagcgcacgtaagccaccagccagagtgatttcagagacctcattttactctaccttcccaagaccccagcgtcatcgtcactctcacatccaggtcactctctaccatttggccagtttttctcctaaaatatggtcagaacaagtcattccccttctcagagatccctaatggatccttaatgactacctgccaaagcctaaactcagttatttgcagtggccaaaagcgtggactctggcgtctgctgggtctcagttaaaggcgtggctgtccttatcactaagggatctttgggaaacaagtctgtcggggttcagtttcctcaatggtaaaaaaatggcattaaaaacaccaacctcagatggcttcactagaagcccacaccctcgttttaacacaatatacctctgtaacaaacctgcttgtgtgcccccagaacctacagttaaaataaatctaacaaaagcacctacctaactcacatgtacaatgggataccattcagcttcaaaagacaaggacattctgtcatttgtgacaacatggttgaacctggaggtcattatgttaagtaaaataagccaggcacaggggaacaaatactgcattatctcacttatatgaggaatctaaaaaagtcaaactcatagaaacagagagtagaatggtgtttaccagaggctggtgagaggggaggaaatggggagatgatcaaaggatacaacatttcaattagacagaagaaataaattcaagagacctatggtacaactatagttagtaacaatgtatatacttgaatatcactaaaagagtacgttttaagtgttctcaccacaaaaaagataagtatacacatgttaattagcttgatttagccattccacagtgtatacatatttcaaaacatcatgttgtacaccataaatatacacaatttttgtcaacttaaagaataaaaagaaatccctccgccaacccaactacctacctcacaaagttattagcgagacttgcacctgtggtacatataaagtatttagcggagtactcattaaattcgtactgttgttaggttggactcatgaagcctccttcatctagtttcatctttccaatttccctcaatatctttcccacattctggctccggaaaactattcctgattccctcatatggcatggggcttcgtgcatctagcttgtagccctactctttcattaagtgacagtgttttcaatccatgcattatcacagttgccacttttaccaagtccatttactccaccaccacctcccaagtcaggatacattgctcttcagtttttctgctgggaatcttgttttgctgtgccttctattagctattattaatgtgagcttgtttagaaaatggaatgccccatttatctctgaatccctaactgtacctggcatcatgctttgatggttttcacaaagtgggaactcagaaagtgccaaatggattaatgagtggatgtgcacattaaaatgaacacaagtaacttacattatgttcctttgaaaaacatttatttcctatgagttgtcattgaaaaaaaaatccttgaggatcagaaacagaacctggaaactttggaatgtagatttttttctttgcttctttaaattgtagacttatttaaatctctacatatttcaaatctaaaagaaattatgcacaaccagactctaaatccatgtggaataattcagtatttcatatacatgagttctgtatttttgatgggtgtcacatgccaaagaatgtagactatggctagaaattaagtgggcttttgtttgtttgtttgtttgtttttccaattgcctagataggattttgccttattaggattaaagactgctttcttattaagcgatgcaggtctcattgaaataagtacctttatgaaaatgatgcttttctgatttttgtgaaagattgaagcattttagggtaacttggaacattatgagatctagtttccggagatgtgagtaaaattaactccatgttgtgaagattttcaaatgaaaaaaatattacagaaaacgtttagggaaggctacccgtgtctgaggaggtgtgtgggaaatctctataattttctctttattttgctgtgaacccaaaactactcttaaaaaaaggaaaattttataaaaacagtttaggggagtgcctagaacttagcaaatgctctgtaacttaatgctcaataaatgctagaatatgcttctactagatctggacccaaaacatgaggctttacctattaaaagttaagaatatttatcagaattatatgcaagcatttcgtgaagcatcagatatgcagtatttcatttaatccttacggggatccggtagcacaggtagtccagccacttggcagaagaacatcctgaggttccaaggggtctgtaaatgccccaatatcaaactcagggaaaaatcagaaaccgagctttgtttactgcaggttttcagttcttaccactatatgttactgtccgtcatgacaagaccggagatgcaaatatttttatctcaaaacttcctacatgtcctgtggcttcatccacaatgtttatttcttacctgaaatcatgctatgaagaaagtattgcccaaaacacatttggatgaggtggcatattagatacataacttttgatggttacctgaggtggcccctgaacatttcgcaaacctttcatgatctcactccagttttatgactttcctttctcccacacggagatgctgagtgctgtattcatctttctgcctcgctatttttccttcatttccttcattgtctgcttttctggagcattgtaccaaatggcttggttgttctttgctgaacatgaaggactgactatcaggaattttcttttgtcttctggaattcactggctttttaaaaagtcagatatccccttcgactagatggattttatgttttgtttaatttttttcttcttgtgggtaggaatgtgtcatactgagaggcacgtagtatatctatcttggtattgacagcgttgaaccatatgtacacttttgaggtatctttgctcttaagcttgttgattttcctcttctgaggatgcatacgaaccaggtcatctgttgcaattaaaaagaaagaacatttttaaaacaagaaggtctaatctctttcttgtgcaaacaggagactgaggcccagagagagttaaataacctaatcaagaccaaatggctggtaattagcagacatgagactaaacttatgccccttttagtgattcatttagaaaaatatatttttaagacatttttcagaatactaagggagggtttttaggtataaagaatgtagtgaatgcatctttgaaaagtagcataaatgacttgaaaaaatgatattatcagtgaaggcacttcacatattttatgtgggggtgtctctcatacttggggcagaccccactgccattgattctgttgggatatgatgcttgaggttcttattcttaaagataactgcaccaagtttgccttgatcgttttactatttccttgagattactttcttgagatgatgagaccagcttgaattttcattgtagttgtgagacctttctcaggttgaaatgaattctgataagctgattatctctctgaagaaaatatgatgtccacatttcatagcttagttccgatcacttcagtgccattttcgttctgagacatcttcccgggtctgaattaaataagataataaggtgctctggagtccagtacgtattaaatagatttttttttttttaaaaaatcgaggcctacagagtggaggatggctttctttatggtgtattttctttctccatgttgaagtaggtagcagctagctagtttctttttctttatagagcaatgagttatgaagctcaaaaataaagtgttctcagtggtgtaaataaagcagtagtctgagtaaatatatcacactatgtactgagggtttgctttttgcgttattttgtctctttcttttccttctccgctctggtccagtttatgccattgtgtattgttgacacattaatcttggtaatagaaatggaaagctacttttcattgagaaatagattcaaaggaaaagatgattaatgggctgggcacagtggctcatgcctgtaatcccagcactttgggaggccgaggagggtggatcatgaggtcacgagtttgagaccggtctggctaacatggtgaaaccctgtcttttttttttttttttttttttttgagatggagtctcactgtgtcaccaatgctggagtgcaatggcgctatctcagctcactgcaacctccccctcctgggttcaagtgattctcttgcctcagcctcctgagtggctgggattacaggcacgcactaccatgcctggctaatttttgtatttttagtagaatcggggtttcaccatgttgatcaggctcgtcttgaactcctgacctcatgatctgcctgcctgggcctcccaaagtgctgggattacaggtgtgagccactgcgcccagcccaaaccccatcttcactaaaatacaaaaattacccaggcgtggtggcaggtgcctgtagtcccggctattcaggaggctgaggaaggaggatcacttgaacccaagaggcggagattgcagtgagccgagatcatgccattgcacttcagcctgggaaatacagtgagagtccatctcaaaaaaaagaaagataattaatgaacagaagttccatgcattcccaatgatgtgtttttttatcctggctctataaatctgtctgcattgcagcctcttgtgagctcccagattactgtatccctcctccgtctcacctccatggaactggtggatttagctccaaagctacctggtattgctaacggaggaggaggacacttagaatcttgaggactatcttccctacagagccgtatgcctgaggaggggagacgaatggctgggaatgatctactcagaggggagacgttacttagaattgctgtgttggtgaccagcatggtggtgcttgcctgtaatcccagcactttgggaggtggcagcaagcggatcacttgatgccaggagttcaagaccagcctggccaacatggtgaaaccctgtctctctaccaaaaatacaaaaactagccaggtgcggtggtgcacgcctgtggtgccagctactcaggaggctgaggccggagaagggaggtggaaattgcagtgagcccacatcatgccactgactatactccagactgggtgacacagtgagaccctgtctcaaaaaaaaaaaaaaaaaaaaggaattcctatatctgagagacgttgctttgtaaacctgttgcacaatttctctctccaatgacaacaatcaacagaactagtgagatgatggataataaccaaagtgaatctgttgggaaggggtgatgcatggtagaggagcttcctgtgtgtgtgtgagagctaatcacagccccatggcacgtctgagctcctttcttgtaaaagcacatcaatcagtgtctttctcgggttatcccaaatccttccacgggtagtcataagcatgtgatgtctacttgggatggaagcattctcattgagagcaaatatagcacaactgccattcagaccacagttcaagttgtggcttctcagtgagaacacgtaccaatactaaccctctctgaacatcatgcttaatctgtgaattggagataatgatgcccagggcatagggatgtcagtgcaatgctgcatgcaaattgtttatcagagtgcatgacacagagttaacatgagatgctcctcctcctccttctttttcctgttaatttttattattttcttgctattggcattgtctttatttacacatactcacatgcatatgtctttatcagtcccagatagatatttactgagttcatttaaatcgcaataatttccatcacttttacctgtgtctcaaggccctcttcagcttgggaggacttcaatatgactcaagtaggtacagctttttaaacacatactgtagtcatactcttagctttttttttttcctgtattacctcatttgatcatggggagaatactgtaaaagagtactttttatttccacctcgtgcattggataattgtggccagagatggacagtaactcacccaaggtcaagcaactagcaaatgctggagctgccagttgcaccaagtgggtatgacttccaagttcaaagctctttcttcacgtatgcacttgcctctgaatatcatggtctgtcctctaactgaccccttaggagctggacatgaggtaggtaggaagttgagcttcaagaaggagctgtcagtgcagggtggtccatgaaagcccctgggtctcagatggcagagaaacatgtggtttctttctagaattattcactccttcactgagcccatatttaaagcgcgttggttttgctctaggcactctgttgagtgcagagtatttggtggggtgcaaaaccctccatgtctgagtcctcaggcagcattcagcctggtgggagagacaggtactaatcaaatgcttatgttttcctgtatagttatagctgagataaatgcaatgacaagggaacctgtcctagatttgctgcagaaaccaatcaaaggaggctttgctagggaggcagtatttgagctgagagttgaatcatggatggaaaccacacaggggatctcctttcccttcaagccctgctgctggagccgggcaagttgcaggggaccctgagggctctcagttatcgctcatgcatcgaaaggaatggaactttctgcattagatttctgcagagattagcacttcttttacgtcagaggcatttttatgtaagaagtctactgatttcttcatggatgaaatcctttggccttcttaatagcacgtgtgtgccaggccagctccagaagctgatagattcaggtgaactcagttcatgtgaactcaggagcatttgctgagaagcctgattcctcttggtcagaagaactcactggccgtttctacttagatgggaaggagcattttcatctcccaaacaattttgtgcaatgcctgtaatcagccagcagttgccgtccatttctgcctgtcttttatcattgaacctaaaagaatctgtctgcaggaattaaaagttgtcgttttctctgatatactatgccttgcactcagtacctctaaggaaatgtcacagaccccccaaaactcccccatttaagtggtggaaacatggaattctctagtttcatgatgggattggtaaaggaagatatagctactttgtgaacttggtgcttataccttctctccttttgctagacatgaacctgaaggcaccacccaaaaagtcaaactagacaacatctctatttttaaaaaaggagaggcagactaaacattacatcagcgtaaggacttcagagtcacacagaactggatttgcattctggctttgctgttgactagtggtaaaacctgcagcaagttctttcagattcgtaaacgcccccctaggtcatcctcaaaagagaaataatggtggttgtgcttagagagacttctgcaagtaaagtgcctagtacatggtaaatacttggtgttggatagtaatcattattgccgggcaggaggctgaggcaggagaatggtgtgaacccgggaggcggagcttgcagtgagccaagatcgcgcactgcactctagcctgggtgacagagagagactcatcttaaaaataaaaaaaacatcatcattatagctattaatattgtccaatactaaatggataagaaataaattatttcttatttatactaaattatttctttctaagtctaattgatctaaatacatatgtaaataatagtcattatataatatcatttaatatattaagtcattatataatatcatttaataatatataatagagaaaatgatataacaatctgatacataatgagttttaattatatatttttataaatgatatttatgatttatatctttagattattaatatttatgtatttttataaatgataatcatttatgttatttatatatttctctattttgataattatttccatattttatacatgatgattgtttatattatttatatgtttatttagattgttatttacatatttgtatcagtgataattatgttatttatatgtttatttggattattacttttatatttctataaatgataatttatattatttatatatttatttggattatttacatatttttataaattataatcatatattcatttaggttgttatttacatattataaactgtaatcatttatatattcgcttaggttgttatttacatatttttataaatgatatttatgttatttatataagtttctttggattgttatttacatattttataatcatttattcatttatttatttaggttattatttacatacttttataaatgataatttctattatttactgagttatttggaatgtcatttacatacttttataaattataataatttacattgtgtatttatctatttggatggttattatttgcacatcctataaatgatcatcatctgttatttccatatttatttatttggattgtgattattatttgcttattccttatgtagatccttgtggccctgtgtgtgaatccatgttcttgagcttgcaagccatgtgttggatcatctgttttgcttcgcctttgtggcatgaaagcaatcttagataacacttacataaatgaatgcacatgactgcatctgagagaaacttttttacataaaaatactggctgtgtgttgacttgactggtggaccctagtttgctgagtgacagggttgcctgcacttgaacatcctgctcgtgtggctctgagtagttcttacctggatgacttagtcaccaaaatgtatgttgtaagtaaaagaagccccttggagctaggctgagccagagaggcagttttttggggaaatgcattggtgtcacgtttggtatgcattggatgcagaaattgcatccctgatttatgcgaaaagcaggctattcgaccaggtatcaggagttgtggaataagagatgcaaatgctgtctggaacagcaggtgccattcttagaaaaatagatatgggggatgtagaggaacaccaaaagtatttcccaactatcactcctaaaacaactttgctcagtagctgtctccccctgccactttttaaactctacagcacattttaagtgccttgtccgagcctggccagagggacgtctctctgcttctacaagaataccttgatgatatttcccagctgaaaagacttacctctctcctctcaccctatacccaggaagttttaattttatggagattgaaataatcaggtctcatgtgtatatttcctttcaaaccactgcgttcgcctgttttgaattcaatggcctgtcttatgtactcggtggagaaataatataaacaaaccttgaaatttccctggagttcagcttcccttttcatactgggtctagctaaagtttggagccaactaaaaagagcctcattgccttacacacaccctgttatctctggcgggttcaaatgcaatttctctgagaaggctgtggtacctctgctctctctggccttgaatctgagcgtctaaggatttctttggagtacacacagttgcatccttctgacagacagtgcaaattaaaagatccggcgcggcccaggaaccagggacccaaacttgccccttgggttttcatttacagttaggcactgcagacacaattattgctgacagggaagcggagctggtggcagagtgcgcctgacaggaggctcatgccagcccataattgggaggattatttttaatcagaacataccctacagcccaaacattagaaatctcctgtaaggccaagacaggaaattaaacacaccaacaataaggctcaaagggaggcggtgtgtggggtgtaatattgttagtctctcggaggtccctagagcttcggggagaagtttgcttccctacagagggaggctgggaggaacagaagcagacacagagactatacctgagcccttgttgaatgggcaaatgcagccaaattaaatgcagcagaaacactaattgcatttaagtgcaatgtgtaatgcgtttgtttcttgcaaatgcaatgacgcttattgactttagtagtagtagtagcattttgagacagagtctcgctgtgtcgcccaggctggagtgcagtggcacgatctcagctcactgcaacctctgttcaagtgattctcctgcctcagcctcccgaggagctgggaatataggtgcctgccaccacgcccagctaatttttgtatttttagtagggatggggtttcaccatattggtcaggctggtctcgaacttctgacctcgtgatccgcccacctcggcctacgaaagtgctgggattacaggcgtgagccaccacacccagccgcttattgcctttaagcagcataagccacatgtaaaccttggaatagcggatacaattgtatttcatcagtaagagaagagcctcactggttccttatttttaggaatcttcagtgagcacttactacgtggcaggtgctgtgatggcttatgatactaggctatgctgaaagtcatctggatgatcttattgccttggcaaaattttgcacagcacagtaaaactttgtttattaaaaggattgttgttgaagaagtaggcgtagcgcttggctgtttggctccagtaatatttatttagtagtagtgccaggtaatttagctgtagtgtcctcacatcaaccctctgaggtgggcattattatacccattctatggacaaaaaaactgaagctccaagcggtcaagcagcttgcccagaactaataagataactgactttgaaaccaaatctgtgtccaaaacctgtaggatgtcaaactatttgtcaaactgtactgtcactcatgaatatgactgggcacagcctggtgcttcgaggtgctgccactccaatagaaaagacagatgtagagacagatgtctacaaatgaagagtctatagagatgctaactggattctaagagtggggaacatggcatgattcactgtgcttggggagtcagccaggactccctgaagctatgaagaacaggtgcaaatttaccagtggtttaaaaaaaaaaaaaaaaaaagaacagaatcccagacataggaaacaagtagtgcacaggcacagtgttatcagagatgctaggacatttcaatttagtttagaactattggcttgcctggatgtggtggctcacacttttaatcccagcactttgggaggccaaggcgggcaaatcacaaggtcaggagttcaagaccagcctggccgacatggtgaaaccctgtctctactaaaaatacaaaaaattagctggacgttgtggtgggcacctgtaatcccagctactcaggtggctgaggcagaagaatctcttgaacacaggaggcagaggttgcagtgagctgagatcgtgccaccgtactccagcctgggtgacagtacgagactctgtctcaaaaaaaaaaaaaaaaaaaaagaataaaagaactattggcttttgggttttgttcttgttaggctcactcaacaaatataaagggagaaaatgaatctctctttggggaacgctcatcacagagaccaagcatctgatgtggggatgggatgggaagcaaaaggagatgatgttggagaatccgctcctgaagtcaaaggatattccatgctgtcctcactgtgtgaaatgcctacgcctgatggcagggaaaggtggtgctttaacccatgactgtccttagaaaagcaaccacaggtttacagtaacattacgtattgcttctgaggctggagttcagggtgcagagatcttcagtgagtccaggaaggcatgaatctttcgcatggcagactgaggcccatcagatactctgactgcagtagtggttactgctaagcagcttcctgttatgtggctgggagtcactggattcccatggggagggcttctatctccaatctaaggtggcttcagtgcacttcctgtctagttcacttctcccatcccaggtgtgatgggcactaacctctctaccaccaggaatcgcacatcataatccctgagtggtatcaagcaaccctgggcagcttgctgatttggcttcagggtcctttcaaggacagttaaacgccagacacctgaatgaggtcaggggctgctgtgaggcttggagagcatgtatgcaatcataatccctgatgtgatcaagatacagtttgcttccctgcctgcagggtgggtacaaaatcccaacttaggtgaggcaccaccctctgagatggtcttatacataattgcattgtttgctagcaacagaaatccattcaaactcactcaataaatgggcatgtttcttacacagcacaggagcacagaagtgagtttcagcactaaaagtcaggaggtgttctaggtcccaggaagaaccagcatttctgaaccgctgtgtaatcaggaaacaaggcagcccttaccctcccgccccaaaaccctcctccatggctcttccactctcttcttcttctctctctcattgctacttctgctgttttctgcacacgtggcagagaagagtgaccccacagttactgacgacacttaagtgtgccttgcaaattcctaggagaaaattgaacctagatagggtgaggtttcgtctgttctgaacatagcacttactaatggagccaggatcaggcgctgcagacccaatttctggcactatgctagacagagatggggaagggaaatgacttttggggaggctgagtgtgtctaaaattagccataggatgactaagccgatagttccttctttccttccttccttccttccttccttccttccttccttccttccttccttccttccttcctccattccttccttccttccttacttctttccttccccctccctccgtccctccctgtttccctaccttccatcttttcttccttgggtaaatatttactgaatgtctgccatatccatagcattgtgatcagagttaaaatagtgagcaaaacccacacagctcctgccctcatggagctaactaacatgctggtgagacaggcaaactttcatcaaataatttttctaataatttttaattggatgcaaaatgcaaactgggatatgggctatgaagaaagggtgatgggctcttaaagccatgtggtcagggggttccaacaggaagcagcaatgcactggagttaattaggtgctaaaagcatccccagtcaaagccatagcatgccaggcatccctgtggcaggtgaggagtaaagtgtggtccagaatgggaaagtccatggtgctggtacccgggactggggggaagtgtgatctccttactaacaaataaataaggctggagctgtgtctaggagcaaatcattagggatgtcaggagtaaggtaggtttggaatgaaatgggaagccagcaatgtaggatttaaacaatcaagtaacacagtcacatttacattttgtaagggtcacactccttgacctgcatgggggcaaggggtgcaagcctggaggcaggaggagatggcattgcattcattgcctggggaagtctatgaagcagttcatggcagaatctatggaaacagaaacgttgcagtagccagccctgtttagagagtcagagttagaaaaaaactacattctggctgtccaagggtcatcaacaccagtgttttggaagtaatcggtttgctattttgtgcatccatttggatggagtgcataggtgaaggtagctaatgcatgaactgagcattcaccttcattctgcctgactttgttccaatgtcctccgagtttccttcacttgcagctctttagcttctgtgtaatcttggtacaatgaaaattgtgcccaattccactgggacctgagattctccctggtcacaaattgctcttcacgtagtttgcaagagtaattgcaaactcagaacattttagttaaaaaaaaaataacactaaatcactcttctggaactctagagagcatattagggttttcttgctgtctggtaccattgttaatgatcatttctgttctcgctttataacaatggttctcagcctctgtttttataaaataatccccctaaatgactttacaggttcttattagtggaaaggaggggctataaaattcatttcaactgtaggttggattaagaccagatgtaaaggtgtgggtttggactcagatggacatgaaattcaatgttattacctgggtaccaagtacggtagcaccaaagaaggcccagttgctcagagaaacctctttctggaatgaaggtcaatgtcctttcttggtgctgtaaccctctggggcaaggaagaatcacttgttaggctacccaatgtagtgagcagtacataaggggccgtttcccagactacatagttacagtgttgaattaaacattgcccttgccttccagaaattcacagcctgggtaggccaagtccacaaaaagttagaaaggatgtatattctgcttctgatagaagaatatgccaatggccatagggacctcccctaaaattcaggcccactggaagggtcaatgaaagttacagagagcacgcttgggtagatgttcaagtctcaagactccagaccttccatgagttcaaatggggccaggtgaagggcagtttaggatgagagaaggttgtaatcgaagggctaaaggaatactagtgcactgtgtcttaagtatttgatttagctggatcttagaatgtaaggatatgttcggagatggaggaagtgacaggaaagagggggtaggagctgaaaaggttgaacctgaccatggtagctattatttttaataaatgagaggatgcatgcaaattttgatatgaagtttgggctgtactagggattcagtgaaactacaactactataattattaggactcagataatcctgcattggaggcatactgtgaatctctagaagagaaccatgtattttgactatttctattctaattattctaactattcttcccaaatcatgttcttccacttctcacctttacgatgtcagctccgttgccacttccttgatggagccttccccactgtccccggtgaagatctgtctatcttccccactggactgtaggcaccaaggggacagttcctgacatttagaaggcttaataaacaataaacttttaaaaagcaccgactttgtgctaagcacaatgctacttgttttacaaatattaacttttaatattcacctgaattccttgaggcaggtactgtttattcccattttaatgatgaagaaactcagacaaagaaaggttgagtgacttggccatggtcacaaagttagaaggtagtgaagccaaggatgactggaaagatggatggatgggtaggtgggtggatggatgggtagttaaatgggggacagatggatagatagatgggtggatgggtggacggatggatgaatgggtgggtggatggatggatggatggatgggtggatggatcgatgggtctatgggtggataggtgagggatgggtgggtagatggatggatgggtgaatcggtggatgggtggatgggtgggtggatgggtaggtagataggtggatggatggatgggtggatgggtgggtgagtacatggatggatggatggatggatggatggatggatggatggatggatagatggatggatggatagatggatggatgaatgagtgcatcattgctgtttgttgacactagcccatgagattggtcatttttattagttgaaagaaattgaaaacatcaaaatgcaaagcaaaaggctattgaagggtgaatactatcaccaccatttcaaccactgaatagctctatctattcttgggtctctctgcaggtcacccctctttccaatattttgaagtcacttgatgtttttaggtgttgtaatttatcaacaagaggggactcaccagatgtgaagactacacacacatatatatatccacatacatacacatatgtcatcttcatttatatgtatatctgtatatctatatatctagatatacctatcacattaggaaagggggtatattgtctaaacatatctgcaaataatgtttaaaatttacctctaaatcttgtgaactttgttgagtcttggcgtaaattgtactgctgctttataagagtaattcaattatcgatggatcaggattccagaaccctgcaaagtagtcccgtctctgctacttaagtttctccccagagaggaaacaagtcagtatcccaacccccttgggtataggatgccgtaaacatctttcagatctaccagaactcttgatttttctggtaggagatgacctctctttcaactcactgaactataggagattataatagccatttgcagtttaggtgatatttggtttatttaaatatcaatgaacatgaatctcactccctgtgattgggtgatgatagccatatttatgaaatttattactgctaggataccttgtatcataattctactcattgcaaaattaaatcatttccatatttgaactttaagtaagtatcacctgaatgcacattgtagaatcctgcagttctagcgttgaaaggaaatttagaatttatttcatccaagctaattcctagggggaaaatccataatgatatatctgaaatgtcaacctccagtcttaccttgaacacctcctgtgacaagaactcatggtgtaagagaagaatacagaagagtacttccaagcttggtgttgacttgcccgagttcaaattcaggcttcacgatgtacatgcatgtcttgtcaactgtgggagctgtctgggcctcagtttcctcttctgaaatagagaagataataacaccttctttgccaggatctgagaggatgtaataaaaatacatcgaagaactgaatcattttcatcatcatcatcaccatcattgctgttaaattcacaatatagtcagaacctattttgaaggttggtccatattactatgacaaaaaaagtgcggacaaaattcaagaatacatttcttgatactaaagtcattcccctttttcttctttaggaaactggtcaaagaactcatgcaagtggaacttacagcttccttgatcggactcagcattcagtaagtgcaacccattttgaacattcattccataaatacatccatgtctttgatcctgttctctctgaaaagctcttttctgcaggtttgaagttgttacaaaaactttgctgcctgcctatgtctttctcttctgccctattgtatcagagatgagaagagggcctgcaaggtagaaccaccctcctttagccctccctccccaatgaacctgggaaatttgtgaggttatcaatgagttaactgcgcctttattagctggggattaaaataaaatgtgtttttggtttctttttttctccccctaaggttttcttatcaggagacattctgtcccccttctgagtcacatgaccctgcaaagtagaaagaaatgccagcaaacacagatcagttaccgagagcatgtatttcttgaggcatttaagaacagttcatttgctctttttgagctggaatacatgactatgatctgaaaattactgcaaaaaaaaaagaaattttttactttaagatgctggggtacattatagaaatttcatttgttttcagcaagtaagcatttttccactttctgcctttctcattgcatgcaaggactttatttttggtgaaggtagcagtattttgtccaattttctcagctctctttttttatatgcagatatactctagcatttggggtagcaccttcacaaagtctctgatgtcagccctcctctgcaatagttttatgggtgaacagcttgttttaagaagaaatctgtaataatttaattataaatatcaaaattttaaaaggctagctgaaagaaatatttatttttcaagatgtagcttccttcataggaatgcagaatttcttagcaggttctacttctgaaagtgctggagtataatttgatacatcaaatatcagcccatgtcataaaggagcaggtagaattggaggacatgggactccaggcctgcaagaggctgatcaaagggaattcttttgccctcagtgggattgcaggactctttctattgtcttggaatttgcatattcaaatgcagaggggaaggaggcagagatagaaagaactaaaaagatggtgtattagctgttagctacatcagaatgacttagcgtaaccctgatcagctaacgcttgtatctcacaggagattagactggcagcttttgttcctaataataaaggaaattccatgtctaattccctacgtgccacatctatcttttcatgcctttgaagttcaggcttcggcatttcttgaaaactgggaggttttgtaagtaaaaaggtgggggctgtttggcatgaagtctgttcaaatctatttagtgtaaagttaaatttgcttgttacttgatctttttctgtttaaagcagcatctttctcatagatgcctttgttggtgcttgggcagggaggggagggatggaggacataaggtttcaaggatgggttttcagatcatacatgaccttctcattcctctgtcttctgaatatgattgaaattgctgcttctctgaaagaaattcctgttccaaccctgcactgggattgaaacttttaacctaagggaggctgtggtccctaagataattagtacatggatgtaagggagctcatgttaatttgtctatggatatggtatttctgtatctacaactgccatctaaagagagacattaaaaaaagtattaatttactgctctaaaccagtgagcagatataattttttttaaagaaatcattttagaaaggaagcaatggcaagatgccttattggggatgtttatgggtattgatccctcttagtgtatctagtaggtttccatcctgtccttgggattgcagcttctctgatacagcaaacctcaatccccttcagagaccaagcagtcacttcctctggaacaaacattgaattctgggacgtcgcctggttatcaggaaggcagatgatttgacatctaagctggccacatgcctgggttttgtgtgttcttcacccataacatgttggatgcatgctggttgagaaattgctccagtctcttacaggattttagcaggagcgatgacctagtagttggaatttgtacatggctgacactgggcctgggctgatgttgtgaagaatgccatattttagtctgaatccaggttttgatatgtccattggcttcagaaaattaattttcatttcctgcttccaaaatttggttattcttgtttaattttttccagaatgtttcctttgcatcggtaccctttggattgctgtttgttcaatagtatattacccctcatgatatccacagcatttactgtcgtgttggtagaccatgagtacttgttggatataatgatggtcgaacaggtacaacaatggaaagctgaataggtagatgaatgcttcttaactcctgatggagtattgtgtaaattggagaaagatggcattgacattagacaagagaccagtatgggtgtttctgatggttggtttctattccccaatactcttcttcaaagctttcacttctactttgacaggtctagagtaacagattggccaatgcacatggtgtaagagaatgagctcccaggaaccagcatctgttttctagctctccacatccctttgttgttatctgtgtgctaagaggaaagccacagaaagctcacagtagcagggtcggtgttggaacttaagcctcagcatgattttctacaacttgaaaatttaacttccaagaggtttccttgatctctattttcctatcaggctaaaaatcccatggcatgctgcatcatgtttataattaattaattgtgcaaactttatttttatgtttgtctttttctttggtctagtgctatccaatacaccatgtctgtgattataggaatatttttttttcaccaagtcttaatgaggtattattgaccaataagaattgcgtcaatttcaaaagcatactcttaatataattggctttggtgactgagagggggaaggttgggaggaggttgagggtacagataagaagaaggtggagacagaaagaactaaaaagatggtgtattagctgttagttatatcggaatgacttagcgtaaccctaatcagctgatgcttgtatcacacaggagattagactcgcagcttttgtccctaataataaaggaaattccatctctaattccctacatgccacatctatcttttcctgtccttgaagctcaggcttcagcatttcctgaaaagtgggaggttttgtaagtattgggtagagagggcactgcttgggtgatgggttgtttgggtgatgagtgtgccaaaacctcaaaaatcgccactaaagaactcatccatgtaaccaaaaaccacctgtacccctaaaagtattgaaataaaaataaaatttaatttttttttaaattgcgaagatttaaggtatatatgagacatgttaatgtacatataccttgtgaaatgattaccacaatcaagctacttaacatacttatcaccttacatagttaaccctgctaagagaatagataaggaatattctttatctgtgctgttcaatatggttaccagcagccagacggagcaagtgaacgcttgaaatgtgactattacacctgaaaactaactgaaaactaagtgttctttcaaaaactgttattaaaaaaaaatttgttactttattattattattatttatgagacagaatctcactctgttgcccaggctggagtgcagtggcacgatctcagctcactacagccttcacctcctgggttcaagcgattatcctgcctcagcctcccaagtagctgagattacaggcacccaccaccatgcccagctaatttttgtatttttagtagaaatggggttttgccatgttggccaggctagtctcgaactcctgacctcaggtgatcctcctacgtcggcctcccaaagcgttgggattacaggcatgagccatcacgttaaagtaacataaatgtgttactttagttttaattgacaaacaataattgcacatattcatggggtacatagtgatgtttctatacatatactgtatagtaatcaggtcagggtagttaacatatctatcatctcatttctttgtgtccggagagttcattaatttaaatttaagaacatgtggcttgtaacctgatactgtattgttgtatgggatggctttagactagcagccttataaatacaggggctaggtcagaagtgtccgtccttgtacctaggctgatacttagctgttatagatcaattaggactctgactgataaattgctactgtctcaagccccaaagtgtcctctattccctgctgttccatatgttctgcttccttgaatttacccttgatccagaactaaaggtttaatggtcccctgggactctgcacaatgccacagcattcatctattctaactggttggtgcctaatgcatgctgattattcaaatagtatatcacctctgattatttccatggcatctactgtagtgctggcccatagttcaccatcagtacttgttggatataataatggtcgggcagatagagggatggaagaatgaagagatagataaatgcatccaccttttgatggggtattgtgtaagtgagagaaatataacatcaacattagatgaaatactggtatgggtctttctgatggctggtttttatttcctcagtattcgtcttcaaagctttcacttctacgttggtaggtttagaataatagactccagatctatcactgaattctaatgccatatgcagcacagattgctatacatcttcactcatttctttctgtcacttaaggctcccaatgcataacacttgaaatcagtccacgtctcactcattgacccatgggcaccactctcttctcaggaacctcagtcccaagccttagttactaacattgtctttgtttttcatccgccaccaaatgataagtgagtgttttatctgtatcttctaagagacttcttttcattccctctgttggcatattgctccagggacttcttacttacgtatctgggaattctttctaggtagtcttcatacctaaagccaccttcccttggatcccagccaacagattgcaggactaatattcttgaaacaagaatatcgtctagttggttgttgaataagctcatccttacctaacattttatcttttctccatgaatccctcaatacatttcattccaactgggcaagttcatctcttgatatctaaacatgtttatttcccagctccaagcacttgctacacttggtctcaccagttgggatagcctttcctattcttttagtctacacttctatgtagatctctgttaagccctcctgataatgaatttttctctgtttatttcagctacttgattgccccttgtaggataaagaaaatcctaagccaattttcaacgtaggaagttgaccctatgattatattttagaacctgggtttcagtggaacaggcaggagtggaacagagtaaggaggtattgaaagagaaacaacaataattgccttccagggagacacagttctctcacatgcaaaattcagcagatgggttggaagtggaagaggttaaaaggcgccagttggaatacaagagggagagagaatgagaacaggcatggcctagggcattaccttaattcaaggccaggcacagggtgggtttcatgccagctgcatttagagtctgtggtctggaaggacaaactcatctagataatgctcattgaccatcccatttgctttgacacttccctggccaccaaccacccccacacactgttgtttacatttcccctatgaatatctcttacctctcctaagctgctgcatagcagagctcttttcccagcttccctctgcatataaggggcaggaactctgcagacctttttcgatcgaatgagtacatgagcatgggaggaaagagagagagaaagagaaggcagagagagaaaagacagagagctaaaagaagaaataacaattccttctgcttctttattgttaggacagagcaggataataaagaatggaagttacaaggaaggtgtgtaaagtagtagcatgggtaaggaagagggaagcccaggcagcaccccactgtcagcctcgttcttcttcatcatcttacccagttaaaatctgccatggtgcttatgatgctccctgatgaccagttttactgggtgtgcacaatctgtcttccccactggactggaggagttctgagggcatggggtgtgtcagtcttgcttgcttctgtatccttagcacctgtaaaagtgacaagcaggtacatattttgaatgagttgttcattgagttgaatgaatttgtgctgtgaatgttgatcacactctttgtactttcaaattattcttctgtcatccatgactgccggtggcaacccccatacccccaatctagatcagtctttgaaagattaagggagcaatgcttgtgaattgaccacacagctgtcttttgaaaacattatttatatgtttattaatttttcaatttgcataaatttagaggttgcaagtacagtttccatacatcatgggtatgttgcatagtagtgaagtctgtgcttttttttttttgagatagagtctcactctttcacccaggtgggagtacagtggtgtgatatctgctcactgcaacctacatctccaagattcaagctattcttgtgcctcagcctctcaagtagctggtattataggtgtgtgccatcatgctcagctagtgtttgtatttttagtagagaaagggttttgccatgttggccagcctggtctcaaactcctgacctcaagtggtctgcccgcctcagcctcccaaagtgctgagattatagggatgagccaccatactcagccaactctgagcttttagcgtaaccatcaccttaatagtattcattaagtaatttctcatccctcaccttcctcccgccctcccacccttctgagtctccatagttcatgctctgtgttcacaggtacacttcatttagctcccatttacaagaactacataactcttaacaacacatttgaccaatctggcttcagtttcctgattacaatactgataatgaggaattgaactagaatggagtgtcaatttgttctcacattgctataaagagatacctgagactaggtaatttataaagaaaagatatttaattggctcacagagccacaggctgtacaggaagtatgatgctggcatctgctcagtttttggggaggcctcaggaaacttacagttatggcagaaggcagaaggcaaagggggagcaggcacatcttacatggccagagcaggaacaagagagggagaggaggcaccatgcactttaaacaaccagatgttgttacaactcattcattgctgcaaggacagtgccaatgggatgttactaaactgttcatgagaaactgcccccatgatttaatcacctaccacctggctcacttctgacgttgaggattaccgttcaacatgagatttgggtgaggacacatgctctatatcaaatggtctttaactagggccccatctaacttcgaatttagaaagcaaatgagatatagaaactaggccacagaagagaaggttgaagggaagtatcattatctcagcaagacagagatggataagttacgaccagaagcagtcagtccctccctggcccacctgtgtacagaaattagcccattttctcttgacaggagagtgtactatgtagctaaattaggtttgcaactaaatcagtacagacattttgctttctctttgctataatgagaaactaatattaatataatttgatctacattcatgggttgtagtaacgaattacaggaaaggtacccaggcatggtggctcatgcttataagcccagaactttgggaggctgaggtgggaggatcacttgagactaggagtttaagaccagcctgggcaacatagtgataacccatctctacataaaatgtttaaaaaattatccaggcatggtggtgtgcacctatggtcctagctacttcagaagctgaggcaggaggatcacatgagcccaggaatccaaggctgcagtgagttgattgtggcactgcacaccaacctggaggcagcaaagccctgtctgaaaaaggaaaaataaactaagaattatggataatgaaagcaaatttcacctgcattcaccttctattagctttaacacctatgaggtgaaatctttgtatttatcattatcgttcaccggttaccaactgaagaaaaacagtaatgatatttctgctgaatcccttcatttaaactaaagagtagctctgcttgctgtctcagctcaacctgaggatgtagtgttgttttctgaagacattagtgaatctggaatcacctgattcctactggtggttcctgtagaagactatggaagtcacaaaggatgaaccaaaattttggtaaaataggctggttaatacgatatggaaacaggaatttggtttttccaaattcaggaggctagaatttcttcctacttttgagaagctccaaagcaaaaaaacacaaactttgtccatgtatagatggccagaatggttttattttcctaaaatatatgcctagtttcttttgaattcaggtggttatttgcagatccttgcttcagaaaataccagcccaactccatgcctggcttacagttggtacacagtaaacagtaacaatgattgctgttattgctatttaaaataattatgtgctgagaagggatgtcctctcccactgactgacttgtgtgcgtgagtgtgtgtgtgtgtacatgcatatgcattggcagaaaatcggttaactcttattgaacctcagtccctctgtttaaggagaataaattgtcttgcaaaactgcatggtggtacattctagctcaagttgctatgacattgatatggaagtcaacatgcttatcttggtaatgccatcattccttccttccttcattcattgattcattcataaatagctatggaaaaattttgattttggattctcgctaggtactgaggatatcatagtaaacaaacagatatggtgctgtacactcatgataacattggaagataaaactttaaagtaaataaaataatccatgtgagattaactatcacagactagccaataccagggagggctcaggaatgtaaggatgtgattagtttgaccagatgtgagagaggaccaaggagtatcctagatacaagtactttcttctctttctttgtcccagcccaggttttctcctttctaatctagctggctttcttcatccttctcagagggcattctcctctcagggttgtttcgtctcccagcaatgaccatttacgcttcacagggacagactctcccaccaagtccataaacctgcactctgtgcagaatcattgcccatttacagctgctaatgcattaataacagaaacgtccgtggccatgacctacctgagtcattacacactaatcataggaggcaatttcaagcagattgactagtgatcggtgtcctccctgacgtccaggcaggaggacacacgactgccttcacaaccccagagcagatggcccgagagcataatcacacactacagccggtgcaggtgtggctccaggaagggaaatctccatgtcttgcatgcaaagctgggctctctcacctggaggctgtgctccaaatgctcgtctttcattttggagcagaatccacatctcagggaccttctttgtgctcgttttaaacttatcacacagacagctctctgaagacatggaggaaatgagattcacctgcacctgaatggctctaacatgcaccactgtccacaagccactgtcgttccttctccactttcctctgcaatcccagtccagatgtatggtccaaagctgtggtcatcatgggcttgtgatttgtgttattatttcttccctgaagctgcttaagcattgttttttattcatgttgctctctcattccctgcgatcatcattataatggccacacaatataacatcaggatgatgtttttccgctttatcttagaatatctagtaggtttctgcttttctcactaataccagaatcactagagttaattacttagcacctatagagttttcatctttgggataagtgcctgagaagtataagtcaaaggatagaagcatctttatgactttggatatatttttctaacccattttttaatggatttgctcatttacagtcagttcgttgtattttgggctttctgctcttagctgcctattgtttatttgcccataatgaggactcagattatatttaagaggaactaggcaatgactttgcaattaggagtcaaatagaatctataccttcaagaaacagaatagagagggaatcttggttagaaaataactcattgctctatgacatgataatgtccaagaaaagaaaaaggagtttcagaatacatagattctggtgcaagacatgatttctatacagattcaagccaggagcctctcttcttgaccgatctgagatgaatgccatgttatttcttgacaaaggttaggaaatgaggggtctaatggctcttcaatcccgtgggttactgttctatccataaattcatgtataagaactttgttgcatgcaccgtggtcccagtctgcttttatggggcgtacactcagaagacagcttctgaaaatgatctgggtggaaacgtataaaggttgtgcattgccaatttgcagttgcaaaaatctggaaccagccctaatgcccatcaatcaatgagtggacaaacaaactgtgacacaaacacacataatggaatactactcagccataaaaagaaatgaattagtggctttttcagcaacctggacgggattggagactattatcctaaggaagggaaaacaaaatatcgtatgttctgactcataagtgggagctaagctatgagaatgcaaaggcataagaatgatgcaaggaactttgggcactggaggggaaagggtgggagggggatgaaggataaaagactacaaactgggttcagtgtatactcctcgggtgatgggtgcaccaaaatctcacagatcgccactaaagaacttattcatataacaaaatgccacctgttccccccaaaaaccgatggtaataattttttttaatgttgtgcattgtgaggccaaataagctaggattatttttgggtgtatatgctcaatagaccctatgggtcacatctagcagttcattaagattcaaataaacaaagcagcagtcccagtagaaaatgcacagccttggagacaaccaaatgaggattcaaatcttggccctctattcactatgtatgcaaagtaggaaagttacttaatccttctcagctccagtttcatcttctctcatgaggatggcaataggaaaccataggtctcttgtgaagattaaataaaaattcctttttgggaggaggggatgcctgttagggataaaccttttactatagagaatgggacccaaggagtatagcttgggcagtgatcatttcagcaaaagggagtcgtgattactgctctgctgagttaaagaaaaccttgtgctctgataaggaagaagagagaagagagaaaatgaaagacaaggatccaaccaacaagtgggtgggaatcagatgtctatgtgaaagaaagagtccctaggaaatcagcagctggttctgaagttcaatttgaagtggtttgctgtgtggtaaaccaatccccccgactctgtgtgcccttttctacccttccccctgaagttaatctttcctttcaaaactcatactcataatggtttgagagtgatcatggatggaagttatttcaagtgctgaattcctacctgactccatgaagtggaaagcagttgttgttcctagtcattcttaagataacagctaacatggtggaagttttgcttatgggccaggctgtgtactaagaagtttacaagcatcacctcatttcatccttataatgactgagtgagataggttctgctaattattactcttctacagatgagaaaactggaactggaagaggatacatagatttcttaaagttagacagcatgcaaaagctggagctgagtttgaattccacccatctcaactgtggagtctacgctcttgaccactatactaaactctttctatatgcagaactctgagacaaaagttccagtgggactgtaagtctcatcaaagaaatagtgacaaaggcgattgtcttcatcaggaggtggccttgaggattctggtgcctggagacctcagctaatgtctgggttatatttacaactccacttcttcaaaagatggatgaaggccaggcatggtggcccatgcctgtaatcccagcactttgggaggccaaaacgggtggatcatttgaggtcaggagttcaaaaccagccaagccaacatggtcaaaccatgtcgcttctaaaaatacaaaaagaaaaattaagtgggaatagtgtcacacacctgtaattccagctacttgggaggctgaggtaggagaatcacttgaacccaggagacagaggttgcagtgagcccagatcacatgactgcactccagcctgggtgacagaagtgagactctgtctcaaacaaataacaacaacaaaaacaaaatcaaaaaccacaaggtggatgaagttgatgactggtatgattttaaaaatattgacttctactgtgtagctttccttcatctttcccttcttccccatgcaaagaaagatgaagaacatgagcacactgtacaataatgtatgtctgtagtttaatactacatatctgtagtttaatacttagtatgcaaatattctaataaaaaagtcataaggatagggaagtaaaggaaggagaactattctaaagttcaaaaataccttattattcaaagcacatggtcttactcctgcgtagtggtggctgaaacagattgcaagctcctttcctaaggctgactctgcaaacatgaggttttgaagaacttgaaggtttcacacctgcacaaaggctcccaagaagccttgcacagcagctctcgtagtactgagctcaaagtcactgatgattctgttcaaaccctctagtccccactatgaaggctttgaaaagggatatggtgaaaggtgaggaatcagaatagggcccctaacattcctgtgatgctcttcctcatctcttccttactggaattgctgtctcactatatcaagcagggaactacagcaattcattcattcaacaagtacatagtgagtgctcttctatgctaggcatgtgctagccgcgagagacacagtgggaaaaccagacacccatgctgcctagactcaggggtcttactttctctagaggaaacaaatattagataagtaactgtacaataaaatagtataattacaaatcacagtgagtgctgcaatgtaaacacaccagcgtgtgataagaatgtatgcagtgtgtggccatttaatgtaggtgatcaaggaagtgatatttaagtggagacattctagggcaaattctctgggagaggagcaagacttcggtggttttggggaattaaaggatggtatggttagaacagaatcctagaaggggacataggatggaattgaaagagcagatatgagagagattaccatcaaggtacagacttcagattttatcctaagtgccttgggcagctcttaagggatctgaaaaagtaaggaagttagtaatacttgtgtttttaagaaagtattgatctggctactgtgttgaagaaggcttgaagaggaggcaaaaagaacagttaagtgggttattgaaatagtctggggccgggcccagtggttcacacgtgtaatcccagcacttcgggaggccaaggcaggtggacgtggtcaggagtttgagaccagcctgatcaacatggtgaaatcctatctctaataaaagtacaaaaaattagctaggcatgctggtgcatgcctgtagtcccagctactggggaggctgaggcaggagaatcatttgagcccgggaggtggaggttgcagtgagccaagttcgcaccactgcacttcatcctgggtgacagaatgaagaaaaaaagtctgggagggaaggatgacattggcttagaataggggtgagttgtgggaatggatataaatggaaggatcctccattttctgtttctctctctctctctctatatatatatatgtatataatatgtgtgtgtgtatatatatatgtgtgtgtatatatatgtgtatatatatatatataatctatctgttaatctatcttctgttttctattcagtgttgcataaatctcaaccatttgctcaattctctggtgcatcagagagtgccaccagtatgtcctaagtcctgcagaaatcatgcaattttttttgtttcacctttttttaaaaaaaaaaattgtatttatttgtgtattgccctggaaatgtacaaatagtttcttcttcccctattaaagtttgcttggtggggtcttgctggttcctgagtttgccttggctgccatcttccatcctacctaggatgacaccatttgtttcacataagtttctcatgcatgagaggctgacattcttaatagttctgtcactcctgttacaacaggctgctgaaaagaaacaagcgatgcctgcaggagatagggctgtctcagcggtttgtgtaacaccaatggggtgtgaggtagcaggaaaataattagtttagttagatgtaaatggaagacgaatgaagaaagtgctaatatgtggatgcctgggagaaggggtggcctgcctcatttaaggtttgaggaagaataattgaatgaatagctatgaaaatgaaagcaatattaagagacttgtatggcaacgtagaaggcgggaagagctaaattcgatcaaccagcatttactgagtgtttattatgtacctgtcactgtgtgaggcattttagctacactggtgggaaaaaataatggtaagacataaataagactttagaatctccgtggaagtcaaaatttcagaacatatgaatgcacaaacagatattagaaaggttggatagcaattgtaagctacattaataggcaaaactattagggatggcaggaataatgttgaatataggagacatgactgactgtgacgatagctagttgatttaaattctcagcacattacttctttccttcataaaatgttcatgtcacagcatagcgtgctgttatatcttcatacacacacatgcacacacatacacatacacatctggtcaaggcttgtgaggccacattaggggttctgggaacaggaaggtagtggagaaaaattccctctcctaaccatttagtgtataggagtctactgttttagtgaatagttcagagaacttaaaggtgttcagagaagagaaagtcagcataaaccatgccgtggactagaagggtagatgaaaggtgttggaaaaatgtagagatgaatccttcattgatgatgcccatctcttatgaaagttatagaacatagatgatcaatatattagctacaccttacagaacatgggccattctaacagatcataatcattatttaatatcttactgagagttttgattgtattttattattgatccaatgtcatgttttgatgtccttgacatgtgacattctttttttttcttttttgagacagcatcttgctctgccacctaggctggagtgcggtggcatgatgtcccctcaatgcagcctctgtctcccgggctcaagcaattctcctgactcagcctcccgagtagctgggactacagtcatgtgccaccatgtccagctgatttttgttttgtatttttcatagtgacagggttttgccatgttggccaggctggtcttgaattcctgagctcaggtgatccacatgcctcagcaccccaaagcgctgggatgacaggtgtgagccactgcgcccagccagacattctttcctttgctatactctttcatattgtttaaagctgttttgttctttggatctgatagttctgttgttttagtcctgagatttctccatttcttttctgctttttattcagtgttttttcaaatctccctttgtcatcatagcttctctttgcctcacattcttttctatcacttgtcaaatttctcatcagcttttcatccttgatttttcagagtttggtttacgaaatggtccagtcatttctacacctctgaaaaactcttaaaattaaaaaatatatatatcagaaatggatacaggcttattttcgtggatggacttaagtttagaataggtggcatatgtttaagtttttagatcacagacattaggaattggcttttaaaagatgttacatcaacgaatggttagaaagcagtaacatcttttctacaaagatacttgtcatctgtcagatttatttatcagttaataataaagtgatttttcatatcactagatgattttctactgtctcattagttgaagaaatcaaaagaaagccaccctatgctaactcatagaagggcataactatttagtaccccgagggccaaagaacaattaaagtgaattaaaattatttcttttttggtgggggtaggggggagcaggaaacagaatgactagactccgaaggatttttctagagaaatattttaaccattgagtaaattttccttgattaaagaaggaaataacaacttggagaggaaatctaagtattactttagggttattgagagatgccggctagtggtacttggaaagataaggacaacttgtcagccactccacagagaagtagttttattaaaagtcaacgaaagtggccaggtgtggtggctcacgcctgtaatcctagcgctttgggaggccaaggtgggcagatttcctgagctccggagtttgagactagcctgggcaacatggtgaaaccccatctctactaaaatacaaagaattagccaggcatgttggtgtgcgcctgtagtcccagctactcaggaagctgaagcaggagaattgcttgaacccaggaggtctaggttgcagtgagccgagatcatgccactgcactccagcctggacaacagagcaagatagcatctcaaaaaaaaaaaaaaaaatcaaagaaatatgctagaatcgtcattatatattgagaaataagattcaatatcccatagatttaggcactcttcacatctgtgtatctggattgggtcatagggagttttattccaggctgagtgaaataagacagaggacaggcaagtagatttcttcttgcttgccagttctcattcgcagaggatccctgtagttctgttgagaattcattggaactcagccggaaagtgctgagattgattagcaatgtcttccatgggtacaggaaggggaggtggcaggtaacatatataccagcttttgccattctgctctagacagaagaaacttttcccctgtggtcaaagagggagagatatttgcttctggagactggatctacttgggttggtgaatgcattttaagatgacctggtttcatattactgtcaagcaagagagaacagtgtcatcctataatgtcaggagtaatgttacagttcagttgggaatacctattatgcctgttagtatttctaactaaatcccctttcgatgtgatagtttaattgtaggaacatttttctgcagttttgtttagggaatactgcttgcttagcgcttaatccatttatactattggattctgttgcaaatgacactcacactggaatgtgtgttagacacgtaaggcagacgggaagatggttccattcatttcagagaaatgggaggcaaaagtgagtaggatggctttgaaggtggtggtcttatgtttgaatgcgcgtcaggccccaggtggtaggtcttggtactgcatgctgctttattcatgcatctctctaaacaaatacgtcctcagagaagagagccaggagagggaggaagttctagaaatgtgctattggtaaatatacctaaagacagtggcatttctttaaccatgttcatcataatgagaaatgcagtaaatatgaaaataaaaaatcaggccgggcgcggtggttcacgcctgtaatcccagcactttgggaggccgaggctggtggatcacgaggtcaagagattgagaccctcctggccaacatggtgaaacctcgtctctactaaaaatacaaaaattagctgggtgtgttgacgcgcgcctgtaaccccagctacttgggaggctgaagcaggagaatcggttgaacccgggagccggagattgcagtaagctgagatcgcaccactacagtccagcctgggggatacagcaagactgtctccaaaaaaaaaaaaaagaaaaaaaaaagaaaagaaaagaaaagaaaaaataaaacaaaaaaatggaaaatctgtagtaaagtcagagaacctgcattgtgatatttcctatgtccatatgtccatcattgttctccaggtattgcctggttttccagcctcacagtaggcagtgggtgagagacgcagcatgatgggagaatgaagcccattcatagtggaatcaagcctccatctttgacctcagtctgtgaccttggcagcttcttgactctgtgagccttggtttcctcttttggtaaatggaacaacaaatggatacttgcaaataagaaggcttaaataactgtgatatatatatattcatatatatacatatacatatatatatatatatatatatatatatttttttttttttttttttttttttttttttttttgagatggagtctcgctctgtcgcccaggctggagtgcagtggcgagatctcggctcactgcaagctccgcctcccaggttcacgccattctgcctcagcctcccgtgtagctgggactataggcgcccgccaccacgcctggctaattttttgtatttttagtagagacggggaactgtgatttatttttagtctcagttgaaatggggaccctatggctctgagaagtcaagacccactggtaagtaaatgtcagagctagctttgaacttcagcattcttcctacagagctgatatctcatgatgtgctgtagagagggctggatttataatctagagagggctggatgttgattctaaaactagtgcttcagttccagcctcatcacacaccacccgggagaactttgccagttgtcaacttccttggcctctgtctcctcatctctgaaagccataagattctgtaaagaggtgggggggaaattggatgagatgatagatgtggagacagtttgcacagcaggacaggctatgcagtgggaaagtaccactgtaaggaagactggatgtatagctgcagaaggtcagagaagacatagaaaatcctttaacacctgagtgaaaacgatccatgacaaatgaagttacttcatttaaaaagagcctagtcagagttttatcatattcaagaaatatcatttattggcaatctactatctgcaaaatcactgttcgagtttttctttgtgatccagagcagtttacattgcaacccttattctaaaggaactcaaaatggcattgaggaaagcatttttcaatctgacccattttttggaacccaagagttcagagcactttatattactcgacagtttatttccatggagggagtctataaatgctttatatttatccatgttatgaattaatgcatttctgaagaaatccacccaccatgtggcatgttgattccccttttctctcatttcccccaaaacaccaaagaaggagggccctatgaggttcaatggtctcctttaatggtgcatttaaagtcgacatgctgatgccaagtctttctgtattgtgccgtcccaacagggatggcttcttagcagcgaatatggggtgagtaatttgaatcaccgccatcaacctgaaaagccaaagttgttccaggataacccaaaccagaacaaacctcagatatttgcaggtgaaagaacgagaatacgaatatatgttgtgggctgggagagccaaaatggcaaaggagtggaaataaattaatggggggaaatgattgatgtggaagtaagtctctcaattgtacacctggatgccacattcttacaagcagcccagtagaggcagatatataggctacaaagacacgtgctgtcaagcagcaagcactacttattgtctctgttttctctctaattgatacgtgtcttaggaaagcttaggtaatcacttggcaaaacacatctttataagaccatctctgtaaaaaaaataaaagtattaaagtgacagtggcacagaaaatcataagaaaatttttccacgttgagacgaatcctcctgcctcttcttgagaatccctccaaagatatcctgtatgtctgccttgtgagaaaacacccccttgggtacaaactggtcaatatcaggaaggcagcatgctcatatctcagtcccaatgcatgccaaatcactaagtggatggcattttcacaaagtcagaaaagcgacagttttattctcaaggttttgttactatgtttcatgatgtgcaagcaatactttggacaattttatccagatggttttgtccaggtaatttttgtctgcaatatgtgaaatacgtgatattctactatcagatactttggattactgttttttagtggtgagaataaaaagataccttcattttccattaagtattacattttatgaatattttccccacctcttcacttgaataccttcccactgcaacacacacacctacacctgtattccttttgatccataattataagcttttgaagggattatatcaagattacctatttttaataccatgttaataattagacaacttgccaatgttgaagtttgttaaggtcctctccatcacaattcctgagctaattactagaatatcagtcagtaggttctaaatcaaaaactctgggcgtgtgcctagatggaaatctgaatttttaataggcagatgagttgatctttattaatagtagtttgaaaactaacacagttcaagcaaaaacaaattctcatacagttgagcactgggactaaaatatttttttaaaaacttggtcactggatgaaatctaagttcttggctttctcttaaagagtactttaaaggttagaaatccacaacagtggctacctggttatgtaattccaaattcattcctcttctaagacatacaatggcactcaagagacctgaaaaagttagttcttcttcaaagagtgcatgtttaaccaacttctcaaaccaggtgaccattattatgttcactttcaaaagtacggaacaatttgaacctgtagaaatgtatccaaaggaacttaatcttttattttgtggtaggtacacaataaaagttttcttcattgaatgaattagtcaagaactcattctcataatgcaggagaatgaaatgggaaggggtgaggggtggcatagctctaggagactggcatgattacagatttgggtaattcccaggatccagtagcctggggcagacttagacaattagatagaaggatcaggagtggaatggaatatggcaagaaatgtatgtgcatgcagtgaaagcgggcagaaaacaaaactcattgattcattaaatgaatattttatggaatacttactgtatgccaggcactgtgctgctgaggaaggccaagttgacagagtaactggccatcccaggatttccacaattgaggagtgtccttagaggtgggactttcatactaaagccagggaaatgccaagcaacccaacctgagtcaatcatcttgaacttgaagaagtgctgtgattttaataggtttgttgcctgatgtgtgcagcaagtcaataggagacactgggttacagcagagaaagtggtttaattatggggctgctgaacgaggagcagcaaacatcaaatccatctcccggaggagctgagggctagggttcttggagagggctaaaatgtggagatcattcattgatcaaagaggtcatcgtaaagtcatggacagggaggtaaacagtattctcatactgattctgttcctctctgggaggtctttaaactggttggcatcagctgtttcactggaatgttggatttgataaacatcttaagcgattcctttattttttattttattttattttattttattttattttattttttgagagagtctcgctctgtcacccaggctggagtgcagtggtgtgatcttgactcactgaatcctctgcctcccaggttcaagcgattctcctgcctcagcctcctgagtagctgggattacaggtgcctgccaccatgcccagctgatttttttttatttctatttttagtagagagagggttttaccatcttggccaggctggtcttgaactccagacctcatgatccacccacctcgtcctcctaaagtgctgggattacaggcatgagccaccgtgcccagcccatcttaagcaattcttaaacaaaagctttatgattctagtatcagaaatcctatgtacaggaacaatggggatgcaaaaggttggtatctagtgactttcagttagaaggaagtggaacaaagtgcagcctgattaatacttaattatgaccatatttctgcccaaaattcttgttaaccatgtgaggatggcttcagtgctaacaagagtgatgaatagtatgggtgctaaggggtcacgaaacaggccgtccgactatctgcagcaaggggacaggaagtataggggttgggggagagttaggcctagctcactcatgacctaaattagttactggtgttaccgaaaatgggtttggatccagactctaagacagggttcttggatctcaagcaagaagtaatttagggcaaatccacagagtaaagtgaaagaaagtttcttaggaaagtgaaggaataaaggaatggctacctcataggcagagcagcaacaagggctgctggttgcctgtttttatgattatttcttgatgatatgctaaacaaggggaggattatttatgccttccctttttagaccatgtagggtaacttcctgacgttgccttgtatttgtaaactgtcatggcactggtgggagtgtagcagtgaggacaaccagaggtcattcccattgccatcttggtattggtggatcttggcttctttactgcaacctgttttatgagcaaggtctttatgacctgtatcttgtgctgacctcctgtctcatcctgtggcttagaattccttactatctgggaatgcagcccagtaggtcttagcctccttttacgcagcccctattcaatatggagttgcccttgttcacatgcctttgacacaagagtgagccagggaaagagagacattcaaaggagaggtaacagcacttctggggacctgggggatcacaagcattaggaaaaccagaagaaaaaaggggaaggggtggacagagagtggcacagaatgaagccacagagatgggcagtgtccactgtctctagggtcttgtagggcatgtgtaagctttccactgatgctgcatcaaatgatcacaaatcattgatttaaaaccatgcaaattttctgtcttacagttctggaagttaaaagtctaacatgggtcttactgagctaaaatcaaggtgtcaatggggcagcattccttctgaactctctatgggaaagaacctgtttccttgcttttttttggccactagaggctgcctacattccttggcttgtggcgtccttccattttcaaagccgacaatggcaggttgagtctctttcacatcaaatccctctgatactgactcttcttttacctcgttcttctccatcttgtataggagatgagtaaaaggaggttgagacttcctgggcggcattcataggaagttagggattcctagcctctagatatttacagttaagggaacagattaataatgtttactaaacagacccaggctcagaatgtcctgatatccccatatcttgaaaacaaaaggattcctaattttgctttaaagataataatgctgattcttgcaaaatatagtaattaagaaaattaatcctttatcacaaaccctgatagtaaagcacatcttcccattttttttttgttatgctgtatataaacaagcattgtacatagggtggctggtttcctcctcttacattatgaatgtcctactctgtctatggagtagctgttatttcaccactttactttctaaataaacttgcttttggtttgcattgtgggctctccctgaattctttcttacacaaaatccaagaaccgtttattggagtccaaatcaggactgctttctggtgacacttttaacgattctcgtgattccactgaacccacctggatcattcagaataatttcttgcgtaaggtcaactgattagcaaccttaattccatctacaaccttaattctcctttgcaataaaacataaaatacttacaggttccaggaagtagcatgtggacactgttggggggcctattattctgcctagcacagggcacagtaaggattttgtgcaaattcaaacaggaattggcaaactatcaaagccctgctttgaaggggagtgatggtggtcaatttgcatttcaaaggatcactctgctgcaatgtgggaatggaggcaagcttgtgtaagggattatcagttgggaagctgttgcagagctcctggggagagatggcggtggtctggactaggatggcaccacgaagatggacatgtggaaatgcattctggctatattaaacagggagaattgacatgaattagagatagattaaaaacaagtagaaacgaaggatcccatgttttgccatggcaatcttttcacattgaatgaatacaaaacgtcaaggtgcttagcatagactagcccatgaatggcacataacagaaacaaccttgataaggttcctgtctctaaatttaaagatgtgcacagcaacctcacgagattcaaggttgaggcattgagggtagaagaagtaatgaagttaggtaggttttgctgagtggcatccacgtggatgtctattagagagttaggtatacatatctgaggttcagaatgcacattcctgtccatttcttccaaatataacctttattcctctaaatgctttttgtgaaatgtgtttggtatttgataaatctcttcggtgcgtatctccaaatttggagataggaaccttatcaaggttatttctgttatatgccactcacaagctcgtctatgctaatcaccttgacattttgtattcatttggtgtgagaggaatgctttatcctacattgatggggacacttgtttctaatgagaaatctgatgaaatcaggtgctttgaatacagatcatctccaaacttctgtcgctttatattttttctgaagtttgtctcctccctttaggagaccatggtttttgatacgaaactccatctgatagtcatttctgataaggattttacttttaaatccatcaaaagggaggagaagtgacaatttaaagtgggcagatggaaaaatgagtctcttggtctttctttatttcttatacccctcttcctctctgttcttttcacaaaagatagtctcatcagaaattcggggaaaaatggcttttcattcttattctcattttctgacattcttactctacagtcattattaatgtagaaaactctgtctattaggtaatctgtgtcttcccctaccctggtggtatttcattatcatttaaatatgccacccactgctccttctcaaaccttttgaatagagggtcattagtagatttttccccctaaattatgctcagcagttgttaaaggaagatagtcttcagggaagttctttctacattgaagaactgaagtgaggatttgcgataattatctggataactcagcctcttcttatccctcctgaggtggaacatatttcctgttctctttcattccttccttctttcatttcttatggattatctttgccacaaacaacaacaataataaccaaaacaaaaccaaataaggtattcatgtttccatgcttcctatagatgtagaaagtttttaaaaagtgttttttgaattgctagctactgtttaaaaattaatacaaatgcatgtcaaacttcctatgagacattttaaagcaggactcgtcttgagatttgaatcagtcgtctttctcagtcattttgggggattaattctgtgttttccatgcataatattccctttggattaaggattactatgaacctgggctttgtcttcatccttaagaatcaccatcccctgagaattaaagatgatgcttctcatgtaaattgcttgaggttttcacgagtctctggctgttacaaatgtcagctgagcacagtctaattctaatcttagcagagtaacctctcctgggcatcggagactgtgatgaaaggaggtaatcagtccttcttcatctctatttctcgtacccagtgccacctgatatgcatcatggaaactgttgttggaggatcaatgtctaggagaggcactgcttgatcttatgcaacctccacctcccgggttcaaatgattctcatgcctcagtagctaggattacaggtgcctgctgccacacccggctaatttttatatttttagtagacacggggtttcaccatgttggccaggatggtctctaactctgagcctcaagtgatccacccaccttggcctcccaaaatgctgcaattacaagcatgagccaccatgcccggcctggtattatacaattacacaatctttccttctctcttcttcttttttcttttttttcttttttttttttgagacagagtctctatcgcccaggctggagtgcagtggcacaatctcagcgcactgcatgctctgcctcccgggttcacgccattctcctgcctcagcctcctgagtagctgggactataggtacccaccactgcgcccggctaattttttgtatttttagtagagacggcgtttcagcgtgttagccaggatggtttccatctcctgacctcgtgatttgcctgcctcggcctcccaaagtgctgggattacaggcgtgagccaccgagcccggtttttttttttttttttttttgagactgctctgtcgccaaggctggagtgcagtgatatgatctcggcttactgcaacctccaccacctgggttcaagcgattctcctgcctcagcctcccgagtggctaggattataggcatgtgccaccatgctccactaatttttctatttttagtagacacgaggtttcaccaggttggccaggctggtcttgaatttctggcctcccaaagggaggattacaggtgtgagccaccgagcccggcctggtcttacagaatctttgtgagcatcaagtctgtcatttgtaaaacaagaacaatatatggcggcttttagggtgttatgatgatacagtaggatgagatgtttggaagagcaagacactagattcttgtgaagcaaagcattctcctgtttgccacttccttgttctctcctaggtagacttaaacagctcctgctgcagagtagatgaatccccacattggcgctgcgtccaggagggttcttggctttacccagaagagaattcaagggtgagccaggtgtgttaaacagtaacttttattgaagcaactgcgtactgctccttacagagcagggctccccctataggcagtgtgcccagaggcagttctgcagcaatatttatgcccacttttaattacatggaaattaaggggcagatgatacagacatttctaggaaatgggtggtcatttccaggtgttgccatggcagtggtaaaccgacatggcaggctggtgtgcatgtctaatggaaagctgcttctcccccagccctgttttagcgagtcctctatccgacctggtatgggaatccccacatccagagtcagttgccacctcctacctcacttccatcatcctttatacttactcggtcccagctacatggcagacataatcctaggtgtgaggatgtgttgggagcaaactcgagtttctcccttcatggagcttacattctaaaagagggatcagatgttgacacatgtgaacccatacaatctaagactggtctcagttaatttagaaagtttattttgccaaggttgaggatgtgtgcctgtgacacggcctcaggaggtcctgacgacatgtgcgcaaggtggttggggcacagcttggttttctacattttagggaaacataagacatcaatcaatacatgtaagaaatacgttggtttggtctggaaaggcaggacaactcgaaacaaaggcaggaagactcaaagcggggagggggattccaggtcacagataggtgggatacaaagtggttgtgttgttgagtttctgattagcctttccaaaggaggcaatcaggtatgcatttatctcagtgagcagagggatgactttgaatagaatgggaggcaggttggccctaagcatttcccagcttgacttttccctttagcttagtaatttggggggcccaaggtattttcctttccaacacatatgcaagtgaatacttattatatatagtgccaataatgagcccaaaacaagcaatccatctgagagaatagaagcggccagaaggtactgctgtagatagtgttgttaaatttaactatatttggcctgaggatgcctctgtgactgagtccttagttaacaaactacagcctaatttagtatgtgaactaagtgaaagcctaacttgggaatgtgagtctgtaacaggttgctgagtctcagccaatcacggcagctcagcttcagataatcccaggcggccaagggatcaggtactgttccaacgaggcaaggctgatctgtaactaatcaaggtgcttccctacctcacttctgttttctgtccataaaggctgactgcctgtgttgaggagtggagctctctgaaactcttctggttccgatggcagcctgattctcgaattgttccttgctcaattaaactctgttagatttaatttgtctatagtttttttattttaacagtgtcttgataatgcctcaagaaatgcctttttgaggttatgatgttggagcagagagttgaaataacttcgtaattgaggcttgtcttgggatggttgatgttagtcatgtcaaacgctggatctctcatatattaccagaataacctcttgacaagacagagttttctgtttaactgaattatgggagagcactacctcaacagagtcttggtggtgttccaggaggatgggcaaattcaggatatttattgagatttcaatgtgtgttgtaaggtgggtctttccatgtacagccttgtttacattgaataaagatcatgatattatagtttagaatagatggacagagcaaggcaaggatattgggctgaggagttcaaagaatcttagggtgaaagtggccatttgatgctttctcttcaagagtaagtgggtctctgaagaagttcctggaatgggcaataaagccatttggacttttaactttctggccaagagtttcctggaatagtaaagtgatgtgaagaagagagtcaactagggaagtcatggtaatgtagacagtgaacgggagatggttctcatcctcaaccaccatcatcatcattgtctctcctctttactgggggcttcatgtgtgctgcatactatgcttggttctaaagatacagctgtgaacaaacaggcatgttcctttcttctcatttggcttataatctacccgtgaaggtagatgctaaacaaatggttgcatgagttaattacaaatgcaatagttgctgtgaaaagaatgttcttcactatgacagtgtagtgtcaatcatggggcgctgtggaggcctgggagtaactgagagaggctttgcatcttgcatatgcatagatgctagctgggtgaaggacgcaagagacggttgggtgaaggagactgaagtttatcttagagcaaggagaaacaaaatgtccctgtatatcaacaattattatatcctatgttcacagagaacttgacacaaataatatcataagacacattcacagtacacagtgacagtgcttggaaacatcaaaattgacagtctacctgcgactgcctggcccattcctctaactaaacagcagttgtttgttgaaagaatgagtgaatgttgaattaatcaacaccatttagttcctcagtgacctccaacagctcatttgctcatgcagatcatacagaaactggtgagaagacatgtttgcatctcagcctagcttactcctgaatacaagaaagcaggaaaacaggccttcaggcgtgaaagtgggtggtggaaacccagcccgttcatacctcttggtcaagtttagctatcctaagtgtgggaggcagagaaggggaaagaggcaggagtgctctgagggaggttatagctttatgggtttgtgtggtttgaggtctttgctcttggttttgagcactgtaggagaggagataggcttgtgataaaatgtggggcacatgtggggtcaggccatccaggttcacactccagctccactgtttaggagctgtgtaaactcaggcaaatcatttagttccttcttgtctatttgtctcctctgtaaaagagagatggtatagatgacaccatatgcttcttggagaattgaatgagatacttcagtagaaagcacttatacagagacttatatggcatttctatggcaaatgctgcccttacgtcaggggaaatctctttgccctgttgtagtcctactcatgcttggtgagatggtatatcagcctgttcttgcactgctataaggaaatacctgagacggggtaatttataaagaaatgagcattaattggatcatggttctgcacgctgtacaggaaagatggcagaatctgcatctggggaggcctcagggagcttttactcatgacggaaggcaaagcaggaggaggcatctcagagcaggagcaggactgagggtggggagcgtgccacgttcttttaaacaaccggatgtcccgagaactctctcaggagacagcaccaaggggatggtgctaaccattcatgaaggatccacacccttgatcccatcacctcccatcaggccccacctccaacactggggattacaactgaacgtgagatttggacggagacacagatccaaaccatatcagatggcaacccaggaaaagcagatttcaggtgtactatgcttttctggggatagagatggacagaggcagatttgctcatttttggaagtcaagcgcttcaaaagaaattcttatcttgagatttgattcctgattttatcaggatcttacagcagacttcttcatggaaaagaataactgttggctaggcgagctgatgctgtgccgtgggttgctatctctttcaaattcctatctgcagtaacctctgtctctctgaggttgaaccaaacacatacttattttgagctgaattttagacaggtttagagcagccagaaaaaaagcagaaaagtgcccttcagaactcaaagcagataaaactttctgttatcccttacctagccgacgacttgagtgtagaattcactcagctgataaggaggctgacattttacctcttagaagttttgtcagataaaagatgtgcaagccatgtttaccatccactctgtgtttcaaacttttgataatagatttaaagaaaaaatcatcgagatacgaatattgtggtaaaataaagctaccccatagaattaaaataatgaggatcaaagaaaggctcaaattgttcaacatcctttaaaaggatccctttgagaaaagctgacttcttgacctatgtcattagtggttggtaaacaatttgcatggcttactaggattacactaatgttcctgactccagctccagcttgcagagagtgcaggtacagtcctattgagaacacatcttcatctctagagagcaaacctggcattaacaatgggagctaaatagaaaatcatggcatttcccatgaaaaaaagagtaacattaagtgctgggctaattgtcaagtggagggttggatatcttctccatttttccccatggttttccaatactttataggaaaaatgattaataagatatccaactccaagaattcagaggtccaaggagataagaaaggaaggcaagttggtttagaactcgtgtcttctacaggggatgccatggggggcagtggtgagcttaactgctggagatttccatggtgaatgtgcgtgtctctccttggcaaaacatgtagaaaagagacttttactattaattactttggtacgctcaagtatccttctcaaagcccttaaaatttcaaaaagtcctaggtttgtgaaaaatcatgcaattgatattggattcaatttatttgtggcgtatagacaaaaattcagatgaagaaatcgtaaaaaatacatggtgtttcacgcctgtaatcccagctctttaggaggctaaggcgggcagattgcctgaggtcgggagttcgagaccagcctgaccagcatggagaaaccctgtctctactaaaaatacaaaattagccgggtgtggttgcgttgcgcatgcctgtaatactatctactcgggaggctgaggcaggagaagcacttgaacccaggaggcagaggttgctgtgagccgagatcgcaccattgcgctccagcctgggcaacaagagtgaaactctgtctcaagaaaaaaaaaaaaaaaaaaaaaaaaaaaaaaaaaaaaaaaaaaaaaaaaaaaaaaacagtgttctctagaatatacttcccaacttctaagtacttcatttaactagttttagggaatgtttatttaactaaggtgatgcctgaatgccaacaatggcatccatacatctatgaaagaccttttactagtaaccttttaaatcacttctctgttgataatcaccaccctcttgtgagtaattactaggtcctaaagcattgtccatggattttcatatttaagcctcattaacaacactaggaggtaggtggcattaattctgttttattaataagttcaacaaaaacttaaagagtgcaagtcatactcatcagcaaggatgcctagctcacaagtggatgcatggggatttgaaccagggtctgaaaacttggaggcctaggtttctatgagggcactcttctgcctcccttagtggtggatggcctggcacctggtcctcaccacgaaatgcctgaaatgaagaccacaggcagtgggcacttggctgacaagtagcaacttgtgcaaagttgtgatatgtcatcttatcctttcagttttctcctgttgcctttcaaccacagcaatgtggccaaaacttacgaagcaggagttttatgacataaaagacataatggagtccctgtcttgacctggggaggcaggttagcttacagggaaagatacataatctttataagagaatattttcatgtgtgcggatagtaaatatacaactgtgtaattatatatatgcatatgcgtttgaattgtattctaatatatacaagaatatatataaaataatattgtatacataaaatatatatatataacgtgtgtgtgtgtgtgtgtgtgtgtgtgtgtatatatatatatatatatatttttttttttttttcttgaggcagagttttgctcttgttgcccaggctggagtgcagtggcatgatgtcggctcactgcaacctctatctcccaggttcaagcgattctcttgcctcagcctcccaagcagctgggactacaggcacctgccaccctgcccagctaacttttgtgattttggtagagacagggtttcactattttggccagggtggtctcgaactcctgacctcaggtgatccgcccgtcttggcctcccaaaatgttgggattacaggcataagccaccgctcccggcctaagggaatgttttcatgtgtgtgtatactaaatatacaagtgtgtaattatatgtatgcatacatatatgtttgaattgtattctcatatattaaatacatgttatttcagaaatggaaggcaaaataaggatattagcatttcctgaggtacgtaaaatgttgggtgctttgcacgtctgacctcatttattttacaacctacctacaagatatgcattattttcatcattccaccaatggggagtatacgggagatgctgtaactggtataaatgcacagaatttatacactgcagaaccagcatttgagttcatggctgtatttacccaaacctaccctttttcagtgcttttttctgtctgttgggcagggagagacattagaatgagctggaggtatcacagatggataaggtacaattgagagtttgtagaggtttctccagtcactttatataataaaaagcaaccagctatctcaagtcccagacctcccagccctatattctctgctttattttcctccttagctcttatccttatctggaatgttgtgtattaacttgtttcctccatctagtttataaatgctatttaggcaggggggttgtttcttttgttgctaggaccattgtacctaaagtagtacttgacccatcatagataaactatccgtatttgttgaaataatgatgccacctataatcaaacaaattcaggacaaatgaccaaaatttagtgtttatgttgaacaattatgaccatcaatgatcaatcatgaatgtggattacaatggaattttactttgaaaattttctaaacactagtttttgttttgtttttgtagcccagggaacaaaggagggcactgagagctgtgagtggagatagcaaaacaaaaaaacaaacaaacaaaatcgtctatttatcctgtccttgctttgggttaccatgcgaagtcattcattacttttagaaataattcatacattgctcaaaaaggatatcctgcgtgtttgatacaaagggcatttatcatattgaagcagctaaaacttttcaatcccatccattaactcacgaagctgcaagttactgcgacgctgccttgcccatctatttagtatttccaggcaatcatggtacagtacaaagcaatttgtttttatataatttccttcatgctcgcaaacacaacatgcatcacagggaaagccaatcatgaactaaagagaaaaagggatgatttaaagcgggagagtggttcatttgctttggggcatgagaaacaattatttcaagaggccagggtttctgtgggaagtcaggtgaataagaatgctagtgctggccggctgctttctcggagaaactgctttgcctaagtaacttcttcttttgagaggatttcttactgagccataaatgcttctaatgtgaggaaggctaaatccgcctcctataaacctgggagccatagttccatttctccccatctttcccaaagatcatctcctctaccattgaaggacaatgggaaatgctgccgcttttatcatacgtcctccatctgaaatgcacttggatttcagccacgtttgagaacctaatcttccaataaactcctttagctctatgagagatttccattaatttatttatttctgtgcttgtttgttttttgggatgggtattagctcatttgccatcctagatacctattttttaacttccttggtgttttactgacaaatataacttgtcatttatttgatttctgtaataagctgcaaagtacttatggtcccttttaagtgtagggcatggtgctgggtttaggcatggggatggtctcaggagactttgctggacctagagagccaggtaggatgggtccttaagcccaaatgcattgcttgtgggggattcaaagacttatctaagattcctttgaattcaaagggggcttgtatctaaggaccctcgatgtccctagccctttgttccctgtagtgtcacttggttatttcggccacaaagtctttgctacactggtttccataaaattcatgcaagcgaacggtgagtttaatccacgttgaggaagatctgaaggacattggagtgcccctgtctcttaaggcacagtccacatgacacgttcctgggctctggtgttcttcctgcttttcctgccttcagtgaagaacttgttcatgtcttcttttcttcccacctttagtctccttttctagaagcataaacacataaacagttcacgcctgtagtcccagtactttgggacgccaaggccggtggatcacctgaggtcaggagttgaagaccagcctcaccaatatggtgagaccccgtctctaccaaaaatacaaaaattagccaggcctggtggcatgcgtctgtagtcccagctactggggaggctgaggtgggaggatcgcttgaactcaggaggtggatgttggagtgagccgagatcatgctagtgcaccccagcctgggtgacagagcgagacactgggtcaacacacagacacacacacacacacacatagatatatataaaaaaaatagcaacagttttccgaaacatgtttcagagagcttttggcttctgttgctctctgtccatcaccagtctccagcaggacccgcctgctctccaccctatcttcgtttctttgtctgaccactcatcacctctccgcttccactctgagtctgcaccagtctcttctccacacagcagcgaaaccagtgttccaaaacgctgtcttgatcaggttgatgtccctgactgatagcttcagaggctcaaggtcaaacatctttcccaagatcaggaccaaactccttcctatgatctcgcaggcccctgccctcttcctctggctcattccccttctgtttcctcttcctgactgtatactagctgcaagagtctttcattcccttgaaagtattttgcttccttccatcacagagtttttgcacaggccgttcctgtacctggaacatttctcctccctcggtctcactaatctctgaaaccacttgtgtctgtagtctggtgatgcatcttcagtgtttaacaaaaattcatggcacttactaatagaagatgctcattaactactgaaggaatcagtgaatgaatgatcaataaatgaataaataaactgggagtcctgaggttaccgtcatcttgatataccagtgttcacataaggagacccaagtgctctgcagatatttgtcctaaaaagccataggtagttgcaggttattacaggttttcttcctctgacagcccagaggacataggagcctgacttcccagtagcaaagaacacacttagcatcctcatcttggtttctaagaccattctccaataaccccttcaaggtattgctgattacagatatatattctgtattctttttttattattagtatactttaagttctggggtacatgtgcagaacgtgcagtcttgttacataggtatacgtgtgccatggtggtttgctgcactcatcaacccatcacctacattagatatttctcctaatgttatcactcccccagccccccagcccctaacaggccccaatgtgtgatgttcccctccctatatccatgtgttctcgttgttcaactcccacttatgagtgagaacatgcggtgtttggctttctgttgttgtgatagtttgctgagaatggtggtttccagcttcacgcatgtccctgcaaaggacatgaactcatccttttttatggctgcatagtattccatggtgtatgtgtgccacattttcttcatccagtctattattgagggacatttgggttggttccaagtctttgctattgtgaatagtgacacaataaacatacatgtgcatatgcctttatagtagaatgatttataatcctttgagtatatacccaataatgggattgctgggtcaaatggtatttctagttctagatacttgaggaatcaccacactgtcttccacaatggctgaactaatttacactcccaccaacagtgtaaaagagttcctatttctccacatcctctccagcttcttttgtttcctgactttttaatgttcgcccttcgtattctatattctttcaactagaagttggtatatacaaaatgatcaggagcaacttctatttccaaaaactaatggagttttcacaaaacaaaatgggtgtaggtcaagaaaacacatgggccaaacttaaagaactcctaatgggcaaagctgaagcaatttaaacagcagaagaaagtagcattagattatgacccaaagtattaaaataaatattcatgagtcaatagtgatagaaataaatgcatggataaattaatacatggaagtagagaaacaaatctcctgtgcagaaaaatcccagataatgtatgcacagccttcatccttgaagaggtagagcatgattctccatctttaagcactgcttttacatggtggctttcttccagagagtacagcatggagaagggaaggaaagggagcaatgttgcaggggcaaaaacctgccaaaaacatcctcagccaacagatcagggtcacgtcagccagcatgtcacattaattgttggtacccttgatcacttaaccccaggagattgaggctgccgtgagctatgattgtaccacagccctccagcctgggcaacagagcgagaacttgtcttaaaaaactattaatatattgggagaaaaatgctattttccctctgtggttttcctccccatacctataattccagtctgattatgaggaaataaacatcagatcaattcaaaattgggggacattctgtaaagtacctgagcagtacatcttacaaccgtcaaggtcttcaaaaataaagaaaaactgtgaaatagctgcagccaagagaagcgtagggagacatagcaagtaaagataccattaccgtggtatcctggatggaatcctggaacaggaaaaggacattaggcgaaaaacaagggaatcattccaagtgcagactttagttaataataaggtgtcaatatcggtttattaatctgacaaatgtccccttccaatcaaagatgttaatactagggaaagtgagtgtggatatgtgggaactctctgtactctctctgcaattttttctgtaaatccaaaagcgttctaaaaatgaaataagtctatgaaaggaaactaaaagccacaggcaatcactcctccagcagcccggtaatggattcccccttccccgtgccctgggccaagactgaactgtgattctgctgtcctgcacccggggacctctatttggagcagtatttggccaagggaagcagcgctcactctccccagtccctcccctcctgccctgcttgcggattttattttagtttgcttccaatggcactcagctgctgctacaggcaaatatctggctgctttgcacgctattgtacaacacactgggggaaaatgagccttcgtgctagagtctgggtccctgagcaaataaacagagaagaaaaatggtgcatgtgggggtggtgaggttgagggagagactggggagccaggtgattgagaagttagtggctaattcagctcagagtttgggcagaaatcctatgcttctccccattcaattttccttattccccggactcctcagaaacacccagcttattggtgggggtaaagagggtattgttttcctgggggtttctgttccaaggataagggagttggaaagagctgttgagggtgtctagccttttttactaggtggaggtcgtctgcacaagcgctctctctcttgcttgctctctctctctctcgctgtctcgctccctcttgctcccgcttgtgctctctctctctctgtcttgcttcctgctttctgagttctctactgagagctggacacagatgcagtggctcatgcctgtaatcccagcactttgggagtcctaggcgggtggatcacttgaggtcaggagttcaagaccagcctggcgaacatcgtgaaacaccctgtctctactaaaattacaaaaattagccgggcgtggtggtgggtgcctgcagtcccaactacttgggaggctgaggtaggagaattgcttgaaccctggaggtggaggtttcagtgagcttgagctgagatcgtgccacttcactccagcctgggcaacagagcaagactccatctcaaaaaagaaaaaaaaaaaaaaagaaattaatggggccagagacctttggaaatttcaatggttgtgtcaaagcaacctgaagtttcggcttcatcaacttccagaaccctttgagagtgtaaaggtgaagaggaggctctgaggctgcctggatgtaccctccaactgtgtggctttgtggaagtcgtttaacctccatgaacctcagcttcctaatgtgcagatccatgaaacactgacacctccttcatgagactgtgtaaaaattaaatgtatcaacccatacaagggacttttaacagtttctggcatcatgtaattttccagtacatgttacccctcctccaaaatcaattatgtatactttaatatgttaagtggtaacatttcacattttaccttctcttcatgtaaggaggtggagagccattgtcaggccttgtctcatcttagaaaaagattagaagttgccagcttcaacataattgtcattgagagggcttaaattttgtttggattaataattcactaattaatcccatagataaagatccagctgaagagtctcattttttcattattaacaatttgaatagatttcatttattgagcaattactatgagccagattctttacagagtgcttaaggtgattatgtctaatcctcccaacagcaggaggtagatactattattcatttcacttaccctaatgtcagagaggttaagtgactttccaagcttgcaaggctagtaagaggtgaagctggagtttggaacagggtttacagagtccagagcttgtctcctgatggatatgctacattgcttctgtttgtgaatttagagaagagtggtttaaaatatcttttatctctctgtttttatggagagaggggagaaagtgctgtttgacgaagatttattgccggagggacatattgagttcgaaacatgaagggtagcaaagctgagattctggcatctgttttcttgcttgtttatcccattgctctgtcggcgcctatagaaggtagctggtttggtttgagttccttccaaaacctggctctaaggaattaatccctaataacaaatgctcagcttgttgttgaaagggtttttgtttgtttgtttgtttgtttgtttgttttgagacggagtctagctctgtcacccaggctggagtgcagtggcacgatctcagctcactgcaacctctgccttccaggctcaagtgattctcctgcctctgcctcctgagtagctgggatgacgggtgtgtaccaccaggcctggctaattgtttgtatttttagtagagacggggtttcaccatattggccaggctggtcttgaactcctgacctcaagtgatcctcctgcctcagcccccaaagtgctgagattacagatgtgagccactgcacctggcctaaaaagggtctttttgactgttggtgatcttcattactcggtgaaggtggagactttcagccacctgataggaggatttgcagtgacttgtcttaggatgggagcacattctcataatgaaagacactcttcccaaaatgttaattcttttggtagccacatgcttgtgttaactattgctttgccactggtgtatggatacaggaaaaagcacttgaaccagaaaacatcagaccaacatgtcctgcaatgctttattcctattgctggatgtttctgcaagtaagtcactctaccaacctttcgagcatctactgtcttccacgaagggatcaggcgtgtatataagccagccttatacttatacttatacacagccgacttactgtgtttgcgacctggcatcatctaagtcaaaaaaactttggtgatattaaaaaaaatgccctcaaaacaacttaatagtatttatagaaattataaagcttcatccagtgcctaaaatgaacattgggatgttagatcattaaattaatgggatgtgatctatgtcctccgtgatttcaaaaacaccattcttttaattgttaattagagaatgtagtgattacagaacgtgaggaacaattttgcttattttcaatatgctggttgtgattatgtgaattattaactctgagcagcattcaatttcgttcatttccatggctttatgaactatttccagtatgcatctgttcttgttttcaattaaaaaaaatatagatttcagcctgtaccttgtaatgaaaataggaagaagcaggaaatgaatttcttatacatcattgtgtaatatttctttatagatttttttttttccaatgtggacctgcctggagacctgtccatgaaagatcatgaggtgccaaaattctcgcaagaaaaacttggactgttattggctatatatttaatactattatacttgcactgcagggaccaaaagtttcttatcaaatttattgagatgattttaacattctgaaacagattgtccacactatatttggaaaaaaaaatgtccaagtgatagatggatttacagcttacacctcaggtttttattatagttgacatttacacagtcttgaaagtctctactcctctgttttatagaaatggcaatgccactcagtctcatccaatattattatggagctgtaacactctggtgaaggatggaccatctattacttgacaaaccctttgtcaagtatatcatgccgtttcagaattatctgaaataatcatcacagaaattcattgacccatcttatgttttgcgaatgtatgctcgaatgttaagaagctattcatttgtttttctcagatgactaaggatggggccatgtgccacagagctccatgtctgcttttacatagttatcattgtgaatggcgccccctacagttgttcagtgtgtagtctgaaattttggagaccctgagtttcttgacattgtttgagccgaagaccgttatctttacttcaggggtggtcctttcacatcttttttattttattttattttattttatttatttttaggcaggtaatttttgcatttgaagagactctgaaatgaccaagctgagccgttgccattaatcctgtttgtctaaaagtttaatcttgagccacccctctcagcaatgcattgccactttctcatacattacaaatatgtaatatgggcaaagtaacgaatgtcatgttatcaggttatgtgtctcaatcactgaaacaggctcaaaaggaatgggacccagtgtcgaggagaagaaaggcacagaggaaagattctgacacttgaagcactgctcagcagggcaaatttggggaaaagatgtagacaagaactttagacaccaggaacaagattgagaaggtgctgagaaaagatcatggctgggccaggcgcggtggctcacacctgtaatcctagcagtttgggaggccgaggcgggtggatcacaaggtcaggagttcgagaccagcctggccaatatggtgacaccccgtgtctactaaaactacaaaaattagcctggtgtggtggctaatgcctgtagttgcagcttctcgggaggctgaggcagaagaatcgcttgaacccaggaggcggaggttgcagtgagccaagatcgcgccactgcattccagcctgggtgacacattgagactctgtctctaaaaaaaaaaaaaaaaatcatggtcaatcattcttaaagctggctaattagtgttacctggagagctttacaaaccccctaccttatctttataccaattgaatcagaatgtctggaatgagggcacaggcgtcagtgtattttaaagatttccccagatatttcttatccacagccaaaattgagaaccactgggctggaggagtgctagggaaggaaaaggaatacaggatcaaaagaacctttcatttgtttattgatccagccgtttttgttttttttcactcattcattcaacaaacacttctcatgaagtccctgtgtgatatacactgttctatgatttgaagatacagctgagaagaaaacaagcaaagccttcatgctcaaggagcttatgttctagtgtcctgaagcaaatcctttctgactcaatagaaatcaggttcacgtggcaattataacacatgacctttcattaaaagcatgacagaatcattttcatgagattgttaatttggaccacaaaacaagtcctgcccaccccacgcccccccaaaaaacaaaattaaattactaaaatttgatgtaatcgatgcatatcacatctatttgtgaaacactgctgtttctaatgcccgtccttcctctaagtactcttcaccttcatttgcctaattcttcaggagtaaacttgtaaccaaaggcaaacatcttacaaatttgatgatacttagacctgcttcccaaatgcttgggaagttttcataaaattgaatgtacataaataatacatggtcaggggttcggagacttaggcaaggtgctaaatttgtccaatatgaggccacctgctcgtatgtcatctgttggcactggctcacgcatttgtgtgccaggacatatgaaattaagtttacctgatgctctctgacagcagctttctgttacaacgtgcaaattagattaggttaaggtagagggcagagtaaatggatggcttcatagactgatactagaatcctgacggctttaaccagaaggtgactggttctggtctagcttgggtcattggtaatcacaagttcctgttattgatgcctgtgcagtggcctgtggggagatggatggcttattttttattgaattttgccgttatagccaaacatcacactggcagtgcaacttcattgaccttcaccctcgaattcgaggaaggaaggtcgaggtgtaaacagaggatggagactaaataaggtagttgtctcttgaatgttgcttggtcccccttctaagtgtgtgatacatgagcaaggctaaaaggttgtacagcctgccacctgggaaccacctcccttgggctgaagctggcatgattacttgggtcttcaaagcaggcgtgcacagtttttctctcaatatgaaatgatctaatgcaaacttgaaattctaccagaagaatcattttttaactttaaaggaatctagagttgtctctgcctcattaagtaactcaattggcttcaaaagcattttttatttatattgaaaatatagaaactgtcaacttcatcctaattttgaagactttttttctataatgtggccttccgttgtgtagtaaacttagtaaagcacctgttgtacaactcaatggcattccatcccaagggatggtttaatggcataaacgaagggccgagggaaaaataaattcagatatttaaacagactaggcaccataccctaaatctttgcttgcaaagttgaccagtgatgcacagaatgaggcagaaatactgtcaaagggactggagactgatctcgagatgttctagcgtggaatggatgggtttacttatttgtttaaataattgcgttctttggaattgcctaaattttgcacttctgccggtttaaatagagtcgaattgaggttgtttctggcaagaatgagtgtcacatttttgaagggaacagcagtgacagcacaacaacagacagttcggagactaaataccattttttaaagtttccgaagattaaatagaaaaacactccggggcttagctaaaaggctaacaggagaaacgaatttcacgtagaaatcaatcgctctgttcactgacacccagtgacagaactaataattgtgtccatgtaaaatcagaccctcttgttactttttaatgaagtctgtctgattctgtgatatttttggcctaggaaatgaaagagatgttttattaaatgaaactaggtctacataggtgaagtatctgaatataactatgtaatcatatcgtacaataaaaagaaaatataaaaaaattggaaagacatgaatgtagttcaaataagcttatccctccaagaaggcttctccgtgttttcaatggaatagtggcctgtattttgcatttgaacaatggcacaaagccattggaaggggaagaaaggtttagcctacccctcttggatccttatgccacaacgtctgttccctgctgtactgagaagtccaactctcctttgcaagccaggaaaaataggacctttttcaaattgcatgcttcgaagatgctggcagaattcaaaagtgctttctccacacagtataaagccctttacctgattaaagctggttatttggcttgccaaggtgaaaagttttcttatgttttatcttgcattttccctctcttcttccctcatttcctctcctcttcctctttctttctttctcatcttccctccaacattaaagacatttggtgcaacctcagcattattatttttaacacccaccttgccaagaagagtataactccaaggaagcttcttttttaagcagacctcatctgttctctgttggtccctgagtggtacctttcagctggccatttttccccagcggtgcatgtgaacacatgtgcgtgtgtgcaggcatgtgtgtacacacactttcatgttgatggagacatatggtcatatagaggatctttgtggtccatctagttctttagtttcaaatgtgatgtgttttatctaatatctgaaagggaaacatctttctgtgtaatttctcaccctgaattacacatttaaaccccacaaatatcagaggacattctaagaaataccttgtgggtggaaaagttgaccttttgtttccctctgcctggttggctgacttgggagagagtaactgaaggcaaagggaatgtcagagtggaggaaattcccatcctagactgggcgaggggcagggggtgtggtccttttacgatattcacccaattcagagcgccctacttctgttcaaaactgtgataagaaatatcaatatgggcatatgacagtatgtgtgggagggtacctccttcacttgtagcatctcacagggagaggtcttggcaaaggcacagtcatcaaaactgatgagcccaaaatgggattcacccttaaaaaaaaggttttgataaaattagctttcctcttaacaatctgggagtgctatcagaatagcagctataaatctgtctggtagggccctctcttcttaaaatagatggatgggtagatgaatggatagatgggtagatggatggatagagggacagatggatggggggataggtggatggatgagtaggtggatgaatggatgggtggatggatgtttggatgggtggatgggtgggtggatggatggatggatggatggatagacggatgagtggatgggtggataggtggatggatgagtagatggatggatggatgggtaggtggatgggtagatgagtgaatggatgggtggatgggtgaatggatgggtgggtggatgggtaggtgtatggataccttggatacatacatgtaatacatttaaattcttaataggtacatcttatgctcttcatgtctctttctctggggaggggcactggggtgctgacatatgctatctttttttgtggttaagaccataaggatgagaccacttcaccaattcttctaggcatgttttgaagcaatgtggtatagtggaaagaacacaggatttgaatcactggaagccagatttaggtctgagcaccatgtgctttttagcttgagtacctttgctcaagatggttaacctcagtatccatgtctgtaaaatggaaaaatgttttctaacttgctggattgttgagagaattaaaagatatctagatctaggcagatagtgtttaactcaatacctagaatagagagagcattttgattaatgggagctacagctactacttcaactgctgctaaggatctttcttgtttttactttcccctccttctctgggtgttttttttttccacgatacattttagaaatagaagccacattctaacttctttggctccttgcctgactttcatatggtctctggtcgagaatggtggccattctatgtgtgtgtgtgtgtgtgtgtgtgtgtgtgtgtgtgtgtctgcctgcctgtatctatgtctgtatctagaaaatatatatttatacctggaacatatgtacgtataaataaaattctggaagatgcatcttgctggaagatatatgtcttgatatgtatatctggaaggtatatatcttgtttttcccttgcttttgacagatgttctaaactcaccataccttttggatattgaactataaagacttctacattcctattttatacatttagaattgtgaatattgtaataaaaattcctctgacatttctcacatactacagacatcatgtcccctactttttcttcatggagagatatgagacaatgttgaacaacccagaataagccaaaatataaggaggtaagaatggattcgttgtctgaggctcaatatgacaccacctgaattttctctatatcacccttcaagggggtgaggatggctaagaccactgatacttatgtcatagcatgaacaaataataactacttaccatgtgccaggttcttctgcaggcactttacatagataattttatttaatcttcatagcaaacttagggagtagatgctagtattatcccaagtttacagaggaggcaactgagtcacagtaagctgaaatgacatgctccaggttgcagaatgatcataaagcagagccaaaattaggcaccagtgtcttttggtgtcaggaatctctgcttttgtgcttttctgtctcatgaaaatatcagagtggctctctctattgggtctcattattgcatgccattgtgggttcttctgactgtgtgtcacctttcacaaggagcatttcctacactgtgaaagtgcacatgacaattttatgtacttcttgttgaaatccttgtcttccttatgctgcccattggtgcttcacactattttcttcctcatcccacttccgcagcttgtagctcctgcctgagctttggaagtgaaagccaaagttccacctcgatgcaggtgataaaactagggcaaaatgaataaagtgagagctttgacgtcagcacgtggaacacatacacaggttatgctgaattgtaagctggacattatgtcactgtaggtttagcccttcttggattttctttgtttgtttgttttgttttgttttgttttgttttgtttttaaggtgtagtctcacaccgttgcctgggctggagtgcaatggtgtgatcttggctcactgcaacctctgcctcccgggttcaggtgattcccctgcctcagcctcctgagtagctgggattacaggcatgcaccaccatgcccggctaattttttgcatttttactagagacagggtttcactatattggtcaggctggccccgaactcctgacctcatgatccacccatctcggcctcccaaagtgctgggattacaggcgtgagccaatgcgcctggccccttcttggattttcttatgcatttgaaatcaggtaaagctaaaattgtgaatatgtaaataaaaataccatgagaacatgggagagggagctggggtgttttgctttcataggatgggagccaatgcctacatgttttctattgtatcttttggacaggtagaatgattgcaattgttaaaaaaaaaaaaaaatagggaaaatgatgccaggagcagaaagcaaagatgttttcaaagagtcagaaagactctgttccaaccacaaaccatcctatcttcccccagttaatggggttgcctaaatcgtcaactcctactgtgaaactcaaacccttgttgttccaacttaactttttgcccacagagtagtttaggacaatccaatgtcagtatggcaggtagaagtagcacaaagtaagatccatttgtgtcttgatttgagggacataaatgtcctattttctttacgtgtcttggtcaccccctcacacaggctctctgaagttgtttccgtcattttgtacccttcctcttcttctctttgtaagcttaagtttcacattcattggctgtttttctctctgaggtttcagcttcaagggattatgcatatgagacttgtattatataccctgaatgaaaaatattgaaaatatctcacagctagctggatctctcttaatccaggctttccagaaaaatggtgctgggaccacccctggaagctcagcctgccccaaaccccaggaatcttcagtctgcaagggcagaaccagataatgaaatggcatgctagcaggtagtagttctctgatctaaccactgccacacataaaaaatgctgcagctttgatttgggttttatgtcctgtgattacacggatcgtgctggttcctaatgtagacctttccagttctctgggtgtgcacctctgcatccacatctccttccaattcatggaacctcctttatttcttccctgcctgtaattcttctgctctatgatctgagcttccactcatgcccttattatttagctcttacattcctagaagagtatatgtttatctattttaccactttgggcattgtcatatgtcataggttcattcaccattcattgaacaaatggttatcaattagtcatatgtaccagtccatgtttacacatgacaggcacatcaataggtaagagaggaagagcccatgccctctgtttcaatgttggtagtaacatggcttgtgaaggttaaaagaaaaacccagaagcaacctagtcttgtcatcaaaatgagaaagtaaagatggattgtggtaaagtaacgcagtggaatactacagagcagtgaaaaataaaccaggacgaatctcacaattttagtgttggaaaaaaggaacaataggatgtgttatcctcacttgtgtaaaattgaaaacatgcttgtgtaaaattgaaactatggaaaataatgtgaaacaaattagtatatttcttagggatatatgtatatatacatgtatgtatgtgtgtatatgtatatatgtttgtcagggataactaagggattcctaatctattggtagtatttactaacttgggcataggaagcagatacatcttgtattaagtaatatactgcttatgtgccttaaatatctcattttaattttttataaacaaaattgatatgctcacttcaaattcacctaattttaagggattgaattattccttagatgtattctgctgaacttgctgggtcggatagtgtaaagattgaaaggattgatttaaaaaatggaaaaacattgtgaaggaaaaagaaaggaggcattgtttgagaacgtttgtcttagacatagcatctctacccaacagtgcaaccactcattattcctagcattgagggaagaatggttaattttggtgaaagttctagttcatatgaattcctctctttagtcctaaagttgttgggagtgaagagatctttccatgtcctcgagggctggtaggaaaaatctgtgtcttgttactaccatgttcccccaccatctttcctttataagttttaattaccctccaacctatacctcatgtaaagtttttcactatcacgcattttctacaccttctatgtacgtaaatacacatatatttttaatactcttacctatcttagtgtcagttccagacatgttgcctggttaactttgaatacttcagtgtgttcctaaaaacaaggacctaaccacaatacaattccaaaattaagaaatttaacacactggtatagtcctctggtctcatccacagtttgttttccaatttcatcaattgtcccaataatgaccttgatggcagttttgttcatggtccagaatctaatccatcatgcatttcatttagttgtcaagtctctttagtgtcttttaatccacaacagtgacagtcttgcttggtcttttatgatcttgacatttttttaagaacacatacgctgggccgggtgcggtggcttatgcctgtaatcccagcactttgggaggccgaggcaggcggatcatgagatcaggagatcgagaccgtcctggctaatgcggtgaaaacctgtctctactaaaaatacaaaaaattagctgggcggggtggcgggcggctgtagtcccagctactggggaggctgaggcaggagaatagtgtgaactcaggaggcggagcttgcagtgagccgagatcatgccactgcactctagcctgggcgacagatagagactccgtctcaaaagaaaaaaaaaaaaaaaaaaaaaaaaaaaaagaacacaccctggactgcccattgccgaatcacctgaagagagcccttcaattttaactaatcatttttgcaagcttagttgtttcagctgctacaaaaaagcacgagtcttttaaaaaggagtaaaattctgacacgtgctacaacatggacaaaccttgaaacattacgctaagtgaaagaaaccagtcgcaaaaggacaaatattgtatgattctacttatttcaggtacctaggatagtcaaattcatagagacaaagtaatatagtggttcctagggaccagggggaggatagaatggggagttgatgtttaacgggtatagaatttcagttttggaagttgagaaggttttagaatactgataatagttgcacaagaatgcaaatgttcttaatgccacttaattgaatactttaaaataattaaattggtaagttttatgtaatgtatattttgctacaattttttacaagagagtgggtcctcaatatgtaaatataatgtcaattaaaataacaagaaaacacaaggcagttatttactttgtggatgaccctcaatttgggtctttcagctgtttctttatgatcccagttggggtgtgcatttttgccagggatacccccaagtaataatgtcctgtttttcccagggtgccatattaagagacacatgatattagtttgtctattattggtgatattaacatcagtcctttggatcatatgatgtctctcagatatctccagtaaaaactttctcactgtaattaatacatagtttgggggtgggaggaatggttttagacttttaaaataccgatttgtcatcaatccttcattcactagttttaccattcattgatgattcttgtctgagtcaattatgattattacggctatcaaatgatggttttctaaccccattgcacttatatgtgtgggttggcattctatttcctttcctatatatatacatttaattacttatttcagtataaagtcatggattcgtgtttttattctatgaactacaatcggttactttcgttatttgttttgatgctcaagttgtatcatatgtattcactgggagccccttcaagctggctcctgtatcattttgacataaacccgtaagttttttttaataacatccttattccttggcaccagaagatattccaggtatatcttgacttttcttgccccagtcctagagccaggaggccatttttccacagagtaatccttcctttgattggagagtggtgtttagaaacaaagttctgggcgattatggcttctggaccctctaaatagacaatatagatagaactaggaaaaaatacacacatgcacatacacatgtatatataattatcttttcaaagccaagaatttgttaatccttcctaaggattatgttcttcccaacaggatacattatctaggttaaaatttccctgcctatctgatatcacttgttattacgagttatcttttatctgtctgttaggctgtgagacccttcagaagagagacttcatattttttgtcatctttgtatccccattgcctaggaagatgtctggtacagattaggtactaatattaattcataggattgttgggtgaaacgatggttgaatgaaaggatggttggttaggatcattgggtaggagggtggatgggtggagtggagattcgatggaaaagtatagttgggtgggaggatagttctttgggatcctgggtaggagggttgttgggtagaatggagattgggtggaagtatactcggatgagagggtggttggtaaggatctttgggtaggagtattgttgggtggaatagagattgggtggaagtatactcggatggaaggatagttggttaggatctttgggtaggaggatggttgggtggagtggagacttggtggaagtatagtcggatggaaggatggttggttaggatctttgggtaggaggatggttgggtggaatggagaattggtggaagagtatagttggatggaaggatagttggttaggatctttgggtaggagtattgttggatggaatggagattgggtggaagtatagttggatggaaggatagctggttaggatctttgggtaggaggatggttgggtggaatggagattgggtggaagagtagagttggatggaaggatagttcattgggatcactgggcaggagttttgttgggtggaaaggagaatgggtggaagtatagttggatggaaggatagttggtgaggatctttggataggaggatagttgggtggaatggagattgggtggaagtatagttggatggaaggacagttggttaggattgttgggtaggagtattgttgggtggaatggagattgggtggaagtataactggatgggaggatggttggttaggatctttgggtaggagtacggtcgggtggaatggagatttgatggaagagtatagttggatggaagcgtagttggttaggattgttgggtaggaggattgttgtgtagaatggagattgggtggaagtatagtcggatgggagggtggttggtaaggatctttgggtaggaggatggttgggtggaatggagattcagtggcagagtatagttggatggaaggatagttcattgtgatcactgggtaggagtattgttgggtggaatggagattgggtggaagtataactgtatgggaggattgttgtttaggatctttgggtaggaggatgtttgggtggagtggagattcagcggaagtgtatagttggatagaaggatagttcgttgggatcactgggtaggaggatagtgtagaatgaagattgggtggaagtattgtcggatgggaggatggttggtaaggatctttgtgtaggaggatggttgggtggaatggagattcggcggaagagtatagttggatggaaggatagttttttaggatcactgggtaggagcattgttgggtgcaatggagattgggtggaagtataactggatgggaggatggttggttaggatctttgggtaggaggatggttggtggaatggagattcagtggaaatgtatagttggatacaaggatagttcattgggatcacagggtacgaggattgttgtgtagaatggagattgggtggaagtatagtcggatgagaggatggttggcaaaatctttgagtaggaggatgattgggtggaatggagattgggtagatatacagttggatggaagaatggttttcatgcaagagcatttgggttaggggatggttggatgagaggagttgttaagtggaagaattgtgacgataaaggatcattatgtgggaagacggttgtgtgggatgtggtctgcatgtcttatttagcaatgtatgtcttttttgttatacttctgtactcattgcattcaggtgctgtttaagaagttattttggttcctttttgtctttcagatagtaggtgttcattcagtatctattgactgtgtgactatgactttcaggaacaggaatggatgatttatctttcgattctttgcattctccatagtgctcagcttggcgtaaatacagatttaatattcagtttgacagtaagtcagttagaaaaccacagcaacataatatctgccctatttaccttttaaagaaaactaaggatgctgtattagtttcttcaacactgagtgtggacttgattcattgtctctggatattcagttgccccaaaattattcaagtagtctacttggcaagtatttcaagaatggagggcattgtttagccttgtaattattcattggctcatgtaattaggagacaaacttttgctttggaataagggttacaccacacaatttgggatcattttgtgatcaggcaattgaataggctagaaagaattcctttactgatggatagacattctgaatacctgttttatccttttctattttctcatactaagaaagtaagtagcaaattcttctcacactgatattgtgaacagaaaggaactctactatttttggccatatatatgtttttttaattttggatctattatgtgttctagtgtctttagagaaaattttcgtaattgaaccttagaagagaagacaaatgctgtgtaatgtacataagaacaagaagacgttactctagctgaaaatgtcttttttccacagtactttatatcctggccaactgctcttgtgcaaggcgaccaagtaacattttcccattcagctataagaacgaagagactgttattgccactggctggtattgagtaatcgtacataggtggggtgagttgaaggcaatctgaattataaaacaccttcctttgaagtcaaatcaatttttattcttaatctgtgaacatgagatgggaacaaataacttctgagtgaaataaagatttcttagcctgtcaagatttatcttatcaggctgaagaggtgggattcctgttagcaactggcagttttaaaaatccattcgcctgaggaagtgtgaaaacagtctgcagaacaaagacactgagctattgctgcattgagtgcttatttgctccttttttacatttcctgcttgagacctcgccaggtccaactttaaaacgtttgcaggctaatgggagtgtgtgcacagggagtatcagaaatcatttccttaggggaggaggtgttttgtggtgcaaaatgttgaggttctgttgccaaaacaccaactgcaagagggtattttctgtgaacttcatgggtggctttcatagggaattctccatgtcattctctgatgtcttttattggcccttgttttgccagagtggggaaaaaaaacaaaaacaaaaacaaaaaccaccttccctgtgtcatttctcttttaacaaagaaagccaaaataattctataaatgaaagtcatgcacatgtagaactttgggtgcagctctagagtattttttttttttaaccctcctaggatgaagccaaaagaagaaaactggttgtatttctctaacatttttaggcagatgatcgtttctgggcagggggaaaatgccaaagcctgtgcagtttctctttcggctcatttgaaaatactctaggaaaagacccctgtggattctctgccccttctgtaatgtgtggaatcatgtgattgctggacagcccccttggaagcctgccagcccagcctcttcagcatccagatgggaacccggaggcgcatctcacagcggaccgttgattaacccaaggtcacctggctctggtttctgacggagcgagaatgagtacccagaggtttccagaacctcagcacaaagggtatccatgatgaacaggcatttccctatcccttctctctcctgtcccctgcataaacaatgcaaaaaacacactcccttcttggccaggacccaaagacctattatcctacacatgtctttctgtgctttgagggatcagcaggggtgccagtgaacttggattactctttggatcaccctgctgcctccagctccccctctgttttgtttcatgactcagtcatcctgtttgagctcatttaccacttgtataggggtacattccttgacttctcagagcaaaccaagcccccatccatgatttcttcttcttttacaatgagctctcatatcacatttatcccagtggaaatttcatatcaatatctgtgattctttgactgttctctctttcccctagactccaggatccttgggatcactggccttgtcatttatgttcctgcttatgtcctatagcctggcacttagtgaggcggtgtgttgtgttgggttttgtttgtttgttggttggttgttgttgttgttgtttgcaagggcccctgcaaagtatcacaaactaggtggcttaaaaaagcagacatccattctcttgctgttctggagcccaggaggctgaaatcaaggtgttagcagggacatgatccctctgaaggcattaagggtgaatccttcgttgccttttccagtttctggtagttgctggcattccctggcattctgcggcttgcagctgcgtttttgaaagctgcctcactcctaacctctgtttacattggtgtctgttcacgtcacctgtcctctatgtgtgtatctctgtgtccagattttcttccgtttgtgaaaccagcagtccttggtttagggcccaactaatggtttcatgactcctgtgttagcttcctagattgcagtaagaagtatcagaagctcagtggcctaaaactacagaaatgtgttttcttacagtgctggaggctggaaatctgaaatcggggtattagcagcgccatgcattcttcaaaggacccagggaagaattcttgctttcctctttcagcttctagtagtcgttagggatctggcggccctcagcttcgagatgtgtcactccaatctctggcttgggtatcacatagccttccctgtgtttttctctgtctccaaacttccttcttcttataaaggtattggtccccagactgggctcggtggctcatgcatataatcccagtactttgggaggctgaggcaggtggatcactttgaactcaggagttcgataccagcctgggcaacatggaaaaattccatccctacaaaaaaaaattaaaaattagctgagcacggtggcctgtgcctgtaggcccagctacttggaggctgaggttagaggatcacttaagcccaggaagtggaggttgcagtgagccaaggtcatgcaactgcactccatcctgagtgacagagtgagaccctgtctcaaaaaaaaaaaaaaaaagaaaaagaaaaaaaaaggtatcagtccctgtatttaggcctcatcttaattccatatgaactcatcttaattacatctataaagaccctatttccaaataagcccacgttctgacattctggggggccatggatttctgggggttgttatccaacccagtgtacaaggcagtacacatttattgaatgcatgaatgaatgataatgctctgggccctggcaagtctcagcctggagaactgagtctgcctgcctgcgtagaatcaagaacaacatgcacttcagtggaatttgggaagggtcagggtctgtgccgacagaaatggaaaaatcctccaagcgcctcaccctctcttaaaagactcctcaagattgctttgctgttctaccctctacagtgtttttaatatgtctatttaaatgcaaattttgactttctgtctgtaatcatataaaatgtttggcactaaaattttaatcaggaatgtaattttagatagaggcggtaatggagtggtaggccacacataacagaatgaagcttccccaacgtggattcccagactatggaagtgctggcctccctgctcccagctgagccgggaaaactctgccccactccaagaggtgcttctcaaagatgattcctgatcccaggcatgtcctgtgtcctgtcaccaatcctggtgcttcatcgtcctttaaaatccaaacgaggtgatctagtgttcttcctctgcgtcctctggtcttctagcatcctggataggccgtgtatgtttagaaagaggggctccaccctgtgcccgcctaagatgatggctcatttatcaagaccaggctggaggctcagctaccagagcttctgttgtttgggaggaaggctgccagcagcagatgtttgtcctcgcctcagctccctgcagcctttgagctccatctgccgcacactcgggcacagctgccagtgcttcccctccgtgctcacctttcacctctcacggaggctggggtttcatgcatctgggcccaacagagagatggtgacccagaccctgcgatcctggtgccacaatccttcccaacagctcgctgggcatctttctgcactagcctgtcagcatgctggaagcagcaccgatggaggttgttgagcagggttgcaattgtagcccgtcactttggtcttggtgttccatcttgttagggcaagagagtcagagcacacacagccatctcctggctggatcatctggtggagtgggagtgtgcacatgcccacccccatttctaaataagatatgcattgtctcagggcctttgcaatgtccactccctagtcctcaatgctcttccccattggtcatcccagagctcatctcaaatgtcaccctttagaggggcagctgtcagtcttcccagttaaagcatatgccaaccccctcatcactcctggtctcaacaacctctttatttccctcattgctattatcttcatctgtaattctcatctttataatatctcttgaatgaatctttaggaggattactcttcctagagtgtgcaaaacggattgcagggatggtgagaggtgggcggaaatgttggaaaggggacaagggtggaattggtagcactgatcttgttgagagaggattggccctggaaaaagaaagtagcaatggagcaggaagtaattagacatagaagagagctcttcacgtgggaggtgaggagaatcggtgttgggattgtgtgttaggactgaggaaggaggaggaggaggatgcccagctttctaaactgggtatttgagtggatgggggtgacttgccgaaaataaagaatggtttgagaagaaagatgctgtgctcatcttggaaatgttgagttttgggcccctgtagaagacccagctgagatttgcaggtctgcatcaaatggagaattcatcagagaggcaatggtactcaaaaccatgacagtgaaaggtgcttccctaggagagaggcaggataaaaaaataaggtggcccaaaattaggatggccacacatcccagttagccaggatattcctgccttatacctgttgttccaccataatttctaatggcccccgcccccctactttcactttcacttgtctcagtgaactatatcgtcaccctacccgcatgagaaggttggggaaattcagagttcataggagggcataagaacccactgaaaaaaactgagtatgagcagaagggtagaaagaaaaaccggggtagtgttgggtaatgtatgccaagggtagaaaattgacaagagaagaatcattcatgtcaaatgggtcacagaggtgaagtcatgcaagtgtcaagagctgtgcattggatttagctaccaaaaaaaaaaaaaaaaagtcttgatgaccctgtaatcatgatggtgggaatatgccagagacaggtggctttgaggagaaaatcattgatgagaaactagagacagtcagttccactaagttttgttgtgcaagaagggggatatgttagaggagtttgcagacgggcatgagagaacaagagaaggttcatgggatgggaggcatttgagcatgcgtcagtcctggaaaggggcctgatggagaaagcttcaggagagggggtgtccacatgatacagcagtgttcccaagggagagagagcagatgcaggaagggacaccttccctgttaacaggcaagaaagagcaagttggggtgtaaggaagtccgtaggctttatggcggggatttgaagagagtagcatttattttctcctctgaggtaggaggcatctgagaggtgggggaggttgaagatgggaggaaagtagacagttgctttaaatagccacatggaaaatgggagaaggaattggctcattcagatgacttttattgggtgccttctgtgctccaagccctgggaatcaactagtgaagaaaacaatccaatgggactgatgttctccttggaaagagaacagtgacggtggtggaggcagcaaagggaacactggaggctgaagacccctccccaacttataatgatgcgtctgtgagtggtgaatggtggggattttttttttttttttttttttttttttttttttttttttttttttttagtagaactcagcagcttgggtctagacacagagaaaatggacaacttatggtctagagatggcagcacagaaaggaaggtgagttgaagttctggggggaaaataaatggcaggtaaagttatggaccatttgatcaaatcctggtgtgaaataaagagcatacttaggatatgtcttttgttttttcttcttttcctctgacatgcattgctatcatgagtgtccttgaacaaatctctttgggggcatacaaaaccatttctgtaaaacaggtgttaagtataggaactctgggtccaaaggagaacacataatcaatttggataaatattgccaaattgtctgttgcacattcctcaccagtttgtgctgccttcagcagtgcccaaagcgcctccttcccttcacataccgttgccaacataggccattatctttctgagttttaccaagtggaggaacaaaccaaaggtcctcatatttttctgtgcattctggtgattgcttgtcttggcgagcatcttctttttaaaataatcttgctgggggacttgtggtatgcaatgatgactgtggaagtattttagggggcaggtcagagaggagatgcctgtcagtttggggcaaggggatttgggaagtttttggaggaaatcaaatgggagacaaaagaatttgtctgagagctggagaagaaggaatagatcctagagacattttcatttttgttgcattttatttttatagatttaagatgtgtaagtacaaatttctcatgtgcatatattgcgtagtgatgaggtctaagcatttagtgtacccatcactggaatagtaaacattgtacccaaaaggtaatttttcaaccctcacctccctcccacccttccatcttttgcgatctccagtgtctattattccaccctgtatgtcatgtgtacccattgtttagctcccagttataactagagatatgttggaagtaaaatgcaacgggcttgatgaccttgcaggaagtcagcgaggagtgatcagcgctgatagaggcttatatctttggagtttgtgtgaccatgctaacttttaaacaggaggaatgatacaaaataagatgcaggtttggggttcttttccaaggtcttgcctttacctattggatgtcaactatcttcttgggtcattgaacaggagctcttcctcttggcttgtggcacagatgagtttgcttctgtcatgacgctggggacatggggtcctgtgtgctaggccaggcattgggccgatgtatgcctggggctaccgcatctgctgctgctggaactgggtctgccctgtgtccctcgggattccagcaagtggacttcatcgcattatcatgcattcacctggtcagtttctgcacgggctgtttatagggcacgggtttaatagctgtctcccctgctgcactgcagattccacgagggcagagaccatgtccggctggtcgatcatcctctcctaggaaaaggctctgcaaagttttcctgtaaagggccacacaggaaatatttcaggccttttgggctgtgccatctctgttgctattcaactgcctttgtagcgtgaaagctgccttgatgatatgtaaacagatgggtgtggctgtgttccaataatactttatttatggatgcagaaatttgaatttcccatcattttcatgtgttgaagaatagtattcttgtgatcctttttccccaaccatttaaaattgcaagagccattttagcctgtgagccatacaaagacaggcagtgggcctgcggtctgaaagcatagtttgttggtcccgtcctaaagtttagcacagggcctgtaatggcagtaaacactcatttcatattgtggaagaaaagaaagaaggtgtgtaagttgtgtttttgtgcttgctttctcctgcagagtgggtaaaggaatggtactgaggactagtaaaatgcaaagatttggtatcggtaggtcttcatcctgctcctaatgcatagtgtgacctggagccagtttgtgcagctctttgggcctcagctgtcctatctgtgtgatgaggagaagcctagcttcattaagggatgtgaaaatgcttttaagactgggtgcagtggctcatgcctgtaatcccagaactttgggaggctgaggcgggcagatcatctgaggttaggagttctagagcagcctggtcaacctggtgaaaccccatctttactaaaaatacaaaaatcagccagatgtggtggcaggtgcctgtaatcccagctacttgggaggctgaggcaggagaattccttgaactcaggaggtggaggttgcagtgagccgagatcatgtcgctgcactccagcctgggcaacagagtgagactctgtctcaaaaaagaaaatgcttttactctcaagcccactgaaaagtgttaagttattacccaaagcaggagaagcagcacaatagaccaggaagctctaaatcctgacaagccagtatttacgctgcagccagcccagggctcagctgcagaggcagcgaaatcctaacagtgagcaggaggatttgacatctggtgcccaagaagtttgttaaggttgcccagtcacttgctgacatgtgctagcaaattctcatgctttctccaaaaaaagggtatactatgggcttcgctcccacaacattttggtaaatcttccaagaagatctggctttcttcttgttaaaggaagcatttgatggcagcctggatgaaatagatatcaaatctgagtgacattattgctgttgttaaactaaagctgaacctcttaaacttggcatcagttgactctcctctttgtcagaaaacctatgcaggatgccatgtgatctggaggacacaaaagcatgattgtgtcatttctttctgtatggagtctgtgcagtcagacagttcttttctatcttgctttcttccttgggtcaggacaagtccaattcactgaatgcaccaagccccttctagaaaaacagcacagggctggacacagtggctcatgcctgtaatgccagtattttgggaggctgaggtgggcggatcacaaggtcaggagttcgagactggcctggccaacatggtgaaaccccgtgtctactgaaaatacaaaaattagccgcgtatggtgtgtgcctataatcctacctactcgggaggctgaggcaggagaattgcatgaacccgggagacagaggttgcagtgagccaacatcgcaccactgcactccagcctgggcgacagtgcgagaatttatcttggaaaaaaaaaaagaaaagaaaaacagcacaacaaacaagaagagttcagtggttacaatcaaattttaaaccaattgtcaaagtacaagccaccactaagcagatggtgggatctggtttttgttttgttttttgaagcataatggatcctctgtggtatgggaattttaaggggaaaaaaaagagaacaatttctccttctctgcagtacatttactgctgctatcactctctttctaccctgaaatgtttctgtttcaccaccattcatctctcttgattggttttgcttttttttttttttttttcttctaagatgttgctaaatttgcttgtaaagttttgtttattcattggcgcttggttgaaaggtgctggatcattaatctaagtattcaaggttaaccatgctttatgctgaaattgcctttttatggaacagatttcaaggttttgcaagagttgagtgctacctcatttttgacatttcagcaatgaatcctgtttgaaatgtgatttgaatccaatcatcatcttatttgtggaggaagataaaaataatatacaaatattgcagtaaaattgcatttttccctgccccctgttttgcatttcaattcagctagattctgctagggtggcacccagcaatggcatccctgctttaattctatctttcattttttttccctcccagaaggcttaaacatatttcctttctatctaacataagttgtacagggcttctgaagagtgtgcattgaagaaatggagcttacacaattacttctataccttattatggaatctgagggtaaacagggctttggaggtcatctaattcgtctccttttgcaattacagaattatttctttgaaggaacaaatgaagaatctcttcttccaggcctctttgtaaatgtgtgaacaagtttataagtgcctccatctcagagtgtgtgtggatgtggctttttaattaaagaccaaggcttcaagctttgctgttttctccgatctgatatagccactgttcctagtcacatcatggagctcttggtcagcctgtgatctgggaggtttcttttctaactaacgtgtatccttcccttagaactagtctgcaggggctggtaccaggcagcctctcttaagaaacttacacccagaaactgctccatttctgtgtaaatggtagccatgtccgagtgggtgtcactcaccctatttcagcagcaccccctccctgtttgctatctacaaattatctctcccctcattaaagtttggtcttccaaagcttttcaaactctcagactctcattcactctaaaatatttacagattaaccatgttcagcctcagcatggtgtcatcatgggaagatgctctcagtgtggacaagataaagctgttaaagctggttgagccaagctttttcgtatttaaataatggaaacaggaacaggcagtatgcatagttaaggacgtaggtctgggttcgaactctgcctttgctacgtcccagctgtgcccatgacattatttaacctctcttgcctcagttttccccatctttatttttgttttattttattttattttttgagacagagtctccctcttttgcccaggctggagtgcagtgccgccatcttggctcactgcaatctcctcctcccaggatcaagtgattctcctgcctctgcctccccagtagctgggattacaggcatgcaccaccacacccggataatttttgtatttttagcagagacagggttttaccatgttggccaggctggtctcaaactcctgaccttaagtgatccacctgcctcggcctcccgatgtgctgggattacagcaagtttttcccatctttaaaatggacacaataacaaacctactttctaacactattgggagaacagaacaaggtaatgaacagaaagtgataagcacagtgactcatgcgtcacgtctacacatcgtatttagcaaaaagctaagcaagttattcccttgctgtgaattatcagattctagtaccagggagctgaaatactagtctgggggaagagtgtgccaatgagatctttgtatgggacagcttccccaacattagtgtgggaattccattaagaactcatttcttttttttctttcttttttttttttttgagatggagtcttgctctgtcgcccaggctggagtgcagtggcgcgatctcggctcactgcaagctccgcctcccgggttcacaccattctcctgcctcagcctccccagtaggtgggactacaggcgcccgccaccgcgcccggctaactttttgtatttttagtagagacggggtttcaccgtgtcactcaggatggtctcgatgtcctggcctcgtgatccgcccgtctcggcctcccaaagtgctcggattacaggcgtaagaacacatttctaagcttcacactgctgtcctgttgtcatgatgataggtcaaacttactgcagcttagtttgggcgggacattttggctgggaacaccaatacccgtaaaggtcatgtttacattcttgtgtgagcctttctttaaccactgagtgtattttctatcatgattatcatccacttcttgctgtgtattggcatgagggagtctttgtcctcctccatttgttcatccaaaaattactgaatagctaattaaccccgatgctggggatacaccaaacatgattcctgcaccttttcgagcttatatttggtggaaaggatagaaaaagcagcaacaaccaataaatggaaaaataaataaagccatcacaggtggtaagatgtctgtaaaagaaaccattgcgtcccaaagagagaaaagaagttcttttagtatctccagttgttaaaatagtgtctgacacatagtaggaactcaagtgattattcactgagtaaatgtttacggtaaatggaatagtttaggtaggggaatccacaaagattctctggggatctactatttcagcagaaatataaagaattattcatgagatgatcaaggggccagatagggctgggaggaagggaagtatgggtggtgagaaaggcggagagctggaaagatattggattgtttgaggaattgtggaataaagaatctctatggttgaaaaataaagagagaggtgttggggtagttattgattccgcaaagatgaagctcagagagtacccaggaacatgactggggtcataggttctggagaggaacttggactttaattgaaatgcaaggggaaatgactaaagtcttggtaaagtcaaagtccattggcaaccattcaatgaacttcaaatccatgccttttagggttggtgaccctgaaggatgaagcgttggccttgagaataaggcagttcttgtaagttcaaccactggctttcacttacagccttcatcacatcactcacctcctgtaagcatccgtagccttcattttcaatggagaaaaaagaagttgagatgcatttctccccattgctattttggaatccactcagagcactcagcgcctgctgttgttctcattggaatcttgctgtcccatgcaacttgacttctatttacactcctcggattcgtatgtgcaagtcttgcttgtgagggaagagccaccctagatatgaaaggacttgattaggaaaaaaaaaaaaaaaccttttgaagagagaggtgtaaaaaaaatgaagccattagcgtcaacttaaattcaagatatttgggatgatacatctgcttataggctcataaaacaggcaccagctcaaggttatgtgaaacaaagaaaatgtctagcattgctcagctgttttaggctacctaattatatttttagctttatgcacttgggattctcttttcttttttatttgttttgagggtgtatagtgggcacctgtcaattctgcagcccagaatccatgcccctacttctctaagagtgtccatttttccctctggtgatcattcctccccattctcagaccttttgacttccaggagagcttcgtctgtctcagtctacagggaacaagtgtgtggcttccacctggctctgagaagcactgtgtaccccagtcactatgactgttgaaaggtgagcatgcgcacctatcagaaccagtgacatgaagtttgtggaacattttttttttttttttttttttttggagacagagtcttgcttttggccaggctggagtgcactggaacgatttgagctcactgcaacctctgcctctcgggttcaagcgattcttctgcctcagcctcccgagtagctgggactacaggtgcatgctaattttttgtatttttagtagagatggagtttcaccttgttaaccaggatggtcttgaactcctgaccttgtgatccaccaacctcggcctcccaaagttctgggattacaggtgtgagccaccgtgcttggtcctgtctgtggaatttttaaaatgtgtttgaacttgggggacgtaggtctgaagctgtttgcagccattttggcaccatgtggagcgtaggaatgaaactcacactcacagaaagtgtgaagaagagcagaaagaaagaaatgaagaccaaggttcaatggcaccatttaatggtgatttaaaacatgtgtttgtttttatttttacttattatttattatttttaattaatttgtcttttagttgacaaataaaaattgtgtatatttgtcgtgtgatatatatatatataatggaatactactcagccttaaaaagaaggaaacctggctgggcacagtggttcccaccagtaacctcagcactttggtaggctgaggtgggagaattgcttgaacctaggagtttgaggctgcagggagctatgattgtgtcactgccttctagcttggatgacagagcgagatgctgtttcaaaaacaaaaacaaacaaaaaggaaattccatcacttgtggcaatatggaagaacctggaggacattcggctaaataaactaagccaggcacaaacatacaaatacaccatctcagtaatatgtggaatctaaaaaaagttgaactcacagaagcagagagtagaatggcggtttccaggggctgacaggtggagatggagagttcaggagatgttggacaatgacatcacttgaaaggtccctggatccagctaagccttaacccttttatccctctaactactgagttacctaaactagtaaattccctttttttagtcttttcacccagcttggctttgcacttttgccagctgcaaccagcaaagttcacactgtggcaggggtgctcatcagtacgttcagttcatgaggaggactcagatgatgcatgctgcagggattcagagggagaatttcttttctccttcatagagcccatttttctgtgtctgtgggcacaagttgggaaaggagagaataatgaaacgacatgcacagatgcatacaggactctgcagagatggtgcaggcattgtcaagatgacctgcccaccactagcttacatatccttcatttttttgtgtgtgtttctttcaacactcttcgatcatgaaactacatcttttattttccttgacagtgctcaagaaaatgtggtcattaagtttatcatcatgaaagcaggcacctggtttctgaaatactagacttcttcatgtgtatcatctctgtggtttttcagaactctaaaatgaaggtccacttagtccaattgctgttctaggaacctgtgatcttttaatcttggatgtctctacctaaactatggtgtgagggtggtgtactaacaagcaactgaagttgaatgacaagagtaaacatgaggtaggtttttctcagtgctaatcaatgacgaacctcgtgctcaaaaattcagctcaggctgtagccaccaaataaatcatgggccagagaggttcagggactcaaagacatgaggctgtacccaggagaaatcaagctatggactggtaaggctcagaataaaaattgatgctgtcttcccagtatttgggataataggattgtacctctttgagctacttatgtgtactgccatctgagtcgctgtctcagcatttccagcagaaatgcaacagggctggtgaagtgtccaggagtgaatgacttgtaagccattaggaaggccggggaaactgtgtttgggctaaattgcttttggtcaggagctccatcttctcatggctgtgaaatgacggatacctgagagaagtcccagctgaaagccgtgtctgcactgttgttttctaagtggatgctaatccgttaattagaaggtttgcagttatccttggcactgtatgcgtgcatacattagtatttctatttatgcacatgcaatggatgtatttacatatccgtaaacctgagtctttttacctacctcttagaggtgccattctgattattttctggtttagagatggaaagacaaaatctgcccctccccacccccaaatcctgaacttgagtggagctgtggtgataatactgaactgaagggctgtgcaggtacctagtgttttactttgtgccaattatttgttaatgcaggtatcaattttttaaaaaatgttttggatgacttcagtgtgccgggcactgtgtttgtttctgggaataaaatagagaacaaaaaacagagaaggtgtcagcccttttgcaacttataatttagggagggagtgagaaaaaaaaaagcatggaagaaacatatcagatagttatgatttaaattaaataaaataaactatgaattaaaattagttgatgcgacagtatatggctaggtgagtctctaagcttaggttataaatgatgacttttacaaagagactacccttaagttgaaatctgtattataagtagggagcacctataaatatcggggcagggggttagttttgagcaggtggatcaattagtgcaaaggtcctggggcaggaaggaggctggagtggtttgggaaccaagaaagagccgggccagggttgcattttagtggatgatagggaaggcagcatggaatgaagtggagacgggcttgtggggccgggtttctcaacctcagcactactgacattcgaagctggagaatgctctttggtgagggctgtcctgtgtatagtaagatgttcagcagcctctctggcctctacccactagacgatagtacctcgcactcctccagttgtgacaataaaaatgtctccagacatttgccaaatgtcccctccaaatgtgacaaaatctcccttggttgaaaaaccactgaaattggccttgcctgcaagaagtttgagtttattctaggatccatggaaagccactgaaagtttgaaccaattaagtatcacgatttgggccaggcacggtggctcacgcctgtaatcccagcactttgggaggcccaggcgggccgatcacgaggtcaggagatccagaccatcctggctaacacggtgaaaccccgtctctactaaaaatacaaaaaaattagccaggcatggcggcgggcacctgtagtcccagctactggggaggctgaggcaggagaatgacgtgaacccgggaggtggagcttgcagtgagccgagatcgcaccactgcactccagcctgggcaacagaacaagactccgtctcaaaaaaaaaaaaaaagaaaaaaaagtatcatgatttgattcacatttttaaagatcattctatttgctgtaagcaaatgggttgcaggaaggcaatgtggaaaggaaaaaagttcatggtcccagagagaggttataattgccttgatggaaggtgatagtcatgggaagaaagttctgtaggcagatatgatttggataaagttgacagaatttatttgtggaccagatggatgggcagggagagaaggagaagattaagtacaattcttagatttttaaataacaaataggatacccctcccatcctcgaagagctcacactgaagtaagggaaaacaaacatatatattgcactcattacagtgtgctctaataaatgcatgaacaaaatgtttcggcagcgctgaggagagagtgaataagtctttcagagaaagtcagggaagattgctcagaggctgtaaaagcttttgaagaataagtaggatttttctaagtggagaaggagctcaggttcctggtctatactaagaggaaaccgtaggagataatccctcttcaataattcaaactgctgtcaaggaaaattatgcccagagtgactctgttctatggcctgggagggaaactggggtgaatgtcctaaattgttgtctttgaaaagaccgtttctaaaattcgtggcccaacgtagccttttactggttaactctaagtatttaagatgttctccaagcgttttaactgaagacactgcgtcttattttgtcttcattgaatttcgaagaagcatctgtagtaagaatatttacacggtttttctaggtaattgtttgtctcctggaccatagagtaccttaaatacgttacattatataatttactaatagtaatacaattttatgaagatatctagaggtaacaaattcaagattatgtatttctatctctggaataataattactgttttcatttgtaaaagagattgtaagggaaataaaatgtaaagttaaagctaaatgtcattgtattctatgcttgctgtaaggtcaaaatatgtgatcctgatggaatatggtaatatccctttgctctcctccgcacactgaggaaccttttcctgggactaatagacccccctaatgggatgcagacagtgcctcagagtagatgttgttccataaatatctgggggcactccagattgggaccttgagaactagatggtatgctaaattccctccttcctttgcaggaattaaaaagcatccctcaaattgacaagaaaattggataataaattaaccatttacagtttggtaaatatatgcacaactgaagttccacgtcatgggccatatttttatcagacgcaacaccagatgaaggataaaccatatgacccaccctcttctgccatgaatgaacaatggactgaagtctttcataattgcttgtttcaagatgctcactaaatcagacaaggaactcctgtcttgtgtctttaagggaggttgaacaataggctgggacactggagtaaatggggcactctgccatacttacactttcctttgaaatttgtgtttgggaggctttaactatgagtatattttgcagccaaatgcagttagctttttgactaatggagctggtgtgaattttacccctccatctgtagatgctgaaatgtcacattatttcatttttctaaaacaaattaaatgactctgagcatccagtcattagggttttaagaaactcaatcacaactatgagtatagggaatggggatgaacagtatccctttcccatatgctagatagacagtcacctgtggagcttagcagtgcttcggatacagggaaggacagctggtctttgagatattgtgggcatttgggtgttaggattcttattacttaaacctgcccagtccctataaaaagggaccgctttgcaaattctgatccatgcatggaacaggaaatctttcttaatatttagctgcttcatgcattcaaatccttgaagaccccccacatgccctgcacccttctcagttccctttcaatcttggggtatctcccctttctgagaattcactgctgttgctgacctcctcccactcatttccttccatcttctcttactttcttaataccccacattatctctgctgactgtgtctttagacacacaacacttttctttaaggaaaggcaaggctgtgtgttccttacctcatcatgttatgttagaggtccaaatgttttatgggtgaccaattaattcatcatgtcatctggatgactgttgaaagcaaaagcgggatcattgtaagaactgtgtcaggaaaccagcaaaaccagccctgtcccaggcaaactgggaattatgatctctctctggaaggaaagaagaagaaaagtgggagaggtaggctgttctttttccaacaagaatcttggaaggcgttttcattttggaaactgtttagaagactatactaaattgttactccttattaccaacatgcatagcatcctgcaatgcagacatccatgactgtgcatctccactgcttcaaacagggcactagtgttccaagctttgtgtttctattgccagccctgaatgcaaaaatatgggatcctgagttcaaatcgggctcagaagttgacatattgtttgaccttgagcaatctgcttaatttcatagtgtttgtttgctcatctgaaaacaaaagggataatgctgatcgaggcatattgtggagattaattagtttctgaagtgctgagatccacagatgaaaggctttaagtggaaattattttgtttttaaaggaataatcgatgcatgtgaataaaagagaactaactgaactgaattacaggcacttggctgctggtgggagtgggggaagaaagaatattgcttcttgcaaagaaccttaaatttaccccccagaatagcagtgggaaaattgctttttttttgtgattctgaaaggatgagaaattatgcaaaagaaacgagctagaataagaggagaatatatgcagttaagacatatttcaaagtaactttcctggataaacaactaggtatctaatatatatattatgtgtattagatatatatatgatatatatgatatattaatgtattagataatgtgtgtgtgtgtaagtatgtatatactccaccagtcctctgtgattaggttcttagccaaatgcttgtctaccaaaacagctcagccacgatccccaaggagccttaatgacccctaagtccttggtgaaaagatcagtttgggaaggagaaactaactgtttaaaaatctcacagctgtgtatcgtggtgagaaaactagcactattaagcgtgttactgtttaaaaccacttttgctcttgttacatttggtcttctctccaataaatattattattgcccttgatgtacagataggaaaatgataatcagggaaattaaatggctggccaatggccatttgtttggttaggtggtataggcaatattctgacctcaacattatgactcacaagactctgaccatgtcactgtcaccgaagggtttgctaaagatatggtgacattcagctggcatgtggaaatgaattattgtctaaggactacagaagaattggaatgaagacaggattttttttgtcaaagaaaataaaaagttctgaccattaaacgaatgcgtttttgtcatagacgtggtggaaaatgccaacaaagtcagatttcaaaattggctcaaagtctcctgagtcaaatgaaaactctgtcaaagccatgttatacttcttcttagtcttttatccatgcattttaataatatagttatggtcatgttatcccaaattcttttcaaatgttgttttaatggctctgtaactttctaccttgtgactattgcatggttgttttgacctttttctcattttttgtagatatttaagttcttactttttttttacttttataattagctctgtaatgagctttttgtgtgaaaaaacatataattatatacagagttattaccttactacagattcataacatttggattattgcatcttgggaaataaatattgtagtgttccttgtgtatatatcaagtttatatcaataccatctatatacttatatatcagattttataaattaaatgtgcaatttattgtgtaccaaatatatttcaataaagctgttttttaacatgagggccttgcacagtagctcacgcttgtaatcccagcagttttgggaggctgaggcaggtggattgcctgagctcaggagttcatgagcagcctgggcaacacagtgaaaccccgtctctgctaaaatacaaaaaattagctggtcatggtggcgtgcacctgtagtcccagctacttgggaggctgaggcagtagaattacttgaatccgggaggtggaagttgcagtgagctgagatcgcaccaatgcactgcagcctgggtgacagagcaagactccttctcaaaaaaaaaaaaaaaaaaaaaaggacaactaacacctttactcttatggcagtaacagagtagcttgttttggagtaatcctatcatagatagcaattataaattctagataggatagtaaaaatcaccttctgtttgatggtactccccaacaaccataagtaggcagaaattgaaggggctttgaccctggaaagagaggtactgtaacttgataaaatgagatgcatttgatattcacccccaaagtacacaccaatccatgtggtgcaaggaagacgagactcaggaaggctacagtcttactgagtttgagaaataaaagacagatgtccagaatagttagaaagtatcaatgaaagacacatagatagactaggaaggaagatgcagatttacctataaaatctacacacattctggtggatctctgaagcatatttatataaaagaggctctaggggagcccgtgggaagccatagctggacgactgaaagaaccgagtggatactcgagttgctaaacaggtagaggatgcagaatgggagtgtgaatccagcaagttaactgcctgctataacaaaaatcagcactcttctgagtaagttaacaaaattcagcctcattaatatattatccatgatgtccttttaaataaaacttactagatgtgtgaagaaacagagaaacattactcatagtcatgagaagaagcagttaaccctgacataaaaaaaatgttggaattaacagataaggactttgaaacagctggtataaatgtgaatagtaattaaagaaataactagttatataaaaatgaaaattttagaattacaaataaaatatttgaaatgacagttttactatatgggctaaacaggagaatggggacagcacaacagatcagtgaatttaatatagattaatgtatatcattcaatttgaaaaaaagcaaatgatttgattattaacagaagactagtgatttatgggataatatcaaatgtatacagctataggtacttggagtcccagaaagaggaaggagaagataatgcataagtaatagttgaaatttcttcaaatttggtgaaatactttcaagaagctcaagaaacttcaagcaagcaaaatataaagacaagcacacctagtatgattttaatttccacgtcatagtcacagtgatgaaaataaaagataaaaacatcttgaaaacaatcagagtgaaaaagaggcatttcctacatggggcatagtgatatccgtgatggtcagcttctcatcagaaacagtggaagcaagaagacaatataatgacgtcttttaatggttgacaaagaaatctgcccacccagaattctgttttcataaaaaaaaaatccttcacagaaattaataggaagatgcattcagacaaatgaaaatagatgttttattaccattagtcctgtactataagaactgtagctttaaagggtatcttcagagtgaaaggaaatgatgctaggtgagacttaaagagatgaatgaagagcagggaacatggtaaatatgtggataatataaaaggttataatgcttctttgaaaatatatgtaactgtgtaaagaaagatgacatcactgttttttggagtttgtaacatatgcagacacaaatgatgagaatgtgaagcaaaactatactgttgaaaattttttacacttgccatgaagtagcactgtattaatgctgagtagactgtgctgtgttaagattacatagttaattctgagagcaactactaaaaatattacaaaagtgtatagtgagaaagatacggaaggaactaaaatgaaataatagatatatcacttaacccaaaatgagactgaaaaaggggaatagagaaacaacggcataacaaaaacaatagtaacaaaaagcaaacagaaattaaagagcaaaccataaacataagtccaactatgtcaggaaacttacaattatggcagaagggtaagcaaacacgtccttcttcacgtggtagcaggaaagagaagtgctgaagaaaggagcaaagccccttagaaaaccatcagatctcatgagaactcaccatcatgagaacagcatcagggtcaccgcccccatggttcaattacttcccaccgggtttctcccataacatatgcggattatgggaactacaactcgagatttcggtatagccaaagcatatcattctgctcctggtcctttccaaatctcatgtcctcacatttaaaaacacaattattccttttcaacagtcccccaaagtcttaacttcttccaccattaacccaaaagtccaagtcaaaagtctcatctgagacaaagtaactctgttctgcctatgagcctgtaaaatcaaaagcaagttaggtacctactagatacaatggggtacaggcatcggataaatacactcattccaaatgagggaaatttgccaaaacaaagggactacaggtcccatgtgagtccaaaatccattagggcagtctttaaacattaaagttcccaaatgagctcctttgactccatgtctcacttcctggtcatggtgatgcaagaagtgggcccccatggccttgggcagctctgcccctatgcctttgtggggcacagccacctttccacctgctttcatgggctggcattgagtgtctgcagcttttccaggtgcacagtccaggctgtcgctagatctaccatgctaccattctgggatctggaggatagtggtcctcttctcatagcttcactaggcggtgctccagtgggactctgtctgggggctccagccccacatttcccttctgcactgtcctagcagaggttctccatgaggattctgccccagtagcagacttttgcccggatatctgggcatttccacacatcctctgaaatctaggcgaaggttcccaaacctcaatgcttgtcttctgtgcacccacaggagcaataccacgtgaaagctgccaaggcttggggcttgcaccctctgaagcaatggcctgagctgtaccttggcctcttttaaccatggctggagctgaagcagctgggatgcaggggaccatgtcccgaggcagcacagagcagggtggccctgggcctggcccatgaaaccacttttccctcctaggcctctggtcctgtgatgggaggggctgccatgaaggtgtctaacatgccctggaaacattttccccattgtcttggtaattgacattcagctccttgttacttatgcggatttcttccaccagatatgcgaaatcatgtctctcaaggtcaaagttccactgatctctagggcaggagcaaaatgccaccagactctctgctaaaacacagcaagagtgagctttgctccagttcccaagaagttcctcatctccatctgagaccacctcagccaggacttcattgtccatttcaccatcagcattcaacaagtctctaggaagttccaaactttgccacatctttctgtcttcttgtgagccctccaaactgttccaacctctgcctgttacccagttccaaagtcacttccacatttttgggtatctttacagcagtgcactccactacctcaataacagcttatgtattagttcattctcaagctgctatgaagaaatacctgagactcggtgatttataaagaaaagaggtttaattgaatcacagttccacatggctaaggaggcctcaggaaagttacagtcatcatggaagacacctcttcacagggcagcaggagagagaatgagtgcccaatgaagggagaagccctttgtaaaacccccagatctcgtgagaactcacccactatcacgagtacagcatgagggtagccagccccacaattcaatgacctcctgtcaggtccctcccacaacatgtgaggattatgagaactgcaattcaagatgaaatttgggtggggacacagccaaatcatatcaggtgatttgaacaacactatctaccaacttgacctatgacatttatagaataatgtatccaacaactacagcatgcacatgttttcaagtgctcatgaaatatcccctcaaagtagactacatgttgggtatgaaatcttaatgcatttaaatttttgaaatattgttaactatgttttctggcaacaatggaataaaattaggagtcagtaattataacgtacctataaaagtaccaaaattttggaaattaaatagaatacttctaaatgactctcacattaatgcagatatcacaagagaaattagaaagtattttggactgaatgatgatatctcaaggcttatgggatccggctaaaaaacagagtgaatgtatagctatagatgctgtaaatttactggttgaaatgttagagagatttaaagtgaataatccaagtttctcctttaaaactagaaaaaaagaaaattatacccaatatagtaaaaggatgggaatagtaaatataaaaacagaaatcaggctgggccttgtagctcatgcctgtaatcccagcactgtgggaggctgaggcgggcaagttacttgaaatcaagagtgatttcaagtgaaatcacttcaaatctggccaacacggtgaaaccctgtctctacaaaaaattcagaagttaaccaggcttggtgggcgcttgtagtcccagctactcaggaggctgaggtgggagaatcacgtgaacccaggaggcagaggttgcagtgagctgagattgtgccactgcattccagtgaaagagcaagactctgtctcaaacatacacacaaaatcagcattgatagtacctgatggtgttggattgaaattggagctatcagtatcaatttagtttttttaaagtatatacataattatagaaatacacaaaacttggaaactccaggagtaatcagcacaactagctcccagatcttggtttctaaatatcattaatcattaaaaggaaccaaaacttattggagaaagggtgattccagaactggggcaaggaaagaacaatatgaacctggaacaactctttctttttgccagaaagtcaggaatatcaaagaatgatgggagcatgtccaaaggacacaggcctcagcttcaagtaccatccactggccagatctgggataatctgagtatcaaaatgtaaataatagcaagagattggagctcactgaatgaaaggcaaatgcataagtgtacactgatataaataaattagaaaatgaaaaattcttcctcacaatataaacactactactaacttataagcataactcacacctgtgaaaatgagttagggtaacttcacttatgataacctcaccaacattggactgtgatcattttaaaacctacgctaatttgaagggcatgaaatgatcttttatttggatttataggactttggatcattaggggacagcagtgtttagccgtatgcttataatgtgtctttaactaaaatatgatcatttttcagtcattttgtagctttcatttacccataccccatttcaaatcccttgtataatggaagccactattgctgttcccagagtgactccattgttcttagacgcagagaacgaaggaagaaatcaaagtttaaagataagtttactgttcatggaaaacattaaatgataaactatagtttatttaaaatagaaaatgattatttcttgggcagctattgcatttatgggatccattttatatgtatctagtaaatccatcaataaccctgtgatggagtaattagagaagagaaattgctattgtttccactttaatgatgagagaagaaaatacccagggagattaagatcgtaactgatcatcatggctgagccagaccagctaactgtcgaaacgttcctctggccccaaccgtgatacctttgtctaatggtggggccagggagaagggtcagaaggatgagatgactggggagaagaaaacagaaaaaaaaaaaaaagcattttcttgtgagtcctgtcccaaaaaaatgctaagcatgcatgcagacacccattcattttatacattttgcttgagtccctgcagtgtaccaagagctaaactaggcatataggaatgaccctgacattcatccccacccactggtctctggggtagaataaacttcggaagcttcctatgtagaggcgaccatagtagagaactgaaatctcaccctttgttataggaggataagagaaaataaacgtggatatttaggtgtgttcttttccaaacaaaataaaaatgaacaaacacatttgcttgcttttttttcctttggatcttttatcttttaatgcactttcattggaattcaatccatacatactgaagggtggttgaagtaataaatacagtctttttctccaaatggtacccaaatgaaagcaaagtactgctttctgcttaagagtgttcagtttgtccttgacctatacatttacactgggttgctgtcctctgcctccttccactactgtccacacaatacctatgtaaacacatacacacacacaggccttaatgatgagtaaggcccatttatttagaaaacatggtttgaaggatatgttaaaatcatttgtagataaattgatatttttatattattacttctttcttgggtttctgcctttgatttagactgtagccagttgtgcctgctatcagttctggaacctaaaattcatgtgggaagaatttaagtgtaaccgagatgtaattgtgattgaagcagggaatgaaatataaacactaatcaaagcttcagtagacatgttttttttgtggattaatacatcacattttaaaaccttcaacccttggcttctcagttttttctgtttattgttttgtttgttgatgtatttgtttaattcatgggttagaggcttgggtgctgagagagtcgattgtgttaaaacctttagtgtggaggtcatgaagaggactgagaatgtttgatctttcactgtgggtgctgaaccagcagcatgagtatcacctgggagattgttagaactacagacttgcaggcctgtattcaaaatctgcattttaaaccaagatactcaggtaatttgtaaacaaaagtttgagaagcactaggtcagtttactccagctgtctaaaccagacctgccactcaggtgttaagaacccaagcaataaggggtggcttgcttttgataatctccctctaatcttatcagagactttttttttaaatagaggattctactcccatcatccaggcaggagtgcagtggtgtgaccaccactcattgcagcctggaccaccggagctcaggtgggcctccctcctgaacctccccagtagctgggactacaggcgagtgccactacagttgcctaattttttaattatctgtagagatgtggtctcactatgctgatctcaaactcctgggctcatgggatcctcctgtcttgacctcccaaaatgctggggttgtagccatgagccaccgtgcctgacatcagagacacttctgatgagcccaatatatttctaattattggaccctcaagtgcatctggagaggacaccgaaggactgtggaggcatcgagccctatgttcatgcattgactcaagtgtgtccctccaaaatccatgtatggaaaccctacccctgagaattactatatttgaagattgggcttttagaagataattaaggtccaatgagattataagggtggggtcctgattcaataggactggtggcattataagaagaggaagagacacagtaggaaggtggctgtctgtaagccaggaaaagagctctcaccagaatccaaccatgctggcactccaatatcaaacttccagcctccagaaatctgagagtgtaaatttatgttgtttaactcacctagcctatacagctggctctccatgtccatggactcggcatccatggagtcaaccaaccacagatcgaaaaaatatatattttaaattgcatctatactgaacatgagcagattttttcttgtctttattcactaaacaatacagtataaaaatttatttgcatagcatttgcatttgtattaagttttacaagtaatgtagagatgatttaaagtatatgggaggatgtctgaaagttgtatgcaaattccatgccatttgctgtcagggacttgagcatctgtggattttggtatctgtggagggtcttagaaccaatttctgtggctactgagggaccactgtagtatttgtgatggtagtccaggtactcaaggagagttcagttacaaatgcaattttcccctaaagtaacttggttccaaaagagtacgcatttgtagttgtatactacaaatggagtgcgtgtgtgttctctactctaatatttcatgccagagtgagttattagtttttgatcctttttcttctttttccttcatgagcagcagtcctagtttgcttgggacggggaggttttcatggacgcatcatcccttcagtgctagaacagggagagtaccaggcaaacttgggtggttggtcaccttttgctgttcccagattctttcctgagctgaagatctcagctcccttatgagaacttcacattgcttcaaagaagagcagatctcatcagaatccagcaatgacatgaagcattttggtgcagagtaactaccagattagagctcctggaatacttaaaccttcgtggatccccgatatggaaggaagaagcctggctatcctagcttgaatggaattcagcattggtagacggaaccacaaatgccttctatttcttcccaaatatccttttagaacttcgaactaattctagatagagtcttaaggtcaggtataaatgaactgctaagtatttatgcctgcataacacaatgatcaagaggcttcctgtgagcccaacattctcatgctttaatagaaaacttattgtaaaatttgcactctactctataacatagaaatgtctatcatttctataaatactatgcagtctcttctgatatatctgttatcctatcatacaagagcagatggctgggattttatcacagttagagggtgttttgagatgggctgcaaatcctctggagaatttgatttggagactcaattagtcatgacaagttaggttatgctgcagtaacaagttggctcctgaatctcaatagcttcataaaacaaagctttcatatgtccagtgttgggcattgggaagtgcaccaaatagtgcctcagggactcaggctatggaggcttcaccatcccaccaccgtatcatctggacacacaacttcctttgtcagcatgatgggaaagaaaacatggagaattgtacaccagctgatccatgcttaggcctgcaagtgaaactccttggtcagaactagtgaaatggccccacctaacaaggtggaatgagaatgctgctcttctgtagccataaagggaaggaatagcaaaaatgaaagtgaataggcataatatctaacacaagggtccaagaggtagaccctatacatgacaaactgtaattccacagaacagctggagtcattgatttgggaactagccactttacacatgggctatttttacatttgtttcaaggagtagtggcagggatgtattatttaataatgatcaataaaactcataaaatattgagggagaaaacaacttctattacaaaatgcaatggtttaacctcctttccacagaataaaattgcaagtgcatgagaattatcacatatgtccaaggatacacatattcctaccttggatgctcacatactgtgtgcaggaaggtgagaacgcagaggaattaaggactcagaacttgtctcctctcattaacagccaatgtctcacatatgtcctggtggatcttacagggctcagcctgaatgcttctctaaacttttccacatgtagtaaggctaaagaccatgtgttttacaagatggcaacactcaatcctatgcttttcactgaaacagaatgctctgtcattgaagcatttctctggggacctcagattctctttacagaggcaatacccattaattctaatgcagcctcctgtcatctgggactcatgaacttccaccgcagtggtcccttcctataatcaaactgtagtagcttctgtctccatagaagatgttagacatgcccagaaacctggtatgcaatgtcacactctgccaaaagaacataaaacttagacaaatatggaagtcattaacactgaagagttctttgctattaaaaataggaaaattttattactttcctacatgagaagaatatataatacctttagggttatttggtcatttggaggctagcttcttttctctgtttgtagacctatttttggaagtcgaacattttttttttttttcattttaagcaccctattgatacttggcatctctgcagtaatagaattttgaagagttcatcctgttcctatgctcggtcaatttttggataagtctgaaaatgatgctgtggatagaggatgctgggacccccatcatggcaagcatgcatcattgcaaagggtcttcataaggttatgtggaggctacctggggtcaggatccattcagagctggaaaacttaaatagaccaactgatgttagaaatagaatagatccatggcttgaaatgaacagttgtgtgtttatatgctggctgacccccctactgactgtgtgactacggaaaaaacaaaactctgctgcccatcggtaaaatgggattatgatccttgcctaacttcctgtttatagggttctggaggtcccaatgagataaactcttttgaaagaggtttggaaaatgatgcattatttcacaacaacatggtgttacggttgaatatcaatgatagagagtaattgagatggctatgtaacatagtggccagtcatccatttgcctagcaaccatctatattatttgtatctgtatctatctatatgtctatatgtctatacatctataactatatttatatacctacatccttatctgtatctgtacctttatctatatatatgctatggatttgcctatgtccaagtctatatccatatcaaatatgtacatatacattttctatatatgtaatccatttctatctctatatgtctatgtatatatctatatctatatctttacctatacctatatgtatatatttgtctttgtgtgtatctatgcttatatactatctctatatttatttttatgtatatctatgtctgtatttatacacacacacatatatatagagagaggcagagacagagagaaagagaggagaaagagggaaggagaggggtgtgtgtgtgtgtgtgtgtgtgtgtgacagagagagagagagagagagagagaagtacattctatcctaggaaatgggaacagagccataatcaaggcagcatggttttgacttatagttcccaggagagactttcattaaacaaaaatatcttgaatgaattgcaattgtggtaagtgctatgaaggaaaagtacccaatcacagtataaatcttatcccagcagggaccatcagggaacacaaaagaaataaaacactaaatcaccaatcctcacgcagcatacatggaccgtaggtgtggaccccagcctttgtgagtagatccccactatgttctgaatgttcgcttttccccagaattcatatgttgaagcctgattctcagcacaatagtattaagagctggaggctttaggaggtgattaggccatgagggtagacctctcagtaatggggtttgtgcttttatcaaagaggccagaggaagcttgtttacccctcccatcatttgaggacacacagaaggcaccatctataagaaatgggccttcactggacgtcaaatctgtcgacaccttgatcttggacttccctgcctccagaactgtgagacatgcatttctgttgttaataagccactgtgtctaaggtattttgttatcacagctcaggcagacaaagacattccctaaaagaaaagcactttattctataaagtgctgttgtttgagcttaataaaaagttaaaaaggccctttacagaggtctgtcttaaggaataaggtgtgtgtgcaggggggactttaattaccagtgggatgtatttaatgtatgatttcatttagaatccgggagccaatggttagtgttttttaatagactgaaattttcatcagggcgagttctggatctttatgcagctggtgctcagctcatctttgacctgcctgggtccttttctcacccattccatggtgggaagcagacactttgacttttcagagcgttattgatggaacaaatgtagtttgaatgagcttattagagtgtctatgaagtgtcctctgttcttaggcaacaaggccagtttctctcctcttccctccctctctgacaccgtagtgttatgttgtctgtaacatgttttgttacggttttagcaagttttcaaggcaaagggcatggcattaggaaaattgaattcacaggtcaaacaacaagtcaggtgacctcaggaaaatgacagtgatttgtgtttgcattttaatttaattcagtcctaaaaatgacccatcttgctgctattttctgtgatcacaacttttatgttttcttgtagctagctcttcatgtaattaatcattgcatgaatttctattttatcattttcttttggtgtcgttttaccaccccttctgtgatctccctgaaggtagaaaacttttctgttttgttcatcaatgcatacttaaagcctaacacatatttgacattttataaatatctgtgacttgaataaatgaataaattcacagtctctccctacatactacttcaaatactaatgttttataacaaataaaagtttactgtctggacgtggtggctcactgtaatcccagcattgtgggaggccaaggcaggtggatcacctgaggtcaggagtttgagaccagtctggccaatatagtgaaaccccatctctactaaaaatacaaaaattagctgggcatggtggtgcgcaccggtaatcccagttactcagggggctgaggcaggagaatcgcttgaacctgggaggcggatgttgcagtgagccgagatcatgccattgccctccagccagggcaacgggagcgaaacccggtctcaaaacaaaacaaaacaaataaaactttaccaaacactttgaaactggaaaaccttaaagttgttttccatttgaaagttaagatgcctttgagtgttaattacatgagtctgttcaattgtatgttttttgataatatacctccatgaaaagttgtgggatttttttaagctaagacacatgatttaaaataccctgtgaaacttttaaaaaggaaagaacctgaatgaacaaaataatatggtccccaaatggctgttgtagtggaggggaaaaaggtttcggctaaaatttatccagctgcaaaccactgtcttaagccagcaagaaatttatattcttccgaagctgagggaaaatcaaaatccacaagtgactcttctcttcccctagctgcttcatacactgctcagtttccggagatctgagataatcattttgtccttgagagtctcgtggctgtgctcttggagggtttgggtttaaaatcttaggatttgatcctgttcagaaaaacaaggcaggagcacccgagaagcatctaaaatcagccactgccagaggctgcttgctttacctgtcttgcctgttcaatttgtcctctacgaggcaaaggtgagactaggagccctgcttctgggaaaatgcctctgttaaagaaccatctcacattcctggagtttgttttgggatcacaaaattggcaactttcttttcttcttcattgcagtttagagttttaagcatcataaggctgtgtgtgtgtgtgtgtgtgtgtgtgtgtgtgtgtgctggtgcatatgaatgtgcttttacaggtacaagaaaataaataatccaaaggtagccttctccttggggtgtcctgctgaaacgatgacctagggttcttttttttttttttttttttttgagacagagtcttgctctgttgcccaggctggagggagggcagtggcgcgaacttgactcactgcaagctccaccttctgggttcaggccattctcctgcctcagcctcccgagtagctgggactacaggcgcctgccacaatgcacggctaattttttgtatttttagtagagacggggtttcaccgtgttagccaggatggtctggatctcctgacctcatgatccacccgcctctgcctcccaaagtgctgggattacaggtgtgagccaccgcgcaccttctatttgaggccctgcgctaggaggactgcattaagaccaaggcgtgcggaagcacactgatgttgctgcctctggtgggtgcacgttgaatcacgtgtgtctatccaagaggaatttgtattaacttctagtgcatttggccagaaaatgccatgagaatcagtggaacatgctgtgtaggctgttggagtggaaacaaacctacctggaagtaggcactgtggtctgcaccattcggcataagtcacttagcccctctgagcttcaggtttctcagcgcacagttggggataaaaaggaacatattactcagcatttgtgggctggctaaggacacagcaggcattacctgaacatccccacaataaccccgggatgtagttatcacttcccttatcgttctcatttagacagaagaggaaaccatggctcccgctgctcacaggagaagctagtattattcccctactctgaaaaccaactggatgtcccgcaatcatgggaatacaggtgcaacccatcacatatggccaattgtttttaaattttttttgtagaggtggagtcttgcaaagtggtccaagttggtcttgaacccctggggcaagcagttctcctgctgggacctcccaaagcattggcattactggtgcaagccaccacacttggaccctttttatctagataaccataggtccggagatgactgtgacaaaagagccatgtgctgtacatagcttgatcaaaatggcaaaaatgtatatgtttatgactgctgttttgtgtattcccgatgaacacatgcctttgttgttgattcttcatctatcttccaatacaattttaggtctggtgataatttctggatttctctatttatagaaaactttgaacttcataaatattaaaatgtcctattagctacatgcagactgctttttctatggccatggacattatgcaattattacccgagctattaattaaatttgaaaatagataaataatggatagggatgctatttatgagttaaaagtgagaaaatgaaaattattctccattctgttaccttggatgagtctaacctactgcatgctctcagcttttattattgaaagtcattatgttactttgcataaaatgaacaattggttgtaacaagtcagccctgtacagtgaccagttttcagatgaagtgattaaaatattttctcaataaaacaatcaaaacatggcccttggccaggtgtggtggctcacgcctgtaatcccagcactttgggcggctgaggtggtcggcttacgaggtcaggagtttgagacaagcctggccaacacagtgaaaccctgtctctactaaaaatacaaaaattagctgggtgtagtggcaggcgcctgtaatcccagccactcaggaggctgaggcaggaaaattgcttgaaacccgggaggcagaggttgcagtgagccaagatcgtgccattgcactccagtacaggcaatagtgcaagactccatgtaaaaaaaaaaaaacaaaaaaacaaaaaaacaaaaaaaaacatggccctttcacagtagtcaaatactgggtaatttccatattatacgagttagaaacatgaatctcaccagagaaaaggtatgtccccaagaacagagtgaacatgtattttgggagttactgcagaaagctttcatgaactctttctgataatataatgcgctggtagatttcctctggtcaacttggatttcagtcttccgtttctaccttttaaaggaggccttattagtctctctggttgatagaggatgcctgtttgttcaattcacactattcatggacccctatatgcctttcaatgatcatcctataaaagttatctttccactgcgtttactagatttgagttatcaaatggaaactctcaccaatgtctttgaaacctttttgttttcaccatgcctcataataagaaatacattttacattgaggcagcatgcacctgcaataataagcaagcgcttcacatgcactttgatgtgctccattttatttctttttagaagaaaatgttggtcacaaatgacactcccagttttgtggctgctaatggacatgtgaagcacttacttagttgtctcggaaccatctaatgatctgattcagtgagcaagagtgtggaattgtgagcccgacatgcttacacatcagtctttctgctgttccagagttactggagcgtgcacctggcatttgttgagtctctctttggatggtttgtgtggcactatcagaaacggaactttcaaaaactgataattttggaagataaataattatggaatactcttgcctcagatactttaatattattgagaaaaattacaacaccaggctcagctatttttaaaaaaaatttttggccaggtacagtgcctcatgcctataatcccagcactttgggaggccaaggcgggtggatcacctgaggtcgggagtttgagaccagcctaaccaacatggagaaaccctgtctctactaaaaatacaaaattagctgggtgtggtggcacatgcctgtaatcccagagacttgggcggctgaggcatgaagatcacttgaacccggaaggcagaggttgtggtgagctgagatggtgccattgcactccagcctgcgcaacaagagagaaactacatctcaaaaaaaaaaaaaaaaaaaaattgtagagatagggggtcttgctctgttgccttagctggtcttgaacccctgggctcaagcagtcctctcatcttggcttcccaaagtgctggggttacaggtgtgagccactgtgtccagccaaaatttatttttaatagataatggttaggacagtgaaatttttagtcggctatcattgcaaatgactgtttgccatatgaaacctgtgcttttgaaatgagggtttttattctcataatcggtcaaaacaattgacagagaaagaaagaaagaaaaaagtgtttgtgaaaagattctaaataaagagtgcattgaatgagagccattttgttggaagaaatccaggatcttttgatgtgactactggaagaacaagaccacatgaaggtttatcttttgatacttaattaactaagaatcaggtatttctcagtctctcatctacagctctcctctacacactcacactagcccctgcatgttcttttttgttggggggaactatggcgacaactaaaggctgaaagagttcaggagacaaagaggaactcttagcgaggttgatggggacctgcattttaaagggtgaatgcatgttctccagctggccatatcttaaaggctgagcacatattctataggtgcacatagacgagaaggaaattccaaccatagggatcgttccgcgcaaacacagcaagtgcaagacctcagagagtgccaagaacacccaagtactgtggaaaggggctggaggaagatgcctcccaagagagccagcacaggcccttggacaatgaaaaactcttggaggctttttaagcaggggaagatgatctgatttccattttgtgaagaaccttggaaaggtggatgaaagcagtgtttctaatatctgcctgaattgataagtcaagtcacctaatgtacttgtgtatgtagacatatgtacttatatatgtatatgcaatttcccagtcctcttctctgggattatgtgtatggaatttgtcacatccatttgcgcatgtatttcccgggcacctactgtgttgtctactctgccccaggtgtgggaattaggcagtggccatggccagtaattctgatcctcatccatcttatgtgctgttgggagagaggcagatattaataagcaaacatctaaataaacaagatagtttccggcagtgacaagtgcaaagaagaaaataaagtactgtgtaagttcgttaagcaaaggggtctcattcgattcaagcttatatcccacccaaatatctagcaccatgtctggaaaataatgatagctgtgcccatggattgtagactgtgtgccagtcattgtcaccggccctgtacatataatacagtctctcttcaaaaccactctacaaagcagggattcttacccagggtcaattttacttttagtggacatttggcaatgtctgtcttgagacaattttcattggcacaactggaagaggttagggagtgctgctgacatctagtggatataggtcaaggatatagtcagacatcctgcaaggcatggggtaggatgcagagcaaagaatgaaccggtcccaatatcaatactgttgagtcttactggccaggcacggtggctcacacttgtaatcccagcactttggaaggccaagacaggcggatcacctgaggtcaggagttcgagaccagcctggccaacatgatgaaaccccgtctctactaaaaatacaaaaattagctgggcgtggtggcatgtgtctgtaatcccagctactagggaggctgaggcaggagaatcgcttgaaccagggagtcggaggttgcagtgagccaagaccatgctattcactctagcctgggtgacaagaaagaaactctgtcacaaaaaaaaaaaaaaaaaaaaaaaatagcgttcaggttgagaaatcctacagtgtaacagggtactagtgttaccccattttcaaaagcacaaaagatgcaggtgacttaagtgataagcccaagctcatacagctaggaagaagatgatgcgtttaaaactggagagtctgggccgggcgtggtggctcacacctgtaatcacagcagggagagatttgggaggtcgaggagggcggatcacgaggttaggagtatgagaccagcctggccaatatgatgaaatgccatctctactaaaaatacaaaaattagctgggcgtggtggcaggcacctgcagtcccagctactgtggaggctgagacagaagaatcgcttgaatccgggagatggaggttgcagtgagctgagataacaccactgcactctagcctgggcaacaaagcaatactgtgcctcaaacaaaaaacaaaacaaacagaacaaaacaggagagtctgtgtgcagagctccaatatgtaacccccacaacctcaggatatctgtgagatacacaaatgcagacgcaaatgactgttctgacagctaacgtagggacttcgaagtctctatcggtgtgaaaaataagaaacattttctgcagatgggtgccaggtaagatgggttcactttgaggaccttggtttaatcaggatatcaaaatttgttgtttccttgtgcttgtcacaatatcccattgttaacacctgccagcgttgtcatcctaaactgttgctgctgtttctgagatgagctacaacaggtgtgccaaatattgggccattagcaagcggtaattcacctgcatgaatatttatcgtcttgtaaggaggaaacaaaagccgtgtctactttttggaacatggtgcagcagtgtcctcgaaaccaaattgtttgagtctctcgcttatgcggaaggagaagggctcctctgtaattttccatcgggtggatttattttctcagccatctccacatcaaaacacaacactgacaggcgcttgattttattaagccggtaaaatcacccgacagtttagatagctcaagcctctgattatcaaaatatctattcttaaactggttttgaagccagtcgcttctccatggggaaatggccacaatgatgagcaggacaaatttttgcttttctcccctctaattccttccctccctgcctcctccttctccttgtcttgttctttttttcgttccatttttctttttttactgaaagagattgtattaatgaggaaagaggagaaaactcagaaacagataagaaagagtggcaccgaggcttcttgtacaagggtgattgtaaattttatgtcctcagtaagaaccccaaggcgtgtgtgcttttaaacaaaaagaaagtctaagggagaatatgccatttccacgcccatgttactgctgcattcgcacctgtcagcactgcggcctgtacctccttgtccagcaataccatactaataacataccttacaggatacacggatacatcaaacaggttgcagtgctggtaatcactgacttagaaaccaaatgtgctgtcctgaatttttaagtattgccatgactaaggaagtaatgatggattcccaataagtgtgtttgccatttgtgtttggatatcatcactaacagtaactttctgtgcatattttatggtgatcacttatgggatcattccttaccttaaatttgtgcagatcattcctctttctttctttttatttttttgagacagagtctctctctgtcacccaggctaaagtacaatggtgcagtcttggctcactgcatcctctgcctcccgggttcaagcgattctcctgcctcagcctcccaagtagctgagattacaggtgtgcgccaccatgcccagtaaacttttgtatttttagtagagatggggtttcaccatgttggccaggctggtctcgaactcctaacctcatgatccacccaccttggctgtggaaagtgctgggattacaggcgtgagccaccatgcccggctgaattttcacctttctttccctttccatcggccctctctactgattctatgtttatacttgatcaaataagagtttcagttagtcaaatataaatgtgtttactttttttttttttttttttgagactggagtgcagtggcactgtgttggctcactgcaatctctgtctcctgagttcaagcaattctcctgcctcagcctcccgaatagctgggattacaggcgcccaccaccatgcctggctagtttttatatatgtagtagagacggggtttcaccatgttgtccaggctggtcttgaactcctgacctcaggtgatccacctacctcagcctctcaaagtgctgggattacaggtgtgagccaccatgtctggccttaaactcctttctttttaaaaaaaaaaaaaattaagttcaagggtataagtgcaggtttgttgcataagtaagcttgtgtcataggtttttttttttttacagattatttcatcacccagatattaatcctagtatccgttagttatttttcctgatttacacatgtaaatcattaacctaaagaaagcaaaagacagaactttcttctgagaaaggatgtatgttttcccttttggaaagttgtattaataacatctaatccttggggagtgctcagaaattattttctgaaagaatgaatgaatgaatgatcaagatcaaataagagacacaggccaagccttcaaacaagttatactgaacccagagggttccctcaggctccttactgccatgactaagtacgaatggtaagtaacatttgctaaggacttactggggagtgtcatggtttatgccatttaacctcatgagggaggcacttatatttcccctattttaccgaagggtagctgaggcttggagagaccatatggcatgcccattttagccagtgagtggccgggtctggaaataaatctaggaggtgtgtcctttaaccactttgtagaaccattctcattatagtaatggagaaagaacagaatctcttatggtgacttctaggactaagggcacataataagagctgctatttggggaatatgtctataaacctgggagttataaagtagggtgagaaatgggggtgcattatgatgttatctgagagggacttggaattcacatcatctacaattttggacagatgtctttctgcaagccttattttttttttttttttttttttttgacagagtctggctcagtcacccaggctggagtgcagtggtgcaattataggtcattgcagcctctaactcctgggttcaagtgatcctcctacatcagccttctaagtagctgggctacaggtgcatgccaccacacctggctaatttaagaagtaaaatttttatagagatgggatcacactatattgcccaggctggtcttgaactcctggtccttaatcagtccccctgccttggcctcccaatatgctgggattacaggcatgagccaccacgtctggcccttcatgcaagtttgatatgcttttccttcactggggctttctccctgagtattacctgaaagtcagaaaggtcctatgtggaagaaccgttgtattgcaattactggggagcagaaggaaagtgattttggaaaaagcgtatgtatgggcttggaaacttttccccagaacagagaccatttgcagacttttcactgtggccgtttctcccagtcttgatagcctttcacacatctccagggttatctttgcagtgactcagtcattattctacaggccagcatgatttttcttaaattttctaaacctttttccaaaccttcaattttataaaatgtgacacacattttgacttcttttataagacctaattcgaatgccccctcctttttgaagcactccatgatttttttctactgtccaggtatatgctgtggtatcgtattgcagagtcattactctttgcctgactggcctggaattgcctgttgacatacagtttccctgctggaatgtgtgagctctctaaaaagtgtggagtgtatggcttggtttgttcattcttgattcatcactcacgtgtgtctctaagtagcagctgctcaataaacattgaagggaggcagagacaagacagtgctaagaaaggaatgaagacaataagcaaaagttaattcaagtacatttctaccaaatttccggaaccagattcctaagcagtggaggcagaggagaatgaaaaggtagagtgggccccgtgccaatttcatttcagaaaacattcagagagatgcttccctgcgtggtgtggttgcagagggcccacctgtacatctgggatacctacaggcatcccaccattcccgttcttcatagactatatgacacatcccagtcgtgttctatcttttacacgcagcacacacaccgcaatttttgccttgctgagcttttaaaactcttattatctcagattatgaagacaagctgtgcggggtataggcatgatctcaaactgagttaattgaaggtggaggtcagttcagctttcctggaccatcaatcagtaaaaagtttacttgtttaatgcacggagagtcaaagacatgctgcaggcccccccatcccttcccttctggcctgtcaggtagatgttagatttcactgagctgttaaaaatcttaatggatcccactgagctgtttcaggttgtttgtgacaatcacttaatttccttgttttgcagctaacaatgattttaatcttcatttcagattaaccacataaagcctcagtgtccttttctcccgttgtcttgcctgcttcaactctgcagtcgatgaaagggagaactctttccctttctcttcagcagagcctgaaaaaaatgtaccttcagcaaaattatagatgcagtaatttctcatatatgttaaaaatgcacagtagcaaagactggaaatccagcaaagtagtagtagcaattgcctccaggtggttagagtgtggggagattttttttccctacctctttcattttttatttttttacactttcaacattttctgtgatgcactttataatttttacaataagaaaatgtaaattaaagaattggtgtttctgaatcaaggatgaacaaagaaaatgtagtcttttgaagagatgttaagccagatatttttctactttaaagggtggagaaaaaccacatcgggataaaagagtgaggctgcagaattagcttgcaacttgaaggatgggccctattacagataatgctgctgacagcctcagttcatcacgtttctcatttttagtgtattggtgtttgctcatatgaaagttcccagcttgtgctactaattatttcatcaccattcacttgtacaattgacagcctttgaaccaatatcagtgcagagaccagagaaacgattctgagagagatgattcaagaggcaaagattggggaaatgaagaagacttatttggcactctctgagtgctttatgtgtgggatgagggtgacatagtgcaaggagtaaatagtgttgtcattttaaaaggctagacctgcatcaaagggcacttactgtaagcctgaaagtgggtggactgaagggctctttcttccaatggccccttgttgcagcgtgaacatctcccatctttatattgtgatggcactattcctcaatggctaattgctaggcaatagaagacataatttagactccaatttgtaagtcaatcacatgaaggctggatgtgagcaagcttggagataaatgaaccgtggtgtaaacaagagaggcccagaggcttcttgatccaatttcaggaatcccaggctaccctgatgcgttggttgagattacatcctctccttcgggaggggacagagggcagcccgcatctctgctcttccatctggagccgctctctatgggagaaggagtcttgagccctttgttggctgttgatttgatttttaaaaggaaaatctgacaaatcatgttgaatgagaaaagcgtattatgtgaacgtaaaaacgtttgcacatctgaggaccacgcgattttattcaaggaagttctacctttaaggaggttatgaattctgaatcagaattttgtcgtcaggggaatgcttcttagaaggaaggaaatgtactttttaacaagattttcagcaaacgttgacacattcattatggccatgagcatggaggtggctcaaatatattttgcataatgtggaaataatattgcattctatttgttcctgcctcctagcgtcaccacgaatgacactggcacagaagaaaacatgggtgctttagatcacacacacaaaaaatgatcgggataaatttaacacactaatcatcgtgaaggggcttctccatgtatcttttcaatacgcaggtttatctcaaccttggcccagctctgtgcagttttataccataaacccagtcagactccgtcttatgctaaaagacctcccccctcctcagtcacaaatcccatcaaatagactgtggtcccatttcctggtcctgttcctcctgtttagggaccagaccttttttttttttttttttttgtggagtctcactccgttgcccaccctggagtgcagtggtgctatctcggctcactgcaacctctgcctccaggattcaggcaattctcctgcctcagcctcccgagtaggtgggattacaggtaagtaccaccacgcctggctaatttttgtattttgttagtagagatggagttttcccattttggcctggctggtctcaaactcctgaccttacgtaatctgccaccttggcctcccaaaatgttgacattacaagtgtgagccaccacgcccgaccacctctccttttttttttttttaactcaactttctttagattcaggggtacatgtaggtgcaggtttgttacatgggtgtactgtgtgatactgaggttcggggtgtggatgatcccatcacccaggtagtgagtgtagtacccaataggtagttcttcagcccatgccctcctccctgtctttcccctccagtggcccccttgtctattgttcccatcttatgcccatgtattagttcacttgtattagtccattctcacactgctataaagaaatgcctgagactgggtaatttttaaagaagagaggtccatggttctgcaggctgtacaggaagcataatggattctgctcctggggatgcctcaggaagcttccaatcatggcagaagacaaaggcggagtaaggtgactcacatggcaggagcaggagcaaaagagaacaagaggggcggcgctgaacgcttttaaacaaccggatctcaggggaactctttcactagcacaaaaatagcaccaaggggatggtgccaaatcattcctgataaatccaccgctgtgagccaaccacctcccaccaggccccacctccaacattggagaccacaatttgacatgagatttggcaaggacagagatccaaaccatgtcaaatgcttagctcctacttacaggtgagaatatgcagtattcagttttctgttcctaggttaattcacttagattaatggcctccagctgcatccacattgctgcaaaggaaatgattttcttttttatggctgcatagtattccatgctgtatatgtactacattttctttatccaggccaccgctgatgggcagctaggttgattccatgtattcacaattgtgaacagtgcagaactctcctttcatcattgtttttcctcccaggttgctgctgttcacttctctgtccagtctgtcaacacccaactttctctgataacaatacagtgtttgttgtatctgaccaacattttgttcggccttccgcaagctgcagagaaactttttgagagtttgataataaatcttgccatgatccctgtaggaggcacgtcttcctgaccaggcgtggtggctcaggcctgtaatcccagcgctttgggaggccgaggcaggcagatcacctgaggtcaggagtttgggaccagcctgggcaacatggtgagaccccgtctctactaaaaatacaaaaattaaccaggtttgatggtgcatgtctgtaatcccagctagttggaaggctgaggtgagagaattgctcgaacctgggaggtgaaaattgcagtgagccaagattgtgccagtgcactccagcctggctgggtgacagactgagactctgtctcaaaataaaaaataaaaaaaaggaagtatgtcaagtatgtcttcctacacaggggagcagagaaagaccaagagcaagacacagtggaggagcagcactgatggagagacatgccccagaggacgtggggaggtgtaggaatcccagccgccagatgagagttcagctacgacgcagcactgcaggcccaggaaggccatggtccagagggaatcagaacagaagagaaatgaggagcccagataagagatccaccctgaatcctagtaacacacagagggcggggagctccggtcttgaggctaggaaacagtcttgcatttgggcaagttgtccttgtatgaagtgccagttgtgtccaggcgtggtggctcacgcctgtaatctcagcgctttgggaggccgaggcaggtggatcactaggtcaggagttcgagaccagcctggccaacatggtgaaaacccatctctactaaaaataacaaaaatcagccagatatgttggcatgtgcctataatcccagctactcgggaggctgaggcaggagaatcacttgaacccaggaggcagaggttgcagtgagctaagattgcaccactgcactgcagcctgggtgacagagcgagacttgtttcaaaacgaaacaaaacaaatgaacaaacaaacaacaacaacaacagaagtgttgcctgcattaaggaggcagtctaagctgtctggcaacttggaggacaagtatcaaagataaattgagattatgtctcattccactgggtgcttccattataatattgcagtggttatcaataggcagtaatcccgtgtcccctggaggacatctaaccatgtatggaaacatttctaaacattaaaagtgaaggaaaggggctccaggaatgctactgctcagcatctttcaggacagccctcactttaaagaattatccaacttcacttgttaatagtgctgaggttgagaaaccctagtacatcttaagagcactgtgtgtgtgtgtgcgtgtgtgtgaacgtggggagataattataactttgtaaagatggatctacaaggatgttcactgcagcattgtttacagggctaaaagcataagcaacctcaatgttcaactatagggatgtggaaagacatgtaataattcctcttctaagatgaaatgacgttgcaaccatggtaaataatgccttaggttaaggttcaatgggatggaagagtgttcctgagatgctattaaatggaaacaaacaagttatacaacactatttgcactatgttttactttcgttttgaaaaggctatctatagatatttgtatttattgcatctaagtcgacataccaaacagaatacaggaaaaaatactctacaatattattattacttggatattgaagatgtggatgaactaaatattttcactatgtgttgtttaatatctttgcagatttccacaaataatttatttgactttaataataaggatgaaacaactttataccttttagtaatattatttttcaaagcatggagctgaaatctgagtagatagaggaaccaggattttctgtcctgggttgattttttagccagaatctacttccatatgcagacaggaaggagagtatggtcaacaggtatgaagtttggggagggtaacattgggctctcactttaagcattgatagctaagctgaaggaggaatactctaaaatcattgtcttctcatttaaatgctcttgatcaaattaacagcctctcctgaatattccaattatattaaaaatggcagtagtgttcaatttgccttctgcacaccccctacccaacctctcaccatttctgtgggcttgggattaggcggtgctgtgttgtgtataagggtcagtcttatagggcaggagcctgggctaatagaaagactgtgacttcatgttcctaccaaagaaaaacaagtttatctactgtatgtggtttatcactattttttttttgtgaagaaaattgtttgttttgaaaacagtttgatggactttgtaggcatttctgtggggaagatttgtattgcctggtttattctgtggatctaattcatacacacacacacacgaacgttttgatagagtttgcagagtttgcttctgtttcagaaggtttaaaatttcttttattcagggagaaagagtttaatcaccattactctttttacctttttatggagggaaaatttacatagcataatgtcaatcattgtcaagtgtacaattccgtggtatttagtacattagcttcccaaaaagaatcccatgcctattaagcaacccctccccatttacccctcccccagcccctggctaccactaggtacacctcatctatttaatgttactgaattgtagaatcttgttggcattttactttctattgtagctagctgtttctctgtctctctgtctcattttctccctctctctctctctctctctccctctcattgtctctctcttattctctctctctctgtctctctttctgtctttccctccctccatccctcctcccttccttccttcgttctgtccctctttccctctccctgtctatgcaatagacaaacatagaaaggcaggttcaaaaacagatggggagatgaagagaaagagagaagggtgaagaagggagagagagaagggagaagggagagacagaagagagagaaaatgaaagtaagagaaaaagagggagggagaaggaaagtgtccaggaaagagagagaaaagaatgcagaggacaagaggaggggaaagagataatctaggagtcggagaaaggcagggtaggttttgaaagaaaggactaaaataggcctggtgtggtgatgcacacctgtcgtcccagctacctgggaggccgaggtgggaggatctcttgagcccaggaggccgaggctgcagtgagccatgattgtcccagtgcactccagcctgggcaacagaacgacaccttgtctcaaaaatcaaaacaaacctactccttctcacaggcacacctcagaaagaccggcagagaggcccctatacccccattgagacagaagcaatttgaaagaactgttctgaaatttcaaaagtgtctcatcatccagagaatgaaaaaaggaaagtaggttagacctgtcttgacctctgcaaattcctgccacatgtctcctgggttctgcccatagcaggctctagctctcagtggtgtaaacttcttgagcatttgggggtcacgctgtcatccctggagtcctttcgttaatgtcctgaaaccaactctccatcagtgttttgccttttcagtattctatctcgctgtataattgagtttctgtgattccaatgcagactatggcatgaactcctgtgtgtctagttattatagattagccctgctgatattatgaggtagggaagggttgatatgctgtagagtgacacagaaacccgataacaatgggaaaagagagtttcatataaatcttcttaagtatagtatttccatattaaatgttataaagtgaaggtctggctgcattgataatgtgccctctgctgatggaatgtgcttctgccctcttggcaggcttcctgtggatcctaggtgataaaagccgtccagagtatttcttcattatcatcgtcatcttatgtttacattattctccttgtcactgagaactccagaccccagtctataggaaacggttcccacattgttgaaatatggctggtggtacagggagtagttctgaacgctgagcatggcctcatttggaatattttatgcaatgaaagtgccggtgagaatttagacagcaaagcttaccagtatgaagcagaaaaaggcaaaataaagaggcgtatgtatggacattgcattcatgcatttgtgcccaatggtgttgaattctccttacaccttaatgaaagagtaaaaatgttgaggaggacgtggagctgccaagtaaggtggattattttttgcaaacaattgtattaccattatgatataatgtattactagtatgatataattctatctgccatgatgtgatatgatttataatgatttaaacagttgtattatcagtgtgatacaatggtaggatgatactataaagagatagtgatttcagagtattgcacaacctctgaagccatttggcctgagttcatgctcttggttcacccgttaccaggtgtgtgactgggagcaaatcacaccctggtcctcagttttctcatctgtaaaatggaataataaggataatttatagtattgctgtgagggctcaggagttaatgcatgaaagcacttagaaatgtgtttgatgagaggccgggcacggtggctcatgcctgtaatcccagcactttgggaggccgaggcaggcaaatcacttgagcctgggagttcaagatcaacctgggcaacatagtgagaccccatccctacaacaaatacaaaaacacttagccaagtgtgctggtgtatgcctgtagttccagctacttggaaggctgaggtgggaggatcacttgagcctgggaggcagaggttgcagtgagctgagattataccactgcactccagcctggacaacagagggagaccttgtctcaaaaaaaaaaaaaaaaaaaaaaaagtgctcgatgcctagttagcattccatacattgactattaccattttcattattattaagttcatgtactgaaaccttcaataaaagcagtatttactgggtggaatacaaaactaatgtatgtgtatgtagtttatttatattgtaattttttattctgtataatagaggcatattctgttattaaggaagtaacttgtgctttctgtgccttgattttctcatctgtaaaatggaagtaattctgttactttatagggttgttatggtgattctaggaattaatgtatgtaaagtacttaacacacactggataataagcttgctgtcatcatcaccatcattgctgttactattatctaaaagcagctcacgtcctgaaatctacagtgagaagaatattcactgggctacgtaaacaaaatatacatgctcatctatatagttctttgatataatcatttttattctatataatacaagaagttcaatttttgagtcaaaatggcaatgggaagtctaaattaattcaacacacaaacgaggctgtgattgtttgttttactagagatttattagctttatcaaagtatcgtgtaggaagtagtaaagcgtattcttagatcacagcgcatttgagatgtggttgggtttatggacctgcggcgtgcacagacttgtctgggaggtgcacattcggtgacatgcacctgctctgtgctgtttcctggaagaggagaaggtgcgcccctcccactgattaggcaggcatccttgtgtgggggattaaggagcatattcagttattagctgtgaaatgtcgtggctgcctctgcattgccagctgtgattggtgctggattttaattatcatcaagcaagttccaaatgtttgaaatgtgtctgtggagagagctttggtggagagtgggagaaaaggtcttgatgaaggagcaaaaccttggcatcagccgtgcacacggccctgggatctttgccagctccccaccactgctgctgcagggtttcttgttgaccctaggggctagccccttccattatagaataacaacagttgtcagaaagccatttctcatatttacccaacattcacttttctatagatcctaaaggccctggtattttctcaggtgcaatgcagatgattcttcattcattcatccatgtgcacctctttgtctgtttgttccttgttcaataaatattatgtcaatgcctgctgatatggtttggctgtgtccccacccaaatctcattttgaaatgtaataatccccatgtgtcaagggtggggccaggtggagataattgaatcatgggggcagtttccgccctactcttctcatgggagtgaataagtctcatgagatctgatggttttataaatgggaattctcctgcacaagctctcttgcctgctgccatgtaagatgtgtcttgctttcccctttgtctttcgtcatgaatgtgaactgtgagccaattgcacctctttcctgcccagcgtggtggctcatacctgtaatcccagcactttgggaggccgaggtgggtgaatcacctgaggtcaggagttcaagtccagtctgaccaacatagtgaaaccccctctctactaaaaatacaaaattagccaggtatggtgacacatgcctgtaatcccagctacttgggaggctggggcaggagaattacttgaacccaggtggtggaggttgtagtgagcctagatcacgtcactgcattccagcctgggcaacaagagcgaaactccatctcaagaagaaaaaaaaaaaacagaaaaacaaacagaaaaagtctttcctttataataattacccagtcccaggtatgtctttattagcggcatgagaacagactaatacacctactgtgtgctggctgaggttctcaacgttgtgctgggcaccagggaatataaaacagtaagactcagtctctcctcttgaggagctcagaatggatgtggccggggaatgacaaaatgctatgatgtacaaatgtgaacaattagaatttgtacaaagaaaggaagtttggattaatgctgtcagagtgcaagagcttggggattcttcatggaaaagatgatgccagagaagagctttgaagaaggaaaagggtgttttctaggcaaactcaagtggagttgaattaggagagaagtgcgaagacatgacggatggatggaatgacacaggccaaagaatggagttaggaacgatgtgctgtgcttgggagctgcaagttctgctgacgggtggagagtaaggccaggtgtgagaggaaacaagccagatgggggagcgggatggtcacataggctttgaatgctgtgatgggaagtttagactttacctggcaagaggtagacaaccaccaaatgcttggcaacaaggttctatttgcattttagaaaggccactctggctgcagtgtggatgataagtcagtggatacaagattaaaggcagggagactagtcaagaagttactgtggtcaggaacagtagctcatgcctgtcaccccagcactttgggaggctgagataggagggtttattgaggccaggagttcgagaccggcatgggcaacatagtgagtcctcatctccagaaaaaaaaaaaaaaaaaaaaattagccaggtgtgttgctgtgcacctgtagtcccagctacttgggaggctgaggagggaggattgcctgagcccaggagtttgaggatgcagtgagccaggattgtgccattgcactgcagtctgggtgacagagcaagatcctatctcaaaaaataaaattaaaaagatgctactgcaatggtctaggtggggaaaggcaggtgattgcactaagttaggggtaatgggtttaggagaagcaggtggtttgaataaagttaggagggagaatagaggatcctatggctgtggatgtggtgcaaagagtcaagaaggatacctgcttctagcataggtgaggcaggtggatggcaacagaggaaatatggaaagaaaagtctttccacaagccctggaagagggagggaaaaggagcgttttggtggcatgcagtgacggtccagcccactacctaagcccaggaagcgtcacgtggtacttctcaacaggcagaccaggtatctgagtaaatgtctgctcagttggcaggtgtcagagaaatctacaagcagataaaacaggggctccgagggtgtaaatggtgggatttgaaggaaggtgagtacaaagatgatgctgggggtaagtgtgagatgtgaatggcatgaggtcttggcaggtattacaaggacttgggcacttagtctgaatatgatgggaagccagccatcacaggattttgaacttccaatggggtgctcctgtagtcctggctactttaccagctttgtgacttggagcaaatcattcttggtgactcagttttctcatctgtaaaatggggctaacactggtcatttacagagttattgtgatgatttaaggagtttatttatgaacatgtccagaaatatgcttgcttgcttgctttctttctttctttctttctttctttctttctttctttctttctttctttctttctttctttctttttcttttttgaaatagagacagggtcatattctatcaccaaggctgtagtgccactgcacgactatagcttattgtagcctctaactcctgagttcaacggaacctcctgccacagcctcccaagaagatgagactataggtgcataccatcaggccttacctatttttgctttttaaattttttgtaaagatgggggtctgactagttttctaggctggtcttgaattcctgactttaagcagtcctcccacctgggcttcccaaagtgctaggattatacgtatgagccacgttgctcaccctgaaagtgctcagaaacatgcttcaggcataggtagtatttaacaaatttgctattatcgtttacattattttacctgaagcttgtatctcaaaatcttcaataagaataatatttaatgaggccgggcacagtggctcatgcctgtaataccagcactttgggagggcaaggcgggcggatcacctgaggtcaggagttcaagaccagcctggccaacagggtgtaacctcatctttactaaaaatacaaaaaaaaaaaaaaatgagcggggtgtggtggcggatacctgtaatcccagcttctggggaggctgaggcacaagaattgcctgaacccaggaggcggaggttgcagtgagccgagatcgcagcactgcattccaggctgagtaacagattgagaccctgtctcaagaaaaataataataggctgggtgcaatggcttatgtctgtaatcccagcactttagaaggcaaaggtgggcaggtcacgaggtcgggagttcgagaccagtctgactgatgtggtgaaaccccatctctaataaaaatacaaaacttagctgggcgtggtggtgcatgcctgtaatcccagctactgaggaggctgaggcaggagaattgcttgaatctgggaggtggatgttgcactgagccgagattgcaccactgcactccagcctgggctacagagtgagactccatctcaataataaaaataatgataacaataacaatatttaatgaaataatcatgctgtcttacttgtgagatgccatccttcgggctgttgatttgggaacagagagaaagtcaggggagaaagtcaggagctcagatggaagccattgcagcagttcaggtgggagttgatgctgccttggccccacatggggctatggatacagtgaaaagcagtcaggtgttgtgtaggtatagctgatgggagtttttggcatagcaaatgagaagtcatagagaaagacaagagtcagaaatgagaagcagagaaggtttgcttcatttcagcattatgttctgttggatgagcaacttttaaaaatggagccactatttcagttatcacttccaccagacactgtagagcctctgtcttgaagcccctgacctgcccctgggtgtagcccatcacctttctcatgggactcagacatgaatgcaagtgtggggccagaggccagcctaggagtgagatagactcgctattctcagaatttcccattcctctgtatttcatagtttctcattggtgctgtaacaaattaccacaaattcagtggcttaaagcaagaaccttatgaacgtattatcctcgggttctagagatcagatgtctggaaagagttttagggggataaaatccaggtgttagcagggctcagtttcttccggaggctccagggaagaatctgttttcttgctttttcctgtttctggggactgccactttccttggctcatggtcccttcctccacccttcaaagcacatcactccaacctctgctccatcatcacacctccttttcctctagctccaacctcttttcatttttcttttttttttttttttttgagatgggggtctcactctgtttcccatactggaatatagtggcaccatctctgctcaccgtaacctccacctcccgggttcaagcaatttccatgcctcatcctcccaagtagctgggattacaggcatgcaccaccaaacctggctaatttatgtatttttcatagagatggggcttcaccatgttggtcaggctggtcttgaactcctgacctcaggttatccacccactttggcctccgaaaatcttgaggttacgggtgtgagccaccgtgcctggtcacttctaagggcacttgtgataacataagacacacctgggttatccggaataatctccccagctcaatatccctaattacataacatctgcaaagtccatttggctatgtaaggtaacacattcagaggttctggagatgaggacatggacgtctttgagaaaggccttattcctcctacatctccaatggccaaggcttccttactggcatgggttccttccccagcttcctcttctcgatggccatgaaggctcctcagccttcctgcaaataggcccatcccacagtttttcccccgtgcctgactctcccttagtcttgagctgaaagccctcatttgtgaactgtgtattcatttaactcgattagctcatgtatgtaatgcacgtcgcatagtgcctggcacataggaagcaacttctaaaatagaattcagtctataaatataattttgaatcatggttctgtcactctgcttccaagctgactatgggtctgcaccatctgtaaatatgataaacacatcttctcaggtcatcctttccatcattgataaaaatgtccaactagacagagaactctgacattgctaacagcctataatctgtttataagtattttatatattttttagagaatgaccacctgcatttccaatgtattcttctcttccaatgatttgtacctcatgatccttcatttggcatttactgagttattactatgtgctaggcaccccaggaggttaaatgataaatgacaaacatgaggccagcttccaaggagcttgtgaatcatgctggaagatatgtacatatacgtgcacagctgttccatttattaacattctttggataaattgatggatcagccctgagtctaagctccagcccacattcctcattaattccattaatactgcaatacactcaatctatagcattagtcagtcgaagtgtctaggacctcaaaggaatggaagaggatttgcttgccatcactttttcgtagtgaacgcatgttaccactgaaggatcacctttactcattcagagtggtttcaaggcaccaattagcaaactgttgtgtaacagatgttttgtgtcattgctagcactcattttgttattgttgttattgttgttgttttttgttttgtttttgtttttgagacagtgtctcattctgtcgcccaggctggagggcagtagtgtgatctcggctcactgcagcctctgcctcccgcattaaagtgattctcctgcctcagcctcccgagtagctgggactataggcatgccatcacacccagctaatttttgtatttctttttcattagaggtggggtttccccatgttggccaggctcgccttgaactccttaccttcggtgatccacttgccttgtcctctgaaagttctgggattacaggtgtgagccaccatgcctggccagtattcgttttatatagcatctacccccagcaagatttatagacactggggcatttacccatttccaagtggtttgccttctcttcagttacctataatcactgcatctaattctgaaatcataatgtttgcaagattttatggcacctgggacacaattgattggggtctagattgttcattttaatcaaagtaggagctggtgcctatgtggtagtcaaacagtagatggacttatctcacatgtgccattcatcaaattccaatgttccatacatttatgaatgatctgtgacacacaccatgacttctgttgcatcgttttcccaccacgaacttcacttagcatgtgatggtttttcattcttctctttgttgtttggaggtcattctcttggggcaaaagttaaaagtcaagttagaaatggttaaaatctgcattttcaacacattggagaaaaactctggctcctggaaacagaatgaggaaagcatgaaaatgtggtgaatactttaaaaaagaaatatgcattttctcttctggttaaaaagataaatgcagctcaatacagttaagtaaatgttatacctgctttaagggtgatattgaccatgggaatgcaagagctacccgaattaaaaatggctgttggaatggtaatgcagtatcttgaattaccagtgaaattacttttcctcctcttaatgccttttctctgttagtatattttataccaccaatagccataagcacataaatacctggaagattcagtcctgtcctgtgctaggctcttgctcagaaaacaggtatttaattcccttatacatgatacagaccaaattgcagttgttgtaaaacatgctgtgaacaattttgacagtatcctgcctggtttttcttcacttttttttttttttttttttgccttaaaaagttttatttcacatataggtccaagttgaaatattattttttctggggggaaaaattaccaccccaagcccagtttcttctcaacacttactgtctttataattaattaatttgttgatgatttttctgtcaataccccaatggactgtaagttacataaggaaagccatgataatttgtatccccaaaccaaacacagtttccgagatgtagtagtaactcagtgattatttgttggatgaatgaaaatagacacaaaatggtacacgtatattgaataaattagggttatggaaaaggtcacatttctttaggaagtttgtagaggtggtgacatttaagcaaactgataacatagggggatttattataaattttctctccagtcgatgggcatagacatacttcatcccttgcaggcccagaatccgagatgtctatttttgacttgctatatatagagagaagaaacagtccctctgaatgtgaagttactcagtatttttggctctttggctattttcaaggttcttcatctggacttaaaaaccaaattaataggcgatcgtttcctcccatcttttgcacagacactattttaggagaagaagatctatcacccacagcatgtcagtgaacgaaggggctgtttttactgttcaatcaggaatgagcgtccacagcatcgttgctcacatactccagtaattccctactgacctgcatttactttatttaattccattaatttaagctaaatgaattttatttttaaaatgtgtctgtgcagaactaagcacagagagcatatttctgtttaactccttttgtttgcagcttgaaaaccaatttggatcttttattttcttttcccttggttctaagctttgcttggtcagtgtcttcagcacctaatttgacaattaaatgtatttcacaacccactgacactgcttcattaggttctccaggagtcatcatttccctgcagcctcattccagtcatttctaatagatggtgtgtgtattagtccattgctacactgctatgaagaactacctgagactgtgtaatttataaagaaaagaggtttaattgactcagagtttcacaggctgtataggaggcatggctgggaggcctcaggaaacttacaatcatggtggaatggcgaaggggaagcaagcacatcttcacatggtggcaggagagagagtgaagagggaagttttacagacttttaaataaccagacctcgtgagaactcattcattatcaggagaacagcatgggggaaatctgcacccatcattcagtcacgtcccaccagctccctcctccaacattaagagttataattcaacatgtgatttgggtggggacacagagccaaaccatatcagcatgccaatgaggctcttctgatgggacaaggaaactgccaggctcctcttggtcttgactcttgtgccaggaaagagtagctggatttcatcccaatgccgttcaccctggggaatacctgggttaagagagtttgtatttctactgatgtctcatcaaagaccttgctatttatgctgtccatatcggtgtcttttgtaaaccgaagttggaaagaaatgtttaaaaagaccgtacaatgtaataattactaattacttgatagccagcacttaataaatgcctgacgctgtgctctgtgcctcacaggtattaactaaattgtatcctgagagaaacctgtgaaaggtgtactgttgtttctatgttaaagatgaggagagtgaggcttaaggagagtaagtaatctggccaggccacttacctaagaagtggtggagttggactcacacccaaatagtctgatctccaaactttgcttgaccacatcctgtagcctcttggtttcatggcatagggctggatgctgtgtgctttgctagtcaattttagtaaagactttagacattgtttggtagtggactgggatcctcaggagttaatcacttttactgtttttaagttaccccgggatttatcaaataaatcgaattacttacagttcttcctctagctataacttatttgaaccctctgagttggggttggcgttgtttggtcacagatgaggagggcaaagtcaagaggcagatgttcgggctttccatagacatttcctgagcctgtataagagcctcaccatgcatataagcaatgcagtggttactgagacatgcataatgctactaggacattatgcatgataagtgttttttctgtgtgtgctcaccactgtacctgagtattcttaacattgtgcatggtactttgttagttatctgcaatatcatatgtgctgaattttgcaactcataatatggacagttgatgatttagtgtatgacatcttccttttgcattgtcactgctagtggcttgaagttctgcacccttagaatagcctggttttctgtgggtgtgagagatgtcctggaaactgaccccagttgaaaatcaatctagcctgtttttgtaggacaactctgttgtgaaaacctatgcactcaagggcagctggatcccacttgagcatgccgatggccccttgcagtttgaagtttgtgttgtcatgaggtcagttgcatacaggcagtgatgatgagactacaggacaggcagggcagatagcacatccttcggcctctgatgaaagatgcaaatggaaactgcagtcaggaaggtataatcaaacaccatccacccatgttaatgcagattgtcaggacggccaacctctcctttccccaggagtgtcacaggcatgattaacgtgctctgagttcagcagaaaccactgtggctcttaccccgggctgtgccttagctcaggcctaggtgaaatgcctgggcaagtgatgggattgtcgaggaatgtggaacatcccctgcttcccttctgcccctttcctcatgcctcctgagctgccccagtcatccaacctgcagtttgggtacagggaagtgttgactggagttcagtgcaatatacccttcctgatttcttgacaaattgtttccccgaaccactattctctcctgtgtggctcagaactacttctagttgctaagcaacccacaagcagctgtagcccacaatatcttctagaggggtagacatattatttgggatacttctccagtctcatctttccctgggagatgtcccttcccaagctctggccttccacattacaaacacacctgaatgaaccaaggtgagcatccgacccagggatgcagctcagatgggatgcagaaagctgggccaatttgatatcctctttaaaatttcaatgaaaatgcaaaaacaatactcagaaggtcttaaactgaaatactgtgtagacttgggacttaggtggccattagtcttactctgtcacccaggctggagtgcctcagctcactgcaacttccttctcctgggttcaagcaatcctcctgcctcagcctcctgagtagctgggactacaggcatgcaccaccatgcctggctaatttttgtatttttagtagagacggggcttcaccatgttggccaggctggtcttgaactcttgacctcgtgattcgtccgcctcagcctcccaaagtgctgggattacaggcgtgagccttaggtggccatttctaaatatacatgtattgatgagtaagcagagaaaggtgtggtacatggcatgaaataggatattgaagagaaaataaagaagatggggcctgtgggatgggagaagatggagagagtagtactcatctatgtctgcaaggtagctgggcttaaccaagcttataatttgtccaggggaatctgggtacctgccaggaggtggtttctgttctggcctatggtatttaggctgagaaattaggaaagagactatatgacaagggtagtaaagactaaaaggattggccgggtgcagtggcacatgcctgtaatcccagcaatctgggaggctgaggcaggcggatcacgaggtcaaagagatcaagatcatcctggccaatacggtgaaaacctgtctttactaaaagtacaaaaattagctgggtgtggtactgggcatctgtagtcccaactacttgggaggctgaggcaggagaatcgcttgaacttgggaggcagaggtttcaatgagccgagatcgtgccagtgtgcctcagcctgggtgacagagcgagacaccatctggaaaaaaaaaaaaaaaaaaatcagtaataggatcaagagggtggtgatatcgaatgagtccagtcaagtgcaacagtgaacagtatggatgagctgggagaatagaaggcaatgctctaagaatggatgcttgatattcagagctggagagagggtctaggctgcgtctgtggagtgtatggctgaggtggagttggaagcaaacatgattggagtcagtgatgagaaagacaagggagaccaggatgttgagtgcaccgtccaagagtgatgaccagagtcatggcggacggagaggcagtgagcccagtgccgttgctctcattgaggaggatgagggaacatgccctggggggtggtgagtggatggcagctgtatgagggatggggctaataatgtctaatgccgctgatctcaagtgagccagggttctaagggaggcaggtgaagagagagttgtaagtatctctggggaacaaataggacccagacatcctaagggaacgagctctctcctgtgtacatagcttcccctaaagtcctctgctagattctttctctctgactgcttgtcagcttcgttttattttcttgtttttttgttttgttttgttttgttttttcttttttttgagacggagttttgctcttgttgcccaggctggagtgcagtggggcaatctcggcccactgcaacctctgcctccaggattcaagcaattctcctgcctcagcctcccaagtagttgggattacaggcgtgtgccaccgtgcccagctaatcttttgtaattttagtacagacggggtttcgccatgtcatctaggctgatcttgaactcctcacctcaggtgatccacccactttggcctctcaaagtgctcggattacaggtgtgagccacctcgtgcagtcagcttcattttctcttatttctgactgtctgtcttcacgtagccaggatatagcccatgttttacgtctcacagctttagcccttgaagagagatggactaaacactctctgtctcatcccaagtctggggaagacagtccttctctattgaattggatgcttatctctgactcaggcagcagtggtcagcgtggcgggagggtcttcctaatttgctattaggatgaattcctagcaagatattatggaatgacaattccacatgcctgtgagagtcactttctaaagattgctctgaggaattcataggctttgtttccaagcttttaattcttccaagcccttaactctcagtatctaacaaccttccctcacaggctgccgggtgatagaaagggtcattgacgtccagcccttcagcagccagtgagaatagcaggggacagagcttgacttagtggtagcttctcagaaaaattcctgggtgggactttggtgcttaaagggggacacatccactcgaatgtttgtctttctggttagaaataaacactgttggccgtgcacggtggctcacacctgtaatcccagcactttgggaggccaaggtgggtggatcacgaggtcaagagattgagaccatccagaccaacatggtgaaaatcctgtctctactgaaaatacaaaaattagctgggcatggtggcacgcgcctgtaatcccagctactcaggaggctgaggcaggagaatcgcttgagcctgggaagcggaggttgcagtgagctgagatcacaccactgcactccagcctgggagaaagcaagcctcagaaaataaaaaaaaaagaaaagaaaaaaaaagaaacagtgttcctctgctgtcttccttctcgtaaattaaaactgcctaacacaccttctcttcaggtatgcagaagtcgccagaaacaagtgttttgtgatatcagtctccctgtcttttctctttgtaattcccaacaattgaggctgtatttctaggaagtgctttgaaagacagcgtccccttctcttgtcctgccgtcattggtcaaaacattttggggaattgcaagggagtagtcagattcatcttttaacagaagaatatgaaaaccttggaatatgatatcagtttggtgcaaaaatgattgtgtgtttgccatgcgaaagtaaccgcaattacttttgcaccaacttaataaaaatgtatctttctgagtcccaccctgagacattctgatgtgaaagtgagtaccaggaatctgtacttggagccagggtctggaaattcagcaggacccactttggaaatattgctttaatactttattagaatggaacttggaaaacagttcccagcccccagttttccctgaacacctactgcctgtttttcacataggcctgggtgagctattgtatcccttccatgtatatgaaggaagcatattcctttccggctgaatcttggccatctcaaaggtgtgaagatttctttcctcccttgttttcctccctttcttcctgtaggattcctgcgtgctatctctcacgttcattctcttttccctactactacaagcaaagcaaacacaaagtaaactaaaatgccccttgttttataaaaatatttcttctgttgctcattttcccatcccccccatcctggccaagcatgccttgtttaggaggttttgcattgttttgatttctccttgtgaagcatttatccccagaaactctctagtacacaaggaccttcctgaaaatctctcaaggatgtgagcaggagccttaacaatacttgaaaatacccagtgtgctctgtaacttctctcccactggtaaacgatgtcctcacaagctcattgatgagagtctctaagatgtacttgttaccaaggatgcaattttaatcagtgatttataaaactgaaatgatagagaaaaatgctctttcatttactaagtcattctttaatttgttcatccagccatctttccatctgtccatctacccatctacccatctacccacaatctacctgccagcctacctatccatttacccatctctccatctagctatccattcatccatgcacccatccatccatccatccatccatccctccatccatgcactcattcaattaacatttattgaatccccatttatgttctacagtagagccaaaagtgatgatttgaacagtgttagtactcaggaaggccactgtcttggtgatagggatatataaatatatatgtgtatatgaacagatattgtataatgtagtggccctaagcacagagtcactgatattcacaaagcataatgtgaaatgaggaagttattcttgtcacgcactgcatcctcatcgattgctgtcctgttgtgaaccacggttgaagtcaggtgtgtttctttacttggttttgtcagtgtgcactgggcaggttgtaaataccacaagagcaggaacagtgtctgcttaattgaatatgctctccccaggacccggcacaatgcctggcacatggtggacgcccaagggctccaaaagccaatgttccaagcagaaggtttgacatggtttggctgtgaccccacccaaatctcatcttgaattgtaacttccacaattcctacgggtcatgggagggaacccgtgggagggaattgaatcatgggagtgggtctttctcatgctgttcttgtgataatgaataagtctcatgagatctgatggttttataaagagaagtttccctgcacaagctctctctctttgcctgctgccatccatgtaagacgtgacttattcctctttgccttctgccatgattgtgaggcctccccagccatgtggaactgtaagtccattaaaccttttttttttcctagtcttgggtatgtctttatcagcagggttaaaatggactaatacaaggcacaataagaagaaaaggccaaagaggccaaaatgcagagtctgtgtggctgaggagagaaagaaaggtatagggaggcaggggaggaaccaaaactgcttttgttagtgggtaaaatgcagagatgaccttctgaagggctggggcttggttctgtgtgagaacagggagtcacacacaggtttgaagcagaaaaatggaacggccaggttttcgttttctatgggttcctctgaaggctgagtggagaatggatttgagggagagtaaaactgatggaggggagggtggcagaagtcaggaagctgttttaagtattccaggcaggagatgatgagaccctgttgaggtggaaacagagaggagagatgtgtgggaggcattcatggcccaggcagaaggagagtaatgcagaatgacttctagatgttagacttgggatgatgggaggatgcaagtggatcagcagggaacatgagaataagagagaacagactgcagaaataataagtttagcctgagattttcttccttttttttatatatataattttttattatactttaagttgtagggtacatgtgctcaacgtgcaggtttgttacatatgtatacatgtgccatgaagattttcttttagagacttttgagaatatcacagggagacatctggtcaactattgcctttatgcatctaaagctcagagaaaaactctctcagttgaggttattgcgttgagatcaacaatgtggtgtggtttaactcatgattatagtcagttcctgcaaagagctggtatagaatgagacaagccaaggataaagtgggaaccagggaagcttattaaccttgcctctgaactccttttttttttttttttttttttgagatggagtttttttttgagatggagccttactctgttgccaggatggcatgcagtgggacaatctgggctcacagcaacctccaccccctgggttcaagcgattctcctgcctcagcctcccgagtagctgggactacaggcacacaccaccatgcccagttaatttttgtatttttagttgcgacagggtttcaccattttggccaggatggtctcgatttcctgacctcgtgatctgccctcctcagcctcccaaagtgctgggattactggcgtgagccactgcgcccggccatctctgaactctttaaaggtgaggctcatttgattcagcatccctgttaactatacacagagtaggtcctttcacttttttaaatttttttttattttttagggatagggtctctgtttgtcattcagactggagcgcactggcgtgattatagctcacttcagccttcaacttctgggctcaagcaatcctcccacctcaacctctcaagtagccaggaatacatgcacgtgccacctaatgtttaaattaatttaaaaactgattttaatttttaagcctagttaattttcaaattattcattagagccagggtcttgtcatgttgcccaggctggtctagaacttctgggcccaagcagtcctcctgcttagcttcccaaagtgctgggatgacaggcgtgagccaccacacctggccagtaggtgcttttaaaaatattattggtttctggagtattggtcaaaagttttaagattcccattgcatcttcaaaaggtagagaatttggtttaaatcacttcattgttttcggaaaaatatagattttaaacttaaaaaaatttctcatgtaagggacattcaagtaacatagaagggaccaggagtttggagtatgttatttatttactcaatatatatgtatcaatgccttctgtattcaagtgatgaatgtgggaccctagggggcagtgctggctaggaattatggccaatgacttaaacaattacttacagatccttggtttcttcatctgtaaaatgggaataagaacatctactttttaggattactattctaattaatttaagttaatatagattaaatagagttagttatatttactataaatgttattctaaatcattttatttatttagtgtctgcattataataagggctgaaagaaaaccaaagagagaggtgtcctgatgcaattatgattacattacctttgcttgtcagccacatagcgctctttttactgagacctaaaagtgtttggatttcccaaaccattgccaaactggtaggtgaggagcctctgtctagcatactaataagctaaggtttgtgttttgcctgtacttttcattttccaggaatgaaaaatacattttcactctttgtcattttaatgaaatcaagtctagggaaacatgaaacgcaagtcacattccttttcaacgggaaaacttcgaaaaccgcacaccagattgcgaactgttaaaattcattcattaaaagttcatggtctattggactttttttccttcaagcgttgcattatgtacatttcctatctgtgtttgtgtgacagattgtctaacagatttcttgtacagtggagttacagagtctgccagaaaggcctagtttggaacctgtggccatcggtgaaagggatttggaaatgccatcttgttagctaccggataatttagtaatcatggcctaacagatccctcaagaccaacaattacatacctgtttgaagctaattggactatacagaaatgggagttatatgaattatatgttataaaaatgaggtaggcgttaagtggactgatattacattctgaaacctagaatgactttcaatcattttagtgcacaggcttagagtagccaggatgcttggcggaggttgtctgtcatatcagagtgcctgtttttagaccgtgtgctaattctgtgtgtcgctatatgcatatgaatgcatactgtgtatctctacgtgcgcggacaaatcacatatttgtttacccttaaagtttgctgataacaagcgttaaaaattagaattcataatccagattttgaaagccgcctgtatgccacaccaaatgctgctgaagagttatgggaaggcttttatttttagcactcagtaaattaaaccttttattcatcattcccaaagaagagaacatccgttcttattaatttaaggaaggggaaagacagccgtccaatcggagtgaacctgtgtgttaggacttgttcaagggagtgacatcacacacgctgtcatccttacatcagttaattaattatctgtgttacaataacaagatatttcagacaagagtctctctctctctctcataataactttaagcatggtagttagagtgttgagttctggttgcaaagacatttcccttaattcaatgcattttctctgaataattcatgtttgttcgtttggtttttttataacatataactgatcagacatttttcttttttttcttttcttttctttctttttttttttttttttttttgagatggaatcctgctctgttgcccaggctggaatggagtggcgtgattttggctcactgcaatctccccctcctgggttcaagcaattctcctatcttagcctcccaagtagctgggattacaggtgtgtgccaccacacccagctaatttttttattttaatagaggcggggcttcaccatgttgaccaggctggtcttgaactcgtgaccttgtgatctgcccgccttggcctcccaaagtgctgggattacagacgtgagccactgcgcccaaccaggcatttttcaaccacagcagttttgacatttcgggctagatgaatttattttaggtatggacatttctgtgtatcacagaatgtttagcagcattcctagactttacctgcccatagcaccctgtgcagttgtgacaaccaaaaaatctctagatgtttctttttccccctaaatgtcacctggaggacaaaatcacccctgattgagaacccatgctgtctactcatgagactgtcatttaggatatcatcaactgaaaaaatgttaaaatgaaagtatatgtgcttcagttgtattcatcctgcagtatttttttgtgccttcagccaccttatcctattaaacattttccaaatgtaaggtacatatgtagccactatttttgtactggttctagacaatatattttattttgagttgagagatagcagccattttcagtcattttaaatttgattaagatttaatgagaagagaaaaaaggcatacattttcgtaaactaatttcagcagatgtgtggatgcttttatataaacctacattgaaaaagaaggtagcagttatcattaggacagaaagacataaagtcctatatttctgccattgtaagtatatgtacatcatacaggtctggaataaaaaaatgtaaagtgtttctatgacccttcgctaatcacagaggaccaaggaggagagaggaatggagactttggaacaggtcaagtgctgcacatagcataatatagcttccctagatggctctgtattaaaatctcagaattaagttattctgtcatcgactcattccgaaagaaatcatgcttgctcgtttctcatgtctacccttactgccttctgtggggcatccagatgtttcaaaggtctgaaatgtaacaattatgttgcaggaattgcagtggctttgtttcggggtagaacattccaggctgtgagtttctttggaaggcaggcttctgattaggtgttgccaaaggctctgcctaaacgtttgttttctgttgatggagtctaagagctgagtggttttattttcctagaaacagctgcttcctttcagttggctgaatcggaggatttattccccttttccactgcacacagagccttatgatgggcactgggatgtggaaggagtggtatcaaaggaaaagtcatcttgtctttcagtgtttagcgtcaacactggggtaaatctctaacgttgcattctggagtgctgtttaagagtgtttttattttctttgaattcaagcatactggaaagaaggggtacctggtggcccatattttattagcaacgtactgcagcctcccatcaggttcttgctaatgaaggtggcatggccccactgccccctgaatctgcaggaaagtggatatgagaggcagtattcaggaagattttgaaaaggatgttttcccttcatttctccagatgctgtaaaacttcatgctggatgatgccaggtcaggagagagctgtgtgcatggagtggattgcgttagttccctgctagaattgcttttattggattgcaatttggggtaatattaggagcccatctttaaggagatagtaagaaacaggcatgccttttgtgcctctttgaggaggtggtggggatatgtacatctcaggtcctctggcatggtgactataaatcctggcttccctgtgtttcagaacacctggatccaaatcccagctctgcttttttacctaagtattttttgactcctataagcatttgcttcctcatctataatatgagggaaataatagctcccacatcacgagttgtgaagctcccgataaagagagtgggttagtcacttacctgcactgaatgttcaaaaattgtcactatcctgcttgttacatgataaaacctccgtttgctccagccttaaggaataactgtgctaattttattggttatttattggtttattttcacaatataggtacctggaatggtggatatcaaccataagatttccttccatgccgattggtaggaaagccagcaggaaatgttggcctctacccagccaacatggagtgctttgaggtttgtgtgtgggtattaacttcattcctggcttcagtatgtttccaacccctgtttccatttctttacttttatcacctcttaacaagatagataaataaatctgttttatgctgctgtattgtgtttgtcaatatgaagcaaattaatcctttcttgacctgtggtggtggcaggggaataaattttatatatatatacatatatatatgtgtatatatatatatatatatatacatatatatatgtatatatatatatatacatatatatatatatatatgtgtatatatatatatatatatatatatatatatatatctcctctgaaatattgatcttctcttcttctttataacccctgaataacaggagccacaaactcaaacatctaagcagatagcatcaatgagaaaaatgggcccagtttaagacaatagggattagtgggtactgccataaatagacaggatattttccattctccaaccacacctccatatttcttcaccattgagtgtctcagttaccccgatgtccactcttcctttctcatcccatgtctttcaattcaacacagtattcttttgatccagtgcatgcttgtaaattttgctaaaactctacctattattcttttatttttttatttttgaagcaaaatagcatgttctgaggtagcctagaaatgtgtctgacacaaagcattctgtggggttagaagaacaactaataattatggaagtatcaacattaggaatagtggttgctgacatttattagtacttgctatgttctgcttaactatgttgcatgctttagatgatttttttgactttcaaccccaggagttaggtaatcttcttatctccattgttatcactaggaatatggagatgcaaggagacagagagactcactcgggccaaaatccagttgctcaacacttccacctgtcagcctcctgggcgtgacttccccaacgtggggaagatctgatgtgtgttttgtaggtattaccaccttcacctggaaataattcaccactctctaacttagatacttcctggtcatctttcgagactcagctctgggctatcaccagccttagaagccttcccttaccaccctttactggggcaggtgtcccctcctgtgtttcttggctcacaccaccacagacagagcacatacagtattatgagcaacttttggccctgtgctgctcttcctcccgtgactccatccatgactccttcctcccatgactccatccatggctctttccttccatggttccatccatggctccttccttccatgactccatccatggccactccctcccatgactccatccatggccccttccttccatgacccctccctcccatgagtccacccatggctctccttccttccatgactctatccatggttccatccatggctccttccttccatgactccatccatggctccttccttccatggctccatccatggatccttccttccatgactccatccatggctccttccttccatggctccatccatggctccttccttccatgactccatccatgggtccttccttccacggctccatccatggatccttccttccatgactccacccatggcttcttccttccatgactccacccatggctccttccttccatgactccatccatgactccatccatggctccttccttccatgactccatccatggctgcatcctttcatgactctatccatggtcccttccttccatggctccatccatggctccttccttccctggctctcttctttccatgtctcttttccttccataactctcttccttccacgtctctcttcctgccatgactccatccatggccccttccttccatggctccatccttccatgactccagtgccatattttgtaggcaaaaactcatggagagaaaaagaccctctgagaagcatctaccagggatgtacctagagatcgtcaagtgatacctgaacaataggggccacaaactcaactatctaagcaaatagcatcaatgagaaaaatgggcccagtttaagacaatagggattgatgggagctgccataaatagacatgatatttgactataggtggttcacagtttagcctttgcagttagactgctttaaagtggatccttgtgccttatttcactagctatgtgacctgggttaataatgagtctctctgtgtctcagttgccacatccacaaaatgaggaaaataattatgcctaccctaggggggtcctgagtagatataagatggtgttcataaagcccttagcacacagctttgcacctagaaggtgctcattaaattagttcctgttctccatgcttagtataacttctgtatgatgttcagcgttgctttggggcaacactgcaggcaattaaattgtctttctttaattgtcatttcttcctcttattccacaggtatgtattgtacaactactctaaagtggggcacaaaatagacaaagcccctgactttctttttttaattattatcatccttttaacttctgggatacatgtacagaacgtgcaagttcgttacataggtatacacatgccacagtggtttgctgcacccatcaacctgtcatctacattaggtatttgtcctaatgccatccctcctctagccccccaccccttgacaggccccggtgtgtgatgttccccttcctgtgtccatgtgttttcattattcaactcgtatttatgagtgaaaacatgcggtgtttggttttctgttcctgtgttagtttgctgagaatgatggtctacgcaaataaactagaaaatctacaagaaatggataaattcctggacacatacaccctcccaagactaaaccaggaagaagccgaatcccttaatagaccaataacaagttctgaaattgaggcagtaattaatagcctaccaaccaaaaaaaagcccaggaccagacggattcacagtagaattctaccagaggtgcgaagaggagctggtactgttccttctgaaactatttccaaacaatagaaaaagagggactcctccgtaactcattttatggaagcccctgactttctaagcttattggtttcactggtgttgtctgtaatggcagccatgagccccatgtgactgtttaaatttaaatgtaaaaattcagtgcctcactgggactagttacatttcaagtgcttactgaccacacagggccagaggctaccatactggatggcacggatatgtgagtttgctgaagctgccatagtaaaatgccacagactgtttggcttaagcaatagaaacttaattgtctctcagttctggaggccgaagtccaaatccaaggcgttggcatggttggtttgttctgaggctttcctgcttggttggtagatggccgtcttctctctgggttttcacatggtctttctgtgtctgtgtctttgtctttgtctcctcttcttgcaaaggcagcagtcatgttggatgagggcccaccctatgacctcgttttaactcagtcacctctttaaagaccttctttccaaatacacattctgatgtacagggggttaaggcttcaatatatgaatttgggagtggggcaagtatgccattcagcacatcacaacaggatagaaaatttttataattacagatggtggctcattcctgcaactgtagcactttgggaggtcaaggcaggtgaatctcttaagcccaggagtttaagaccagcctgggcaacatagcagaaccatatctctactaaaaatacaaaaattagctgggtgtggtggtatgtgcctgtggtcccagctatttgggaggctgaggagggaggatcacctgagcctggggagatcaagactgtggtgagctgagattgctccactgcactgtaatttatgtgactgagtgagacaccttctcaaaaacaaggaaacaaaaaatgaaaacaaacaaaaaacaccttaaacaaataaatgtccgtgttatttactaatactgaatatatacttaaaaccagcacttcacctacatgtgcattcttctgcctgggaggtgttgatagagtgaccttaggaaaatgtctttgtctgtggttcaaaaatgaattggacttgagtgagaagaggcacacatcttctctccccctccctccccttgcttcttcccatttccatgttccgtcccctattattctctcatactctatttctcctcatatacaggtttttttttttttttttttttttttttttttttttttttttgagttggcgtctcgccctgtcacccaggctggagtacagcggcacatctcggctcactgcaacctctgcctcccaggttcatgccattctcctgcctcagcctcccaagtagctgggactataggcacccactaccatgcctggctaatttttttttttttttttgtatttttagtagagacggggtttcactgtgttagccaggatggtctcaatctcctgacctcaggatccacccgccctggcctcccaaagtgctgggattacaggcgtgagccgccacgcctggcctaccaggtgtttttctaggccctattttagaagaggaagaaaagatttttaccctcaaggaatcttcagtctactggtgtctgagagacctgaacaacctaaccacgatgtattgccaaagctggtgagacagaagcaggggaaaaatgaaacaggatcccttggaagggagatgtcactcctgctctgcggtcgtgggaaaggctgcagagagaaggcatttcctctacacccaaccttgaccttcagcaagtcccttagcctcccgttgagtggcaggcaacatgtaaacagcagctatctcttagagggcaggagttctatgaatgcacttattaatcactgtgaagctgatgaaaacgatcaccataaaactatgacacactccttttcttttccaagaccagtagtgctgaaaggccttcttgtccgaggcttaccatatagacaggtacctcatatcaccatgaatatatgacgactttttaatcaagtgttaatggtctcctacacttcacaaagcaggaatggagggggtcgttgcagctggtaatgaccgtatttgcttttattgtatgattacctttattcaatctctagttccaaaaagggttttagatggcttataataaaggtgcagattcaataaaccatgagattattaaaagaaattacgtggtgagcctagtaatgaaataattggggggtggtaagaaaatattcacagaaatcttaagatttcattttttccaattgattaagaatcttagactaaagctagccactggaactgagcacaaagcttatatctaaggattctgataaaatgcaaagaaaagaagaaagaaaaaaagaaacaaagattatatgtctttatatgtcgagctatattgctttcttctttcaacaataatttatttagcacctactctgttgctggggttttgatagatgctggggagtggagggagaaagatataaatactattaagaccaagtcctttcagatagaagaattatgtatttctgtaaaagagaattgtgtatttttagaaaagaacatggattagtgtgtgtgtatgtgtgtgcgtgtgtaagagtgtgcatctattcaagctttgtttttccccctagatatgggtgtctcaccctgtcttccaggctggagtgcattggcatggtcatagcttactgctgttctgaagttctgggctcaagcaatattcccatctcagcctctagagtggctgcgattattcaagtttatcattgatgattgggaagagccacagtcaatgaacctagagaccagataacttagggccctgttaaggcaagttaaggagtttagcttttactttaaggacaattgggaaccattgaagtggatcaaattttctatttagaaagataactctccctgcagtgtggagaatggattgcggtggaaggagagaggagaggaacatcagttagagggcggttgcaggctgatgggcactttgggtgggaataatggctatgggaatgaagacaactgaatggatccgtgagacacagagcaagataaactatttaacttgtagatcaattgtacatgaagaatgaagttatgagaggaagcaacgtggactcaagtttcattctggtaccttctagttggattcatgtaccatttaatgagatggcagaattagaaaaaagagaaagtattgggtcttagtgagaagatgatgtattaacttgtaggtatgatgtctgagatgtttggaagacacttaggagaagatagatgttaagtaggcagctgagtataagaatctcacactgagaagtgagaggggattggtgatttgggagccttggagtataaacaggttttaagccatgggaattgatggagtcctctaggtagagtttaaagaatgaaaagaaaagaaaatccaagacgtctttggaccccaaacattgagacgtttcccagaggagaaaggatttataagacagtctaagcaccagtagctagagatgtcagaaaatcagcaggaaatagtggtgttatggaagcaaaaggaaaactacgtattacagagcctgtgatggagtggccatagggtcccttgccaatggaagccatggcattggatgatagactcaagaagtactcagagtgagagaagatgagagcccaggacacatctctgggcccttgtgttattttctggtgactgtgaatttccggaagtccccccccccgcaatagctttgatttgacatggagagaagtgtgccttccatgatacactgtgaattactgactaccgttccaggcatcttaactataactttaatcatctgagctctagctcccatcaccattcctgcagtgccccaggactcattaaatcgccaggggtattcgaagacctcccaattaaggacccgttttatgagcatagttgaaatcctggaaattattgcctctttgaggcacaggagtaggtgctggtatctgctaggatgaatgataatgtggaccccggtgatttgctgtccttcatcgtttgatctgctttaatgaccagagagtaattagtccgttgttgtgtgcagctaggtgttacaaatggagttgtaaattcagcgccttggaataaaaagtggctattagtttctcccctgcaattcagtttacagatagttctggggcaaagtgagaagaagcccagtgtgccctttcaggggtgacatggtggtcacgtacatgtgcaaacagatgcgtgtgcacacacatacataggtttgtgttctcaaaactgaaaaaaaaaagaatctctttgatgtaatttctttgtagcatgtttttaaatgaagatattgaagctgatggcatccagggctggggaagtttgaagaagggaacagaaaattttgcaattggatttccagcagtaactgtgtgcaaacacggcccctccctgtatagcagaactctgtgttatcctgagctctggaagttcgtctgcagcatgaagttttttaccttgctggcatcactcaggaccacagagggagcatgcctgctggttaaggatctgtgggactacctgtgttctcagtctggctgtactatttactattggtttcaccttggaaaagacacttaatgcctctaaggcttcatttctccatctattaatgaagatagccgtagaaccagactcattgatttattagaagactcaaatgagaacattcacggaaagagcttgccatgacaccagagatataccaggtgctaaataagttgcttattattctcacatcttcatcacagtaaacaacttggagaatacagacaaaccaggcatcaaccattggtgtttcagagcaagagaataactgacatccagtatcgtttcctaagttgatcaaactcttcctgaccatgtggcgatatatgcagaggcccctcaaaccacagggaaaacaaggtaaagtggccagtgctatgctcatttgacctaggagtaaggaatgaaaaacggtatctgtgttaaagcaattacagatatacgacagagttgcatgtaaaatgcatgtggatttctaggacaaacacatcatatcaaatgcatcttgcccttgcaatacttgattccagttgtgtttcccagaattactggagggttaggtcactctcctctggggacagctgattttctccacaaaactggtgattaggaggactgtggaaatgtgcccacacttcccagtaagcatttcttcttgtgctttattgaagattccactagaaattaagtgctttggaaattgaagttttgaaatcagcacattttcagccaagcctggtggctcacgcctgtaatcccagcactttgggaggccaaggtgggtggatcccgaggtcagcagatcgagaccatcctggctaacacagtgaaaccccgtctctactaaaactacaaaaaaattagccggccatggtggcgggtgcctgtagtcccagctacttgggaggctgaggcaggagaatggcgtgaacccgggaggcagaggttgcagtgagccgagatggcgccactgcactccagcctgggcgacagagggcgaaatcagcaagttttctttattcaggatactcactcggcttaccatgccatcctttcaaaagagttttaattttatttctcctctctgcatcccctcagtatgaatttaggtacaccaagaatttatcaagcttcaaaataatctaaactatttgaaatggaagacacctaagaaagaaaatcgctttagagctgatcagtcactgacctctatatctcatctcaaagattttcttttaattaccctatatctcatgcttctgatatctttaaagattaataaggcatccatatatccaaacaatatagatatatggaatatagaaaataccaatgtctttagagtcaatacttaaaaaatcttgctcttgccgggcacagtggctcatgactgtaatcccagcactttgggaggctgaggtgggcggatcacctgagattgggagtttgagaccagcctggccaacatggagaaactgagaaaccctgtctctacataagatacaaaattagctggatgtggtggcgaatgcctgtaatcccagctacttgggaggctgaggcaggagaatagcttgaacctgagaggcggaggttgtggtgagctgagatagtgccattgcactccagcccgggcaacaagagtgaaactccatctcaaaaaaaaaaaaaaaaaaaaaaaaaaaaaaaaaaaaaaaaaaaattcttgctctttctcatgaatagctgcccaatattctgtaatgtaggttatattagattgcttggggctgccataatacagcattgcagacttggcagcttaagtaacagaagtttattttctcatagttctggaggctggacatccaagattaaggtgtcagcaggattggttccattggttctctctccttggcttgtacgtggccatcttttccctgtgtttttccctgtgtgtgtgactgtgtcctaatctcttcttataagaacactggtcatagtggacaacctataggatgagagaaaatttttgcaatctatccgtctgacaaaggtctaatatccagaatctacaaggaacttaaggaaatttacaagaaaaaaaacaccccatagaaaagtgggcaaaggctatgaacagacacttctcaaaaaaaaaacatacatgcggccaaacatatgagaaaaagctcaacatcagcgatcattagagagatgcaaatcaaaaccacaatgagataccatctcacaccagtcagaatggcgattattaaaaagttaagaaacaacagatgctggtgagcttgtagataaataggaacacttttacactgttagtgggaatgtaaattcattcaaccattgtggaagacagtgtggtgattccttaaaggtttagaaccaaaaataccatttgctgcagcaatcccattactgggtatatagccaaaggaatataaatcattctattataaagatacatgcacgtatatgttaatagaagcactattcagaataccaaaaaaaaaaaaaagtggaatcaacctaaatgcccatcaatgatagactggataaagaaaatgtaatacatgtacaccatggaatactatgcagccataaaaaggactgagatcatgtcctttgcaaggtcatggatgaaactggaagccattaccttagcaaactaaagcaagaacagaaaaccaaacactgcatgctctcacttataagtgggagctgaacaatgagaacagatagacacagagaggggaacaacactcactagagcctgttgggagagggtggggggaagaaagcattagggaaaagaatgaatgcatgctgggcttagtacctaggtgatgaggctgataggtgcagcagcccatcatggcacgcatttacctatgtagtgcacccacacatcctgcacatgtatcccagaacttaaaaaaattaattaaattttaaaaaaagaacactggtcatagtggattagagcctacccttatggattccttttaacttaattaactcgttaaagaccttatctccaaataagggcacattctgaggtttgagggattaagacttcaacgtatgaattttgagggctactatcagcccatgacttaggtgtatgtaatttatttaactatattcccatccatgatctttcaggctaattttacttgttttgtatttcttcacattaaacaatgtcatatcaactaatccaaccataacacttgtgtggctggataaaacagaaatgttttattgtgatgtggaattttaactttgtcttttttgttcaaactaagaatggcttatgtctccccatagggataacatgattttgttttgacagaaatctttaatggaagattattttttttctcagtggcaatctgcagattaatgggataattttaggtgaactgaagagaatggagggctgttctgtttaagctatctttgtgcttatgtagggacagtaatatcatccaataaaaggacatatgcaattatatcagctttgtggtaattatatggatattttcattgttcagtacatttaattatgctttgttaaacagcctgtattagcttttggtggggcaagctttgactggattaatgccaggggcttgtatgttgaatgtttcacacgatgcatctttctagaaggaaagagcaaacaaaaattaagaaaaagggtcatgattacctttcccttatttttccttttcaacaacatttttaatggacagttccagagacaatttcatcctttataaaatccttatattagtcatttgaaagaaaagcaactaatatatggttttggaaccgttaacccaacacagaactctttagagttaatgtgtggcctcctccccatctaccttcgcagtcctccagtctcactctgggaggggcagaatttccattgacagcctgatgcatgctcttctgtatggtcccctttgctgatacaattatccatgtgcatgcttatgctttttaaagggtggcctcatcctccgccttttattcagtaacttgccttttttgcaaggcatggttattgtccacacatgccaattattaaaaatctacttactccttttacatatctgcatagtattccatagtatggatgcgtcactatttgttcagccatccttccactgatgttctttagattaattcttcgttggatttgtgtatttttttcttctgccaaaataagcattgctataagaaacatttggcacgtatttctttcattttggtactttctgttggctaaaattctctgaaatgaaataattagtaaaagctcaccaattttttaatttcaacaaatattaccatgtttttaccccccaccgccccccacacacaaaattggagcaatttgaagtcttcccgacgctataaactacctgaacaacactggatgttagcaatcttttaaaaagtattgagtatacacatggcacattgttgctttaattttcatgttcttgacgactaattatacacaaaatctttcctcttataggaattatttaggtacaatatttgttcattttcaattagtttatctttttcttgttaatctattaattcttcgtatcttaaagctgttcaccttagcttgtgaaacttgtgataaacacatgctgtgatttaccttttgagtttatctacaagatcctagtccacttaaaagtactttgtgatcacttttattaataacttaaggagctatccttcccctattcaacttttataaaaacagcctcttgtaatactttatagttttttgctttatctttaggtgtttaaatttacctggaatttacttttgcaaagctaagtatgaaatctaacatgcattatttttcctgtaaagggtagtcagatggcctaatgacaacattaattccatattccaccctttctgttaactcggatgtgtgcatatactcacacagatcacaatttctgaactctattaactcaggtcaactatttatttgctgttgtgtattaaagagttttgcctactaatatattttagccttggcaggatgctatgagatgacatagtaacgataagaattccttactttaaaagttgggcaggtaacatttggggtcagaagctttttgaactgatgaactagttagatttgatggggggtcggggcggagtgtaagtggcagaaatctgacccaagctgatgcaagcaagaaggaagagtattgactttcagacaggaaaaccaagggttgctctaagcttactgaattcagaagctcaaccaatgtcgtgagcaccggtctcgttcaccatgtcatttagctctcttacagccatgtttagcttggctccgccattatacagcagaaagatgcttactaaccgccccaagtttcatcttattccctgaacagcaccagcaaagcacactgaatcacgtgcccatcactaaacaatccccactgttagaaggaggtgagttcctcactggctagactagctctcgcgcccaccatgacctaggaggtgtaatcaatcctgcaggaaccacccagcttgatagtttatcctcccagagaggaggagagccactaagaaaaaatcaaatgctgttaccagaaagaggggctgaccatttgataggctaaaactagtgaatttcactgttcctgattaatgtgaatcaaattttcatgttagttccgaaaattttatcccactgggatgaaggcaactttttcatcgaaatgtgggccacatttaattcctgcatgtaaatgttggtatccagagaaaaacaaattaagataacaatgagatgcgatctttacaacttgaattggcaaagattaacaagttgctaatagccattttggtactactgtgagtaaaacaaaaaaaatcatatattaatggttggagtgcaaactggaataatctttgaagagctgcttttacgaaaagatatacagcttttatcagcaatgcttttttaatgaattaactccatagcaaaaatattttcaattggtttgaaaatagctacgccaatacacaaaagtatgcttgtgaaagtcttggatgacagcaacaacaagcgttgtttgtaataacgaagtcctaccctgatctaatgcatactagtagtgagctgattataaaattgctgtctagttatgcatttgcctgacatttgaagaaaggacaattataccttttaaattaataccattgtttaaatgaaaagaaaacagctacttaatgaagatttagccctaacatcgctgctatagttaattcttcgcaatgattcaccctagagtggtcaggtcacctctcttgtgctttgattacaccttccatatggattacggatcatatgcaaaacatttaattactgagctacagcattaatcacttggctgaatgtatttcaccttttctccttcctgcaatgtttaagccaagttaactgatagcagtgcgttaaaaacaggtagtactatacagcagtaggagaatgtagcctccagcacagagatcccgggggcaattctggagctatcatttattagctctgttgccctcgggcaaatcacttactagctcaggtgagtctgtatcttcttttgtaacatggtcataataaacacagtttctcatatctagcctgattatcgtgaattgtccacacagtatatataagccctgaagccctggacacaaatgtgtaaacattgttcttatggaactgctgattattattattaatctccattttcttgtttctgtgcgatcaggtttttacccatgcaaagtggttgtctaagactatatagatgtgtagagagaggcagagtaggttatttggaaaaagaaagtggtggagtgaggttttgttgttgttattgttgttaattattttatttcatagggagaaggagggcactctccgtgtaccttcgtaaagaatagtacatactctttattttgacagtgtagggtaaacctgtaagagtcaagaaaataacagatttgatactaccctttagtggctatcttgcatgttaatgtatatcctttcatttctgtctgagttcagcagttagactcagctcgtgggttcctacagctcaatttctaaaatctacgtaagaagtaaaatgctgctaagtttacctgcacttttagtgtacattcagatcagagtcttctcagttatagatgtatagggctgtgtgtgtgtgtgtgtgtgtgtgtgtgtgtgtgtgtgtatttatgtccttaaattaagcgctattggagcatggccctgcatatttgtttctgtattgcctgtggtcatttttgtgctaaaagggaagaattgaggagttgcaacagagaccatgtggtccaaaatatttactatatggctctttgcaggacaaaagaaatgctaactgttgatttaggctacagtttactttaagtcactgttacatcaatgaaaaacttggaaactaaatacatttgtgtgtttgtgtgtgtgtgtgtgtgttctttaaacttttaagctaatccttagtttaaccaaaaagaaagactgggtgtcgtggctcatgcctgtaatcctagcatattgagaggctgaggtgggtggatcacttgaggtcacgagtttgagaccagcctggtcaacatggtgaaaccccatctctactaaaaatatgaaaattagccaggtgtggtggtgggcacctgtaatcccagctacttgggaggctgaggcagaagaatcgcttgaacccgggaggcagaggttgcaagtgagctgaggttgcaccactgcactccagcctgggcgacagattaaaactctatctcaaaaaaaaaaaaaaggattaaggattaaaaaaaattgaaatcatccatggttataatattcttgactgcatcttaacatcattggtttgtttttcaaatattgttaaatgcttactatattccagttatggtgcgaggtactttcccatatgttatttagttttagaatcctctcagccaccacctgaagtagttgctattaaacccattttagaggtgaggaaacagatgttcaggaggatttaaataacttgccacgtttcttgaaacttcccagagccagaattcaaccttagatatgtatgaattcaatctgatgcttgctgggttaagaccattggagacaccctctctcctctgtccttttgacaattccatgggcagaatatcacaggaatggcaaatagagggataaagaatgtatgtgacatgcacccaaagagtctccaggccccttttcatcctttcaatcatgtttctaaggtattttgaactaggcgaggctctcttagttcgaataatagcatgctgttcaatgtggacattaatagtcagaatctggtagtgcagctacagaagaagcaaagaaaaaaatgaaatcctctcattgatttctagtcagagaggtgcagaaaccctaagagtccttatgtgagaataagtgttttctctctgtgtcaatcttaatataactaaatgcagcagatttaatcctttctataatttaataatttgtattaattacacttaatgaaatataaattaattacatttaatgaaatataataaagtttatttaatatattaattacgtgtaatgtaacatatgggattttatttaatatactaaccatttaatgtaatataataaaatttacttaatatatgaattacagttagtgtaatataataaagtttacttaatatattagttacagttaatgtaatataaagtttacttaatatattaattgcagttaatgtaatataataaagttttcttaatatattaattacagttaatgtaatataaagcttacttaatccatatttaataaattgaattccattaatatgtattatgtgggttaacatacatacagtgttgtaacaacaccaggaccttagtttacattaaaatagtgcttatttttatagtattgttattttaataattatttatgttactgttaaataagttgacatatatttatgtccaggcaaggtgactttatagtagctgggttttccaaagtgccatatttatatcccctagaagtatactatgctgagacaggagttcttagctgtagaataaagagagctggttttgtagaacattaattttgctccaagcttttggaggaaaaatgttgtttcctattaaaaggaaacaaatatacaggaaatagacagctaatgtgcatgcagtttttaagagaaagcccgagactgcagtcatcctgtgtgatatgccactggactcttccatctatggctctggagcccctaagggtaaggattagacctcatctgccattagctagcggtacttaagtgggaaattttgcaaagcagtaaattataacactactcaaaagtggtttctatttttgtaatattatgatgtaaagttactgagtttgataatgcaatctacatccctttgttgaaactgtagaatatggccaataaagggttaatgggaaaatcccagaatctgctttctttttaatgtttctaatggtcatcttagcaccagagcctctttgagagttaagagaaagaaattaccagagaaggagagtctgtgtctcctgggagatggatggtttgggggaatacggagtggggatggtgatttttctctgcacagaaatactttcttgaagtcagccctttactgtgcaatgtgggatagaattctaacacctccagtataatggcaggaggaggaatggttaggaacattggagagctatttggcctatgtctctttgttatgaagggcccacagtttacgtttttgactttttcaccaaataaaggcttatagcaagttacccagatatgttggcagaatggcaaggctacattcatcatagaactttaagcttgtgccccactgctgggccatactgcctgtcaggcccaaattaatatcttttataagccccgcaacgatgttgtaaagaatacaattatagcttaggacattgccatctgtggtgggacatttcaaacagaattaagtctagagattatgagtgatgcatcattgtcactcaaactgaaattggtatagcaccttctgttttattcaaaattctaaagggaaattattctgccacaaaaattctcatctgttaagtagcccttaaatgactttttttttttgcctttgcaaaaacaaataaaaccattttatttgtgtgtgagttagaacattgaaatgttgagcctagatttttaaatgtgtcgtgatttttgcttctcttgctcagtcctcttttctacttctttctgccttttttatttctaattttattttattattttttagtcttttattttaagttcagtggtacatatgcaggtttgtaacataggtaaacttgtgtcatgggggttcattgtacagattatttcatcacccaggtattaagcctagtacctacccactagttatttttcttcatcctctccctccttccaccctccaccctcagatagggcccattgtgtgttgtttccctaccttttcttaggaaccagaagccccaggcattggaagtggtcaaggcatttttttctttgacccctgggaaggtcttttcttagtacacaagcaacaagaacttcagacagagagtatatgatgctgcattacaacctgaaccattggagttctgtcaaaagaatattgaagagatcctggtagaaaagaaaatagagtcaagaaaaaagaaagtgcagagtaaaatatagagaagtagagggaaaataatgtaatgctgccaaacctaataagagtactgaaattgttgcctctcacaagccagtgactttctcaagttacaaccaaggtatgggattcaaatgatcccactgacaatccctctggaaagtctccagttgaagcctaccctatcatttctttaagagacccacatagacaagttttctccaggtctgagctggatttccttcgttgattgagcaccagatgaggaattggcgtgattttaagggccacgtgcactatgcgaaaaagagttagctttgaaaacaagacaaatacggggtgagacgagatgcaaatgctcggaggtatctcagcactcaagaacaaatgcatgttcacatctcctgtgttaggcttgctcactgctttgatagccggtggaatcactggcaacgttcacattttttcctcctcctgttttcttacctcctcatgttttagttgaatgcatgtaacttgagtaagattaaaaagtgattctcagaatcggaactttgagcttcctgcaaaaggaatatttaagcatctctgtatccaagagtaccatcttatctcacgggctcactaagtgggagttaggaatcctacagttcccttcaagacctatagggcagtagatttgaaccttacaatcctatattgtatttcatgttgaccaatctgtaagcaggtaaagaactgccatcttactggtgataaagagtttatgatgttaactgagctctcattctagacaacaaagtaatccagtgtcctattcaaacttaattcatagttatcaaacagtcattaagtatctactttgtgcctgatagacatttctttaaccagaatgctttgccactgtatcctcattcatttaaaatagagtatatagaaaccagatttagatactgcctctagttgaaattcctgcatccaggtagggctggctgtttgtcttagagaatatgtccctttatgtcctgtctggataggtggaaggtgagtaggtttaacaagtaacatttgatccaggcatttttacagtaacagtttgttattgctggaatttgaccatctcaattcattttcgtaggtataaactagtcatggatattaaatgtgtgactatattgatatatgaaagcttactgatggcacagttttatcatcagtgcctttattcaaatgagttttaaaagttgattagcaactgcattctcctatgttggcttggacatgaatagtgcaaatatgtcagtctttctattcttccaagatgaccttcagctctctatgtgcatgaattccagttggcctttagccactcctccaagtagaacacatatctatccagttgcctcttgtgtaactctttctggagcttccatagcccctacccaacttgatgtggtcaaaatgagcctcttatctttcccaggtatttgtctgatgcccctgaacctggtcatcgataccaccatttagtcaataacttgtaacagtgatctaggagttggccttgactttttggcttcttttacacttgtttttatcctttttttaacacctccagttatacatgtcttctagtgtttctttcagtgagtcttgtcaattctatttatcaaatatttaccaaatcctcttttccattataccgttactgctgtgtctttgtgcaaaccctcatcatcttttaggctaagatacaataaaataatcttccagaggctcttcctgcttccagtgttcctttctgcacacacgagggtagccttcctagcaatgactgttccattttcttatagaggaattaaatctaaatttcttggcatgacacatgggcccctttatcatcttacctgtgccccctttccctgcctggtcttcagacatcaaccctttccatcagttcacccagtcacatctctgcacctttgcataagctgtttcctatggtttgaatgcctttctcccctgactatcgaacaacctgctatgcatccttggagatccaactcaagcatcatcaccttttgaattctctgaaagatgccctttgcctttagttagaacaagaggcatcctctaccaagtagatgcatagcacaatttattccattctgtcatctagtacgataattatactactagtttctattataatacttgtttgttattttccttctccagtaaacgtattctactttgcattctccaggcctaaaagagttctggaatgcaatgggcattcatgtaagtaatgttaaaagaatgactccatcaattatatttctgtgacattctcaggtaggaagatatctttatgcttataattggaaaaaaaaaaaaaaaacctctagtggcagagaatttgtatttctgttagctctcagtattgggattgtatttctgacaggctggcccaccagctatgcttcatgaaagaccatgagccacagggaagaggtttattcatctcagcattggggtattttgcttttcttcaaggcaaagggatctggagactcctttgcaggctggccatgtcttgtgcaatcccagctgtgtctggagattctagcagggatgcagagtgtggttgggacttcacaggaagtcgacttgcatcagaagcacatagggaaagggaagggaaatagaatgaaggaagaaagctttcagcagccaaggcaacaacttcccccgtctctgtctggctctggggccaaacagactcctgatttctctttatctccttgtctctccacctctattcctctgagttcttttcccatcaccccccattctttctctatatactgtttcgctgactagtcatcagactctaccgacaaatttacctgatcttcccagcctagcccttgagcttaaccattccatccacttctcaattccacatttcttggagagaatctgatttgaccaggtaggggcatgtgtctgacccaggtccctggacaagggaccgatgaaggccaggctgtgagagaagcagtgtctctaagaaaccctgcagcgttagggagaaatgattggtatctctatggtacacgtggtggagatgctggctgcacatcccaagagccatccctagaagatggcttccttcccatcctgtaaaccctgagtcagggatgcccccaagcatgtgagatgttgaccctatttctgcacttggcccaagtcaaatccagtcattgctattgggggtcttgttgcatcctgttgtttcctttgggaggtgacatactgctgacatctgtggagtgaagggatttggggaaagtgtgagtcatcatctctctgatgacattttattctcttattctccaaactctgcccagcttctttcttttttctttctttcttttttttttttcaatggaatctcactttgttgcccaggctggagtgcagtggcgcaatcttggctcactgcaacctccgcctcccggttcaagtgattctcctgtctcagcctcctgagtagttgggattacaggcgtgcgccaccatgcccagctgttttttttgtgtttttagtagagatggggttttaccgtgttgtccaggctggtctcgaactcccaaccttatttgatccacccacctcggcctcccaaagtgctgggattataggcgtaaaccactgtgcccggcccagtttcttatttaggaccctcaaggaagaattgttgtaaggaagatagcatgatcatatagggatatctccaggtgaaactcttccacctttacaagatgtatgctggtataacagagaggaacacccatgattacctatgtacctctccctatgtacccctagtcttctgcccggggaccccaggatgccctgcaacacatggaaataaaatttacctcctgactcttggctctcacagctcttatcctgaatctttgttttctagccctgcctacttatctattttgttttctggtgattagtgaacatggatcaccctccgaggctttttgttggcagggtacatgtctgtctcatttttgtagttctgtagtacaaatcagacagcaagtgctcaattaatccttgaacgaaacaaaagaaaggagtcagttcatgcaataatggatgctgacaaccctagcatcttatcgaaggtatgtatctccactgactcacccccatttcatcacaaggctatttcccacccaacagttgcaaaaatctgtcatctccttgtttcttatctgtctccctcactagaacataagctacatgagggctcttgttttgttaatcctgttgacaaaaaacatagcttctgttatttttatttggttggtctttattgaagaaataaagaccaaccaaataaaaataaacagaggctatttattcagagcttgctatagcaaggagtcagacatcctcacttgcattttgccagaaactcaaaggcaggcagaggagtaggaaaattttatagtagataaataaagggacagcttcagatatggcctggctagaggctgtttgcgtggggaagctgcagatgggctaagtagaaaggggtgttccttgtgatcggttaaggtgcacacttggctttctctgattggtccgaagttggaggtgtggacaaaaattaggaaagctgtcagttacgaatctagtcctgattgtttctgagccagtggatttttgtttggcttcctggaccagttactagagatagtaatctgacttccttgaatcgtgacttgtggatagcaggctggcttcctgtagacaataagctggtttcctgggctggttactgcaaactgtgggtcagatttctctttttctatatggtcttgccagtgtccatttgtgtatgcagtctatccttgatgggagggaaaattaaaaaggaaggaaagaagggagggaaaaggatggggacatcatagtactattatccagtttttattatccagattctatttcgaacactttaatcccatttcgatgtgagggaatagtaattcatcccagagcggacgtgacatctgttttcaggaccctttaatcatatcccgtggtccaaagctataacacagtgaagaggaaaaagactcttttcctgtcagtcgcccaaacgggagccaaaggcttttgaggaggcacttaaagaattttcactttgcaattgtgcagaagctgttgttcaggtaatttaacattgattttagtttaaaaggcaattaagacaaaatgggcagccaccagccacttatgttaaataagcttagatttaaattgctcctcatcaccacctttgttttctatgtctgggctgttctatgctactttagcatgggatggtgtggtgccccaagtggggcaggtggataggcgagggaacccagccagggaaacggttattgaaagagaaagaagttggccaaaaattgttctcagtggtgagatgagttccctttcatactgctgctgggaatatggattcatgtaagcttctagaattctggttccttagatctaaaaacttaaatacggtgcccacttttttgactcatcggtttcacttttaggtatctaccctgagataaggcacagagaaaaatatcataacatcaggaagtgatgttcactgcagtgttatttaacataaagagaaagtgtgtagcattagagtggaatacataaactgaccttgtacattttttgtccttacagcacaaagtgttcatgatacattgcaaagtgcaaaagatgaaggcagcttatacagtaacatcccaattgtgtgcttataatgttttagttctatatgcagtagaaaatgtctgaagtggatagacttccaacaaaatagtacttggagctctctttgggtggtgaaataatgttagcttttctggtgctttttgaaatttcctaaactttccacaataaacactcataggttttataattataaaacacattgaaaacaatgttggttgtaatactattagaagaatattcctgtcagcagtgtgcttgattcctgccatctcaaggatgaggctatatgtgcatgctaagttataaggagatggaatggatattcggttgcaataattctgtttcttgcttaaaggaagtctgctacgcttcaggaatgagggtcattcacctggtctttgtttaaatttgtaaggtgaaccattttgtagacaatgcttggaaaatatgcccaggtgattcatgcatttgtctattagaaaacgtggtcacttaccagcaaccaatatagagctaatgggattcatttagaaatgtaaccacaagtccactataaatcgtatgttctcccatctcaatatgcttcattaagctcacctttcttaatgtaactggattattaggtgtcaggacaaagaaaatcagtaggtcctagtgttctaatcctgcaaactttcaatgtggttgctatgtaattttatttttttaggtggagcttgctttgtgcttttctacaggaaaatattttcaaactggtaaagaagtaatattactgtattgtgaggaatatttcaataggtcattaccataacttctagcagaaaggataatctacgtcgcattttacttcaaggataagattgatttttataaaaatctttagtgcattgaggcttaacgtctttttttccccctatgaagaagcaattagatgctggagttttccagaaatgttaggtgggcataaaccaaaccttgatgcttttctttttgaaggttttatcatccagcgtttgaagagaacaggcagttcccaggtgaaaaaaaatgttattggtacaatgtcagtcatcgacactcacatggccagggacgccacccttttcttatatttacatctgtttgaaaaatagagaaatacaggaaatgacaaagaagaaaataataagcacctataatctcactagcaaatactacccattttgtatgatttcttccaggggtgtgtgtctacaaatatccgtagagacatacacatacactttaaaaaaatagtaaatacacatcttgtacacttaaagcaagacctatagatgtacaggcacaccttggagatactgtaggttcagttacaagccactgcaatacagtaaatatcataatagagggagtcacactattttttgtttcccagcgcatataaaagctgtgcttttgtaccatactgtagtctattaagtgtgcaatagcattgtatctaaaaaacgacgtgcataccttaatttaaaaagactttattgctaaaataaaaatgccaacaatcatctgagcctttaatgagttctaatctttttgctggtggagggtcttgcctcggtgttgatggctttgtactggtcagggtggtagttgtggtagttgctgaaggttggggtgactgtggcaatctcttaaaatgaggaaacagtgaagtttatcacatggattgattcttcctttcatgaaatacttctctgcagcacctgatgctgtttgacagcattttacctaacgtagaacttctttcagaattggagtgaatcctttcaaactttgctactgcttaatcaactaagtgtatgtaatattctacattctttgttgtcattgcaacaaggatcatagtatctttactagatgtagattccatctcaaggaaccactttttctgctgatccataagaagaaactcctcatctgttaaagttttatcacgagattgcagcaatgtagttgcctcttcaggctccacttgtaattctagttctttagctatttcctccacatttccaggttcttcctccactgaagtcttgaacccttcaaaatcattcttgagagttggaatcaacttattccaaactcctgttaatgttgctattttgacctccttccatgaatcttgaatgttcttaatggcatctcaaaagcgaatattttttagaatatttcagtgtactttgcccagaaccatcagaagaatccgtgtttatggcagctataaccttatgagatatatttcctaaataataagactggaaatcaaaattattccttgatccattggctgcaggaacctatattgcattaacaggcacgaacagaacacttatgtccttgtgcttctccatcagagctttccggtgaccagatgtgttgtcaatgagcagtaatatttttaaaggaatccttttttctgaatagtaggtgttaatagtgggcttaaaatattcagcaaaccatgctataaacagatgtcctgtttcatttctagagcataggcagagtagatttagagttattcttaagggccctaggagattcaaaatggtaaatgagccttgctttcaatttaaagttaccagctgtattagcccctaataagagcgtcagcttgtcctttgaagctttaaagccaggtgttgacttctttctatgaaagttatagataccatcttcttccaagagaagactgttttgtctacactgaaaatctgtcatttagtgtagccaccttcgtcagtgatcttagctagattttcagggtaagttgctgcagcttctccatcagcacttgccatttcaccttccacttgcatgttacagatactcctccttgccttcaacctcatgaaccaacctctgctagcttcacactttttttttgtcagttttcccacctctctctgcctccatagaattcaagaggattaaagtcttgatctggattaggctttggcttaagagaatgttgtggctggtttgatcttccatctaaaccactaatactccacaccagcaacaaggctcttttacttattagtagtgtgttcaagggagtagcacttttactttcctttaataactttttcatcacattcacaacttggctagttggtgcaggagcctagcttttagcctgtcccagcttttttttttttttttgagacggagtctctagctgtcacctgggctggagtgcagtggcgtgatctcagcttactgcaacctccgcctcccaggttcaagcgattctcctgcctcagcctcccaagtagctgggattacaggtacctgccactacacccagctaatatatatatatatatatatatatatatatatatatatatattttttttttttttttttgtatttttagtagagacagggtttcaccatgttggcgaggctgttctggaactcctgaccttgtgattcacttgccttggcctcccaaaatgctgggattacaggcgctgtcccagctttaaaagtgtcttcgtcatgaagcttaatcatttctagcttttgatttaaagtgagaggtgtgtggctcttcctttcacctgaacacttagaggctattgtaaggttatttattggtctaatttcaagattgttgtgccttaaggaatgggaaggccaaggagagggagcgagcagggggaatggcctgtcagtggaacagtcagaacacacacaatctttatcaattaagtgtgccatcttatatgggcacagtttttggcaccccaaaacaattataatagtaccatcaaacattgctcatcacagatcacagtaacagatctagcaataatgaaaaggtttgatatattgtgagatttacccaaatgtgatacaaaaacataaagtgagcacttgctactgaaaaaaagtggcaccaatagacttgctcagcacaaggttgccacaaaacttcaatttgtacaaaatgcaatatctgcaaagcatgataaagtgaaagacaataaaatgaggtatgcctgtgtgtgtgtgtgtttgtgtgtaagcgtgtatacaactttaaaagtttcatactgtattagtccgttctaacactgctataaagacatacctgagactgcgtagtttataaagaaaagaagtttaattgactcacagttctggaggcctcaggaaactttcaattatggcggaagaggaagtagacacatcttacatggcggcaggtgagagagagccagaaagatcagggaactgccttataaaaccatcagatctcaggacgctgaggcaggcagatctcttgaggacaggagttaaaggccagcctggccaacatggtgaaaccctgtctctactaaaaatacaaaatttagcccggcatggtggcacacacctgtagtcccagctactcgggaggctgaggcaggaaaatcacttgaatctgggaagcagaagttgcagtgagctgagatcatgccactgtactctaccctgggtgatagaacgagatgctgtctcaaaaaagaaaaagaaaagaaaaccatgaaaccatcagatctcatgggaactcacccactatcatgagaacagcatggaggaaactgcccccatgatccaatcacctcccacctggtttctccccttgacacatgggaattatggcctcttacagaaaaaagttcaccaatcaccagtctaggccaggcacggtggctcatgcctgtaatcccagcactttgggaggccgaggcaggcagatcatttgaggtcaggagcttgagaccagcctgaccaacatggtgaaaccccatctctactaaaaatacaaaaaattagttgggcatggtggcgggtacctatgatctcagctactcgggaggctgaggcacaagaattgcttaaacccaggggcagaggttgcagtgagctgagatcgtgccactgccctccaggctgggagacagagcaagactccacctcgaaaaaaaaaaaaaaaaaatcactggtctagaaaaatgggactgaaattcacaatagtgtcatctctaggaaaagaggaaggagactagtttttacctgagtttgagagctccttttgttcttttaagagaacacttatgtactggctttatgcttttaaaagtgatacacatgtacacacatataacatatagagtatatatacatacacacttttcacttaaaacaagttatatgtatacatgttatatgcatgtaaagggccagagagtaaacattttagacttcctgggccacttggtctctcacagacactaaactccgcatttgcagatgaaggcagtcgtagcaacccataaacaaatgggcatagctatgtttcaataaaacctcattcatggatgctgaaatttgaatttcctacattttttacacatcacgaaatattattcttcttttgacttttaaaaactatttaaagtatcaaaaccatttttaactagcaggctgtacagaaacagagaatggctgagtttgattcttgggctgtagttggctatcttctgttttggactgttcccagtacattcacaaatatttatatatctacggaaaacctataatattatattagtgcattctctttcagaaatggtgtcataagtgtagaagtcatttaaaacttgtatttttatctcagcaatttatttttgctgagaaatatttgtatatatatttgtaccttatagtgtgtatttttatttctgttcctacatattcatgtctatatagcaatggaggtattcatatgtggctttatttgattcttttcactgctatatggtattccatcatatgatatgccatatttttaatgctagatgggtatttagtctgttgcctccccccacaaccccatcctgtatcacaagcaatagcaattatatccaaacatatccacaaatgtatcttgtgcatgttttttaggacagacattagaagtagagctgtttgataatagggtatgcacattttccattttaataggtactagtaaatcagcttcccgagagacaatatcagtttacagtgctcatgggagactctactgccattcttggtttgggaggttgcatcccttcctgttttacttatggggtgggagcaagaaaacaaccttctctctgtatcatcttgccttgtagttacagctgtaaatgtgggccttcatgtccctttgggtggctgcagacatggttttaactgtttgctgtgccccttgcacatgagaatagcaatttatatcaataaccaggtctggcaacatctgccaaggttgtcacgctctgtgattaaatggccacatgtgctgagaacacgaggacaatggggttgtaattagggcttgctgtctctccatcggccacccgcaccatgcgtcccttcctataaccttgcttttgtgaactgatttgtgaatcaaattattccactgggcatgccagtgtgtgctgggttaataataatactctatatttgtgaatctctgtaattgtacagggttctggataagcgaaagtctaaacccctttttgccattttacctggtgctgttggaaaatgtgtcaggggatcatacaagataacattagaagttaactttaaaaatagtagggagtggagcatgttcttcatggcatcattattgtgaaataaggttttactttatggttatctcagcatccgttaaatgccactgaccctgtaagaaaggcaggcagagagaacacaaatagaattttgttaactctgcaaggagaaagttaaacactgtgttaatatcatattaaaaacactcttaatgcacagaagaaaaaaaaatccctcctcgttttgttcctggtatgacaaagatggatgatggttacataaggaattggcatgttaaaaaaagacacacttgaaatattgcctctagatatgaagttgtaacgaatgtgaaaatatttgaaagatttattagcattttaatatttgcttaccaatgcataaaatcctaatcagttgtatacaagttgtatactttaactcaaataaagtatccaagaaggacacaggcaggaagccaatgaatatttcactcattgttgatcaaatataggagggatatatgtatattaaattttatttcccatttagatccttcctgtttaaataagtgcttgaggtagcaaagccatcttagtgcacacagcttgcagttctaactgtgaagagaaaggaaaaagaacaaattagtttttctacatccaagagtcatttccccagccaattaattttttggtccctaccaaaatcagcacttaagctgaagatagctagaacctgtgtaactcattcctattaacaacagcaacaaaaaaagtgaaatagatctatgaggacttcttgggaaaataacaggaaaattactttgatgatattattattcaaggtacacatatttaaaaggtgatctctaaatttcaacagagacgacagttgtttttctcctaaaagcaggctgaaacctcagcgcattctcatttagtacgtaacgtggaaaaagagttgagatcctaaagcttcgctcctaaataaagtgcagctgcttctcggagatgaaataggatgaaagcctagctgtttggggcgggaggcgagattgggggcgcggtgctggggtcttcgatgttttaccagtatttctaggtgaagcagcatattggaagtcataaatactgtcccgtggacattctgaataatgcaggagtagcgtaagtaattgggagtgcttatatccgcctttagacatttgattgctcgtgagttaaaattggttgtcaagtgcggactcagggaaccgtgcaaggtgccctattctgtcatgtggtacatatttaatgcctgaaagaacaagggaagggacacgtgcgggcgagagagggcgagcggcgagataccgcagccagctcggagctttgcaagtgcctccgacccgtaggggcgggacccacgcagccccagtatccactgccttcccccagctgcaagagtttgcaaaaacattgggcgtctcatttggcgagcgttttggcgcggacagaggccgaggccggccggggaagccggacccgggccctggcgccgccgtggcctccctttgtgcgcgcccgggtgttgattgcctccttgcacgggctgctcgctctcgcgcccgcgcgctcggggcgttctgcacctgctggcggtcgtgccaggcagcccgggcgagcgaaggcgcgcggcgcgcacgacagatgactggagtcatttacattgctagcacgtgggtgccgtttgctgttgcctcggacttctcccgtgctgtgttttcccggtgaggaaacaggaggcactttgcagccgacaatgaaatcttggcagctaattgcagtcgtgggagatgcccttcaggtacggcgagcgaagaagactctaaaacactgtcagggaaggagagaaagagggagagagggagggagggaagggagagaccaggcagcttctgcagaggcttcctgaagcccactgactccgcgggagggggttgcagagggacgggggcgggcgacagggggaggagtgtgcaaattgacatttttggctgcctgtggcagaggagcagccgtcagccgctgtccaacgttagcgcagacacggtggcggcgtgtgcgcctccggggctgctgattagaataggggacttggccgtggatggaatccgggaaacccaaaccggagatggaaggatgaggctgcgtttgcagcgcgtgaatgggacgcggtatgtaagccgagctccagctccggggacctcggagactgtgctcagggctcgccctgggtgccccgtggtgggggtggtctggacacttggagagggctagggggcgtttagagggattggggagcccggagatgcatcgattttctttacccactggaagttagtgggcaacttccttgccaatgctcattggctccgtttaactttattcccagagatgaataagcgtttattaagaaccgatgtaaaagtcccaataggctagccatggttttgcaagagatgcgcggctctggaaatgagaggtttatgaaatgaatggccagatgggttgtgcatttgcgaagttggcatgctcacgttgcaagggagcatgtgtgtgcaaatgtgagcatatgcgctgcatatctgtgtaaacatgtccaccatgctcgttgcgctggtgtactcttcatcttctctgcctgtttcccatggaagagagattaaattgacaatactgaacacgcttcgacttgagaaataagctctgtaccattttatgacatggaataagagttgccttcttctgagatcaaatgggagaaatgtgccttgccttctcaagtgatggaatgaactgttatgcatttatagaatatattatatacagagtgtcgaatgtgacatccatcagtctacaatgatcacctagcctctcaagcacagctcatccctctagcccttattttcagattatggggaaattgggggttttattatttcttttgacaaaagagctgcgttttccaccttcctacttaagagggctccaagcagaattgtgaatccaaaagttttgttggcagtgtcaccttagtaaaacgttatgaaattatttgctaaaagagtcactttctgagtgtcttcacgtagaagaatttactcattgttgacatggtttcaattttggttacacagaaatgaatgcggtttattgctgaagcaggcaaaaatgattgtgtaatcctctctttagtagggtagctgggtagtaaattgtttggcttaaaatggggacatctttctccactgtgttccctattttttgatttaaatgtgtgctggaaaatccaaagagtgtgagtaaaagggtgtttgtggcatggagtaacttgcctttgtggtttgctatgactaagtttgaagagggttgtttgttaagtaagtgaatgcaagtcaatcagcaacagctgcttgccactcaggctcacaggaatccaggcttttcatttaaaaagcaagattttccaagtcttatctgcccacacgcttcccacacgtgtgatgcctcccctctattagaatactcagaggttatgaagagggaattgttaatctgaggaatgaggtagggggacatgtagaaggagctcctccctccctctcttacccctcttctcttctctctcttggtctccctctgggtatttcttcctccttatcccattttttttcatctacgtgtatttctttccatctttctgtctttactgttttacctggtgcacagaaaccttttaggtatctttgctacactttaacatatgttttgcacgctggaggatcaccagagcctgtttttctttctttctttcaggaattctccgctcacctgcaagaattatttagtatcaggcaattccactgtacagcagtcttataaaaagtgaatattcaaacttttttatcatttctttttaaccaagcaactagactctttgaaaacacttttactatgtaaaaagagcagaatcttttctgttaccccaaattgagggtttatacgaaagtactttctgtctcatgactttattggactaagcttatttttacatttgtctcttaaaatcttatccttcaaacttctgtttttcctatcacttgtcttaattttagagtctggattcattttaatctgtatttactcagacttggtagaaataactatcagtgctgacttatgggccaggtaattgaagtacaacaaaaatagtttttcttttttgtatgatattgtgttcctttttgctcttaaaaaggaccagctaattatttttctttttttttttcctctctctactaggagtatgatacaaaagttgaaggagatctcagtaaaaggctttttttttttttttttttttttttggcattgattgccttcctataaactatagttgcaatatttggaaaatatattgtcatattttatgacactaattggtgtatatgacttttgttttgagaatccaggtacacactcctcattgttgtctttgatttgattatagacaacctgcttgaatgggccaatcttgagctaaacaaatattacaacatctagtgaagaacaaacttggtcttgttttctgtctaaatttataatttttatattagattttgagcacagttgtaatctggtgaaatgaaaagtcatctaaaagaggaagaagatatctgaactaataataaaatgattattattaattaaacttagttgtgtttagcttttagcttttattttaaaaacttcacgtgtcttagtctcaaagttatcaaagggagttggcgtaagttcttggaaagtaattctgttgggattaaaagtcctctctatgagacttcactctccatcttgtgttgattttctgacgaacataaaaagaaatgaggaaaaagcttgaacccttaattttattatttttttttttggcattttagactttactttgttatggatccaaaaactttggagtgtgttaaaatatcaaatctttgtttgcatttatgggtatgcgtttttgctctttttgttttctttcattttcatgcagggttgtgtgtttgtgtgtattatgagcagtagtcaacaggagcaaatgagaagaattttacaattatgaattctcatgcataatttgattttaattaaatcatagataatcagaatagcagtctcaaggatttaggatccctgctgaaccccctcttcttgcacggcaccaagagaaagataaaacgcctttaaaagtcagcatttaatatacagtgtttggtttggaaaccatcgcatattaaattattcagcaactataatgtcccaaacagttttcagggtgtgtttttattaagctaaataaagtttctatgaaaagttgtggggtttcagtaagttgtggggtttctgtgtgtgtgtgtgtgtgtgtgtgtgtgtgtgtgtgtacccaaaaggccgaaacagcttatgtcagctacagcaactcgtttttgattcagcaaaactaggttatgaattcaagcaattaaaaatgacagaaagcccaatttcactgcctagattaatatgcttccaatttttcctgctccataaaaatttcaaagtgttctttctgttgaggtgcttgcataacctatagggtattgggagggtctccatttcttgtttgcttatgatgtctgaatactttgatgtagcaaatgtaaataggatcagttggatatttgtaacataattttgtgcttgcaagttctcctgaaattattttggttgggtttaaaagaaaagagctgtggttagtttctaagcatttaccgatagtgaagaatctgtcggcaagctccaatgtcatgaaggccaggaaagacttttcaagaaaagatacaattatagtagaactagtgttttcagcttccaaagatggcagtgatatatgtaaaaaaaaaaaaaaaaaaaaaaaaaaaatatatatatatatatatatatatatatatatatatatatatatatatatatataaaatattatgcagtgatgggcatgtttattactttttctctattcctaaagtaatgtctggaattctagattcatgtttatctaatgagccaaatctctccctgttatttaaaatggtcctttttccttacacactaattagtagtcaaaaccagccgctttaatgatctgtagtttttggtttgttcgttaagttttctaacctggtttgaattaacttgttcacacaaagagtgtacacagacacagatatacactcaaaaagctcatctcccagcaccatttactccacgctttcaatccaatacagaaagcaacaaccaaacaaatcaaggtgcactatttgcccaatgtttgttttacagagaagacccctaaagggctgtatatgaggaaggcctctgccagcccttcctttgctcttcatggtaattctgcatctgcatttgccacagtactgtggatgtatttctttgttgtttagttgtagtctctagttgtgaggaaatcagttgttgtctgcaaagaagatgtaagtactagttggatttattgtggttagctgaatgtgtaagtacaggtcttccatttgtattaaaatgatgaggatgaggatgtgataacctgtcaacagaaacagcagtaacaatacaatgccgatttcttcccgggcacttactgactccctctgtgcatcagacattggacgaggagctcctgtgtattttctctgttcttacaactctgcaaggtaggtattaccatgcctaatttagagatggagaaacaattttcaagactttttataattagaaaaagtgattagactgcaaatttttctgattccaatatgctaagataccattgaagtttattaatctgagtttagaatttagcatttagaatctgtttacacataatgggtacttaagagatacactacgttagggtttctcaaacaggatcaatttcctcccctaacccataataatatttaacaacattttgaagacagtttttgtgtctttgcgagaggatgactccctcctgcaaaacaaaaacaaattacctggccccaaaccaacagtgccacagctgagtaattataccctaggtaatatcagtgatagtctaatataaacatggtctgatttttcaagagagggtagaaggtatgtgtacttcaattattaaacatttaaaatctctggttggatactgtgactaggatcatgatgcaaaatcagacggtccttattcccttacagtctgacactaaaattgttacagctgcttccttggaacatctttctttataaatatggcatgggtcgttgtgatttaaagtgccctatttttttccaatttacttactctttagtacgagaagtgctggaaaatgaaatttctttccttggtactcttgtcactagaagagaaatgtaacgtcactaaatgaataatggaagagcaattctaacaaccttcccatatggtccttcttttccctcagtattcaaatggcattattttcctcttatctttaaaggtttggcacataggtttattggtttatttgtttatataatattttatatttgccgagcactcttgcaaatgctttaaaatattaattcattgaatctttaagataagcctaggagattgttattgtttttatctactttttacaaagagggaacagacatccagagaagttgagtaatctgtatgagatcacacagcttctaagtggcagagctggggtttaaactccaaagtctgtgttcctagccattttctcatgtactttagtaatttgagcttctaaatgtacagaagcctaagcgttgaggcaccatcttcacccgagttttgaaacaaaagacgtttttagtctcattttggagtgcttgatgaggaaaacggacttacctgtttttgaaagagcatgagtgataatgctcacagctttatatgttgctatttaaatactcctgcagatgcacttcacctgggtcaggaggtcttgtgaattctctctaccatgaccacctccaacaacagcaaaaaagccaccaaagggaaacactaatgtacaggagggcacaatttgcaggatgagtgatctccattttatcccctacttaattgtcatgttggaaaaatagagagaaattctgcaactggatctcctaaggtgtcttcaagaaacttaagtctttgctttctgatgctcttaaaatgttctagagagccccatgtggtccatgccaggtgggtgatggtggatgtgagtacgttgactcccagcttgatctcagctaatgccaggctgtttgttgttccacatttaggccacgggaatgaccatgcctatctcagtctcagttgggtttttagtgaatagcaaatgctatgaaaagaaaaacaatttaagtatatttttaaatagaaatgccaatttgacacattttattctgctttagaagggaaaaaaagatcttgcaagtacgcaattaaatacataccagaatatccagaaaaccaagacagaagtagagagcgtcaatgaacttcagttgaataaatgagtacatggatggaacattttgtatttttcaaaatttcttgtcaagaatatgtatgggtttgtacttgaaaatgtctcacatctcgaatacaagccaccgtggtgggaaatacaggtctgacaggcgtccatttcataccagctgtcctcagcttaccaatctaaatttgtacgttacttaagtgttaggcataggtatctgcttactatttattgccctgcagaaagctcagagatgattaagcacagcttacaagtatggactgcattttacctgaggcaggacacagatttttttatacaagaaagaaagggtcacccatgaacagctcgtatctggtcatggagcaatattaaagtctcaaaaagggctgttgagctacctcctcccagcctggagacagtttaggaactgggctggaagtggaatccattactgttctttatatttcaggcccaataaactcacgtttgaacaaagagagcgaagagtgaatcccattgcagaactgtcaaaagactgatgttggatccattactgtcaaatgtccttttttaatacagttcattaaattggcttttgtggaatacctatttcatctaagtgttggttcaggaaatggtttaaaatgaaaccagaatttgttgttcagtgggaaaataaatgagatgaacccacataaccaagactacccagtaaagttctgtagatactatctattagtatgcagtactaaaatttaaattatacgtgtatatatagttatatctatagttaagctatagatatgtaacttatgtatagactagaagctacatagtctatagtctatttatatgtacatataaactatatatagatatatagttaaactatatatatagtttaattgatgaaagaaagaatgggaagttggatttaaaatagccattttaattccatatccagaagtatatggaatacttccgcatcttaaggtgagcctccttttagaaataaagataactagtgataaaccttgtatgccattaaaaagagtgtacccaacactcagtgaatttctgcccagtcttgattgtgaaattttcttaggaatctaaacatatagaagttacatcaatgttataagtggttcaggattcacattctgctgctgacagagaaagaaacctgattttgttgtaatgtactagctaattgttcagtatatagaattgcacatcattatccttcttattgatagtgtctattgagtgcctgcaataagctagacactgtactaattcccagatgtgcattattggcctgaatatttccagcagccctatgaggcagatgtgattgttatacccagggttcatgagggaaggctgaaacttgggatggtttttcaagggttaccaacagctagtgactaaaagggctgctaatcaaatttgaagctttgaggcttcgaagtccctttccccgtttttttggcccaaagctatatcaatcattgttctaacattggtgaaaaatgaatctgatgtagatgaagagatttatgtagctataggaagttcctataactctcctattaggattaaccttcttatcatcttggcaaattatgcaagtggctggatattttgggtagatgggtggatgggtagatgaatggatagatgagtagacatatagactgagtagtaatggagaagacaaattggcaaaggacatgaatataggttttggaaaaataaacataaatagcaagtatatgaaagtgtgtgtgtgtgtgcgggcgtgtgaaagtttcccttgtatatgtgaaagttttatatattgtattggaaaataatttgttgatgaaacaggcattttatatactgttagaatgtggaatagtaccttcttctgtagaggactatttgggaattcttattttgaaaaagtaggctgggcacgatggcccacgcctgtaatccaacactttgggaggccaaggaaggaggatcatgaggtcaggagttcaagaccagcctggccaacatagtggaacctcgtctctactaaaaatacaaaaatttgccaggcttggtggcaggtgcctgttagtcccagctattcaggaggctgaggcaggagaatcgctt[135 bp omitted]cctttctgcctctggaatctgtgtgatcgctgaagtttgtgaagatgcagcttggttcactgccgcattgtgaacagtcagaaggaaactggagcggaggaaatacctaagtagggtgattggaggtcaaggacccttgtaggaatgaagtggatttgcctggatgtaaaactacatctaagatgttatgagtgaggaagagcccaaaactcagaaatctgtttgaaaaactttgttagaaagcaaacatacacatgcaattgttttacatagagggcaatactgcaaaagataatgaagggactataaacagtgattatctttgttgtagctgtgcagtatgactaagagaggggcagggaagagatgaagcttttgcttttaagattacacctttattctttgtgattttcagcaaagatgccctatttggataattaaaaaatatttaagagaaaagcctccattttgcaaacaacctgtgatcactttacccctgagctgatacaggtcagcttagataccaacataggtattctgtgttggacataggcaacctaaattgcttggaaaatatatttgagccttagaaaagataaaactgaaaatcattggattcacagttatgttttggttgaggtttggggtcagtatgctctttggaatggggtggtggggtgttggaatttcctaaaaatattaaatatgtgttaacagtaatggtttgaccacagaagaaaatcaaatttccctgttgctgtacacacttgtcattcatcgccggtactgcaaaatcatgatccttatcctcccagctgtgtgtgtttgtcagggaccgtaggctgctaaaagttgtatacagtactattattttttttattcatctgtgggtcatttcatcttcctgtgcaagccacatgaatagctgtgtatgaaaattgtattttgtgccgaatttcccactgtgaaagatgtttactatatatttatgaaaacactgcagtaacaaaaccctttatatagcctttcaatttgctgtaagggcagataaaatatttttatctcaaactgaacttcataccttgggagattcagctggcctgactcagaataataaaacacttcagagaaaggcaggtgctgttcagattgcttcagaaacctgtgcacttcactcggcagatttcacttcctttaaacacgccaactgaatatacgaaagctagaaataatcagtataaactatgcaacgttaagtacaagaaatcatctttttttattaaatagtttcttaatacatctacagtagcatcagcgtgatttttaatgagtgatattttcctgtataccagaagatacagagagaaggttggcgatcattccagtgtattgaaaactttcattcctcatctgcatttaggctttggcaatgttcttaattgaaatttttacagagataaatgtagcatatgcagttgtaagaaaatatagatagatctcttgtacactattctctaatggtaatattttaccaaactgtagtatcacatcgtatcgaggatactggcatggctgcaatccactgaccttatttgaatttccctaaggttacttgcacgtatttgtgtgtatatatattgttctgtacaacttcatcgtgtgtaggtttctgtatccaccgccacaggtaaggtactgagcagttccatcctgaggttccatttgtataaccacagctatctctcgcgaccacctgcccctgttcttaacccctgtcgatcatgaatctgccttccatttgtaaaactttgttatttcaaaaatggtatataagtgagatcacagagtgcttagagttttgggatgggcttattgactcatcattccctggagttgtacctacattgttacatcagtaattttgcatggtatatatatgtaccacagcttaaccattcacctgttgaaggatatctgggttggctttgaccatcacacataaagctgtcttgaacatttgtggacaggtttttgcgtgaccgtgagtttcacttctctggcataaatgcccaggaatgggccttggagatctttgatttatgcatattatggaacacatcaatatgttgcacccattggaagtcaatgccagttgcgtacaaactgatacaaggaaaaaagaaaattgtacccacgtcttaatgtttatttttacataaacacggcactaaatgcagagaatagccagcatttatgtagcatccaccatatgccaggctgtattctaagcctgttatgtatgctaactcatttgtcctcagagcagccttatgaagtatgtactactgttcttacttatggaggaaacaccaagcacaaaatggttaagtaacttgcccaagattatacagtcatcaccacttagaggtagtcggtctggctggagaaccccgcattttaaccactaatcaatgtccccgctttcttttgtttgtttatttatttatttattttgagatgaactttcactctttcacccatgcgggagtgaagtggtggaatctcggctcattgcaacttctgcctcccggattcaagcgattcttttgccgcagcctcctgaattgctgggattataggtgcccgccaccatgcctggctaatttttgtattcttagtagagatggggtttcaccatgttttccaggctggtctcgaactcctgacctcaggtgatccaccgccccccgcccccgccttggcctccctaagtgctaatattacaggcttgagcttccgcgcctggcagacagccatctataagatgatgtccccactttcgtagatcggttggtcataacttgtgggttggctgagacagtaatattcatttagagtaaacatctattgatatcaccctgaaaagaaataataaatgaaactgggtatatagaataatcagctagctgacttcatcagcccttagctcacagctctgccttaaagcttgctttatttggccgtttcagacagatggatgcctcttatggcttttggatctccaagacgtagatttcacaaccctcccttggttacacactgtaatatttaacagctctcaatagcagtatgttctgcttttttggtgtggcccaaatctctcctatggcaaactcaacacccctcactccttcttcccacctattgaagacgtggaattgttggttgtccattgtattcacaacataaaggtatctgtttgtaacagaatattgtttggctgctttacattaatccttgagcttttcgttcctccaaaggcattttatatttccaacaggcttataaagtatttaatatttttatatgcgtcagtgtaaagccatctgttgcagtgacaggacaaaatgtggaagacaagaacaagcgtatgtttatggaaagattccatgaaatgttaacaagaaagatatgtgctactctggggtgtcttgtagaaaacggtcaggggaatttggaaaggcatggcttacagcattggtatttgtaaattagtgtttataaaaggcatgtgcactttttttttctattgtcctgcaaatttagactagattgttgacataaatggtgacagtgaccactctgaaaggaaatggtggtgtgacctaatatttggaacttccttcatttgttgttcttcattcacaggcttcaactttttccttttcatttgaacaagtggattgggaacctgctttgcggcaggcgtttgtgttgctggaatagctagattgtgtttctaaacagctagaactgtttctcagtgccttacttttaatagccgtgttgtggtcttgctcatacagaaacaatcagacgggaatcaattttgcctgcccacttgaacgtatcagtttaggcacagttatccaaagctgttgctgcattacattgcccctcgtcgaactgggctcagaaaatcaaagcaagttgccccaagcgaagacaccaatgctcttggggaaacacatcacagctaaattacagcgagtattggccgggcacggtgtctcatgcctgtaatcccagcactgtgggaggccagggtgggtggatcgcttgaggtcaggagttcgagaccagcctggccaacatggtgaaacgtcatctctactaaaaacacaaaaattggcctggtgtgatggcgggtgcctgtaatcccagctactcgggaggctgaggcaggagagtcgcttgaacccaggaggtggagattgtggtgagccgagactacgccattgcactccagcctgggcaacaagagagaaactccgtcttcggaaaaaaagacaaaaagaaaatgcactaagtatagtatctgccaagtactacgagaggcactgtgtcttggttggcttatatgaggctctcaaacctcttaggtagcataagaagtcattgtctccattttacagatgagggagcaattttagagaaggtaattaaccaaatattacattgctaacatggagtggactgggaacttggcaacaggccgactaaacccacaagcagcttgcttaaccactgtgttttgtaactgaggctggagaaagaggaggagcttgtgaggtgccttccagaccagctcttctcaggtgggcattagctgggatgtgtgggtcaaagatgcagtatgttgttgagatgtgacattgacatggagcttgatgccctccacagactttctctaaaagttcttcatttctcagctacttttcccactctgtagatagtcacttctcaaggcccagagagcacttggagaaagaagttggtgtgaactctagaagaacagctcttcaaaatgccgcaatggagcaaggacatgtggaataacctccagtataaatcctttacaccgatttttgaagtttttaaaaaaaaaaaaaaaacagagttttgctcttgtcacccaggctggactgcagtggcgcgatcttggcttactgcaacctctgcctcccaggttcaagtgattgtcctgcctcagcctcctgagtagctgagattacaggcagataccaccatgcctggctaatttttgtatttttagtagagacagggtttcaccatattagccaggctgacctcgaactcctgacctcaagtgatccacccatctcagcctcccaaagtgtaggtattacaggcgtgagtcaccactcccggccctattttatattcacaagtgtgagaaagtgcctaaaagcattcagaggttttcaatcatatttataaataaattaatcactgttacccatgtcaaaagatgacaattccaggccaggcacagtggttcatgcctgtaatcccaacactttgggaggctgaggcgggtggatcgcctaaggtcaagagtttgagaccagccttgccagcatgatgaaaccccgtctctacttaaaatgttataaaaaatagccgggcatggtggtacgtgcctgtagtcccagctacctggaaggctgaggcacgagaatcactactacctgggaggtggaggttgcagtgagccaagattgtgccactgcgctcaagcctgggtgacagagaggaactccgtctcaaaacaaaaaaaaaaaaaaggatgacaattccagatagctattcctaggttgataaaattactgagatagtagaatttagagagacttatgagcagaaatatatattgacagaagagcaaaatatcattgtatttcgttaatagaggaacaataatcaggctatctgaaagagaagacagaccagttagcttctaaatgctgttcatttatttcagtcagccttctcagaaggatattggggcttggttcagcaatcaggcccttttagacccatagattttgcctgcaggtgttcctctccaacgattagattgtgatgataggctataaacttcatgaagacagagaacaggtgagcaatatacaattagttcctagcacaatgtctgcccatattaaggacttcgataagggtttctaaagaatgtgtgatcacattggattgtcccagagtatttacaatgtattaagtcctggaaaatctaaataataattatatctataataattggataatgtttcagagtcctattgaggaaagatagtgttattcccacctgctagttcttctcctgaagccaagatatgcatggtaaaagccatggcacagttagtatctgatccctcaactaaaatactgacaccaccttctataggcttatacggcaagtagcagtatgccttggagccttctcctccaatacaccccattggcaaaaagcgacttatggttaatgcaacagtgaaaataaattattaccattctatgattgtgtgacaggttagtaattaacttatgtcaccagttggcttcgcacaactgtgtttattcagctccgtggagcacttttcagggaaaaagaaattatcagccaggcagcctttgtttactgtggaagctggatgctggtggactgcatctcctcctattgactaggaaataagttggttgttaggacatgattttccattcttcaaaatgatatggtgatgcaaggaatttgaaagctacactggaattagaaaagcataaagaaattgccttttatgcactaatcgagccattatgcctgtttcctttggggtatttttttactgtatagacaccacaaacagccatgtgtaaaaaaaaaaggtatgaaaaatcttaattaaaataaaaactgtagtatgtgtttttatcccattgtaggttaagtgggtatcacacagcctagggacaatggtattagatttgtaataagcacaagtaaagcttttcattttgattggattgggtgtatttttcatcagcatctcccgtgtgagccatgattccaagacagagtcttgtaatcttctgcagtgggaatgattcagcttaaaaatcagtagggcatgaggtatttcaagttctcattattgtaatgtgtcaacatcacttcagtgaccccagagtcctatgttggctggttttccccctgatttattgtgcaatctcgtagggcaaactataatttcacttggaatcagaaagtctccatttatggtttgtgtcccagtctccagtcattagggcattcgcgggtaatcgatacctcctcttgttgctaacagctgaatgaagttgtcacctgcttagattacaaaggagtcgggtaaaaggatgtggtaagggtgagtacattgaacaagttctgttttgagaagggctttctctgatgtttacctgccgcctcgtgaagggctttcagcattttttgggacctcctttctagaaacccttatcactgaattagcacaatgttttatttcttcttttgtgaaccgggtgtgaatgatgtcatttcctttggttaaaaaacaagttgaaggagccattcttgaaagtctgcatgctgacacattttctagaaacctttgagtcacgccaactctttttaaatacctggtcatcatgctacaattaaaagaatggtatcttctattttttcctaattggcaaaatacctaggagcttattgaggcctttagcaagaagaccatcatctgtgttcaacacaccatgcttcaaggtatacacattctattttgctgcacatggacatggatgcacgtgtgcacatacacacacacacactcagagcttctcactagaggatattcactgaccatttatatgatattgttaagtcacacaaagcacagtgactccaaattgcagctccaacacctagtacttggccaagggtgagaaggtctacacagatcaacttttgcagaaatatgattaagtcatctcaggaatgttccataatattctgaacacaatagagtcccttccctcaagaaaattaatatccagccatggaaaagagccaaggtgaagaggcaattgaagtacatggactgtaactacagaggcttaagaatggcaagaagaggcattgaactcagggtcttagaaaacttggacactgacatcaacacttgacaacatcttgactgcatgtcaagatgttgttattctcctcacaaagattataaaccaactgtgatatgtgtgcaggagaaaaatcatcgtgttttaaagttgaccttgtccattaagatcattgtcttttatctcagcccttggggagtagtttttttttttttttttttttttttaatgctgagacatcctctgtcccttgttaagttttgggttggtgttgctggaccagccatgttcctgtcttttcttcctatccttcctggcagagccccttcctcccagagctacttcagcagggtaggatggtctcactgcccatgggagtctgcccctggaccctatcctgcttgatgagttcagaggtctttctgctgagcctctttgtcttgccagttaaacattctttttttttttttttttttttatttcacttgaagttttagggtacatgtgcacaacgtgcaggtttgttacatatgtatacatgtgccatgttggtgtgctgcacccatcaactcttcatttagcattaggtatatctccaaatgctatccctcccccctccccccaccccacaacagtccccggtgtgtgatgttccccttcctgtgtccatgtgttctcactgttcaattcccacctatgagtgagaacatgtggtgtttgtttttttgtccttgcgatagtttgctaagaatgatggtttccagcttcgtccatgtccctacaaaggacatgaactcaccatttttatggctgcatagtactccatggtgtatatgtgccacattttcttaatccagtctatcattgttggacatttgggttggttccaagtctttgctattgtgaatagtgccacaataaacatacgtgtgcatgcatgtgtctttatagcagcatgatttagaatccaaacattcttatagacaagggctccttctcctgacgtttctgatctcattctaaaacattcacccagtccactgacctgtactgggcgctgtgctgggtgccaggcactgcttttccatattcttttctaaactgctaaaatgggtgattattcctccaggctctttgctgacactggggggaaattcttcttggttttcacacccctcttaggacgtgtcttccactctggctttacttgttcatagattcatgaaatcctcaacagagatccttgcaagtgctgaggagatagtggtgaacaaaatagataagatttctgcttttgtaaagtttacattcttctagggatcgtgtgtccttgatttggaatgcctgcttaggggggtcatgagggtataaccctggtttcctagtttccagggaatgggttgggtcattccttgtgtaacagaatattacccaactggaaccaaaaaattccttcagtgtcccttcaggcattggctttagctagtaggaggatgtagagaaattttgtgcttctgttatatctttctcatggggagctatgcagatccatctgtagggatctagatcggctacaatagtagtggccccagagaaagttgacatcagaacccctgatctacctggcatgccacctttaagggctttaacttcagctctgtgacgttccctaggaaaatcccaagaagaggtgtcccaaaccagtggtataagtaagagcttaggtcttgagtccatcactaaagaccttgggcaagttatttaatctctttaagtctcagtttgctcatctgtaaaataggatggcagtataacccatctactattttaaggattgtacgacattctgcacctaacaccttagcatagtacctaacacataggagattttagtaattattaactactatgagagaggtcaaggaggggagggagaggtgccatccatggtggataagttgtgctagcaagtgtttgtatgtggaacttttctattgttaactcttttacctctgctaatttttgccattaccaccggacccctatgtaggactcatctcctctagggtaaggtgccccgatggatcatgattatcagcatcctttttagacatggatgtaagatacttctttcttggcattctattctattctcgctggttctggattgaatccaaatactaactggggttatgtccgttttatagcaatgccatgttacaacttgtaaaccgtcatattatgtagccacttaaaggatgaagtaggccttaatctgatattatggaaagaagataatatcgactcagctgagatattaatgtatagatagataaatggggaaaaggatggtaaaaagtagtataatatgtatttataaagatttagacatatggatgcatggatatattctcaacagacctaagaaactatgaagagtgattattcaaagaaaggatgctgagacttcatggtaggagcatactaccaatttattatatgtgatttttttattatttgttttcataacatttttttaataaaaataacgttaaaataaatcttaagcacagcccccaaatatctatacttatctatgggcagtctttgtttatctcttttccacttctccagacgagatgggataaaggagattgtagaagcctggggagtcatagcactcttgttcttgtaacagttagcttttgctggtaacaaacaattccaatatttcgtggcttaaaaaaatcatatgtttgttcacatttccctgggtggaccatgtgggctgtgctcagcaggacatttcttctgatggtttcatctgggtttactcacaccactgaaattgaattgcctagaatgtcttgacacacatacttggtgatttgctgggttgcctcagttttcttatttgtggccttttcggcaggcttgcttaggcttggtcagcaagctaacttgagtctcagggaccccagtgcagcagtgtagcaatctctaactgaggagcatctttcatcccttccatatgttgcattttctgatgtctactggaccaaatcaagacacacagccaatcccagagtgagtgatgtctcgcgatggaggaagcttcacactcacctggaaaaggtatatgcaaatggggatgggataagtttgtggccattgtttgcatctacccaggcctctttaaggcaagccatgcactgaagggaataatgctctacgaggaggatgttccttaagccggaccttcatccctaaatcatctttggcacttgaattcaagatacatgtagtctctccctttttaagagcagccttctatttgcttatacgtatgcatctttcttatcttttattgtttcagcaccactgataattttgctttttggttcttttttgttccttcagtgaaatggcagcccagaggtaaggtagtcagtagtcatatacctctagtgacaaagaacaacccctggataaagcaccatgtatcttcagggagctgtgcaagcctgcatgatagagctagcaccaacggtgttctgacaagtatgtcgattctgagcttctccacagtccacctgttgggaatctatttgctttggattaaaggcaccagtgcatccagcttcaacttcacattcccctgcccttcaccatcagacagtttatttcagagatcatttgggatctaatgtgtttgcttttctgattctgctggcactggtgtatgcttcaccattggtttatggatgcacagagtaccggggtagtatagagtgagaaaatttgcatgagacctttgtaatgtgaaacttaattaaaagtgcagaggactcaaagtaacagggagctagaatgagggatgagtttgcctatctacattccaaacatactgagtcttatttgacacctcatgttggtagatagatgggcaagtgtgaggggtagtaggtatgacctgtcccactgccatgttttccaaaagctccttgtacatgcattgaattgcatacttgcaagctttatcttacaaaagcagaataaagtgcatcaaatcggcacttctatttaaaaaacaaagtctggccaggtgcagtggctcacgcctgtaatcccagcactttgggaggccgaggtgggtgaatcacgaggtcaggagttcaagactagcctgcccaacatggtgaaactctgtctctactaaaattacaaaaaaaaaaaaattttgtaattttttaactgggctagtggcaggtgcctgtaatcccagctacttgggaggctgaggcaagagaatcgcttgaacccaggaggcagaggttgcagtgagccaagattgtgctgctctactccatcttgggcaacagagtgacactccgtctcaataaataaataaataaaaattagaaaaataaagtctactcaaattattttttttccttcaccagacttgggggtttctgccctagttatgcagtttcttgctcagtggttggatttgaagtattccttaaagctcttgattgtcagtcacttttatgtagttgtcactttcagtatgtcacagtcaatagcagaaatgtgaagcttgtagacattcattttcaccctgatattcatcactcaattgagctttgtttatataaggaatctaaaaatgcacacatttatgattagtaaaaatggcatttgggaaaaacttttcaacaggagaatatttggaaacaaaatgctcccattacatccaggaggaatgtgaattttggaaatcccaaataaaatcagaattgaaaaatattaggtattctcgaatgcagtttttagacacacgtttactctgtgtattctcaccgtctagtacagctagacagagattatggggtcctggcttatgtttgggtatagcagagatgaggtgaaataaataaggtattgatttaatcctcaagaactctactcatttaaatggacagagaaaacagatgtacatgatacattcaaaggaaaaagtgtagtactctttggtacagactaaaaactcaagagtctaatgaaggagaaatcacatacgtaagagtggtacataagagaattccttggaggcagtggttctgataacacattcattcatttcaaatgtatccaggtcctactcagtgttggggtaaggagctggtgccactgttaaacaatgggcgaaagtgacagagaacctgttacctaggagcatacagttgagtggggtcaggagaggaggttagtgacatgggtggaagaggaaatcacatcatcacaatagcaaacctctaattactatctgagctaactgggataggtgacctaaaggaaagattcctgattctagcaaagcagttagcaaaggtgcacccttgcatatatccagacatgccctactaagaaagtggcactgagctgagagtgggaaaaatgagaaacagttaatttagaagcgaagagtcttctggacaacaggagtgggcaggtcatgtagatgccccaagtgggaggcagaagtcagtgcttctggactaagggaggaccatgtgggatgggggagagaatagagtggggaaatgtagtgacagcagccagcagggagtatggggagctggagggaagagccagacactcagatctatggggaaggcattgcagtattgaaaacagcttgggtgaaggcagaaccagggtggaaaaggcttagttggagaaacaaaaggagagggtttcgtggtcaaaggcagtgagaaagaaggctgagggaatgaaccaagactctattaaaaaagatgcgtcagggttaagtggggaccatttataaacttgggacatctatggacccacagtgtagtctagactcacctttgatgttgaatttgtcagtataaacggtaataacaatcacagtagctaatttttttttttttttttttttttttttttttttttttttttgagatggagtctcgctttgtctcccaggctggagtacagtggcttcatcttggcttaccgcaacttctgcctccaggttcaggtgattctcaggccttaccctcccaagaagctgggattacaggcaccaaccaccatgcctggctattttctgtaatttttagtagagagagggtttggccatgttggccaggctggtctcaaactcctgacctcaagtgatccacctgccttggcctcccaaagtgctggggttacagtcatgagccaccgtgcccagccttagtagtagctaatctttagtgtgggatttctttatgtcaggcagtgaacttactgtggtagagggctcatgactgcttccttttcaaccctacgctgtccatctgtgaacatttccttcaaatcctacctccaaggtacatcccaagtctccgcttctgatgttttcactgcctcagccttctgagccagcatcgttcctcacctccactgcagagatggcttcctagccagacatcccaagacctagttttaccttcctccaatccattatacacatgatagacaaaattacttaaaacataaatcaactatacacccattttcatagcagcatgtttacaataaaaaagaggtggaagcaactcaaattaaatgggtatacagaatgtggtttgtctataccatggaatattattcaaccttaaaagggaaagaaagggctgggcatggaggctaatgcctgtaatcccaacactttgtgaggctaaggcaggaggattaatagaacctaggagttggaaatcaacctgggcaacataacaagaccctatctgtacaaaaaaaaaaaaaaaaaagcctggcatagtggcacacacttgtagttccagctacccccaggctgaggtgggaggatcacttgagcccaggaggtggaggctgcagtgagctgtgattgcaccactgcactccagcctggacagaaatcctgttatatgtccaacatggatgaaccttaatggcattatgctaagagagataagatagtcacaaaaagacacatacagtatgattccacttatataaagtatctaaagtagtcaaattcataaagacagaaagtagagtggtggttagccagggctagaaggaggggggaatggggaatgggggttttgttttaatgggtagagatttcagatttgcaagataaagagttctacagatgtattgtacaaaatacacttacgttcattgcatcacttttcacaatagcaaagacatggaatcaacctaaatgcccatcaatgatagactggataaagaaaatgtggtacatatacatgatggaatactatgcagccataaaaaagaaaaagatcatgtcctttgcagggacatgaatggagctggaggtcattatccttagcaaactaatgcaggagcagaaaaccaaatactgcatgttctcacttataagtgagagctaaatgatgagaacgcatggacacatagagtgaaacaacacatcctggggccttttggagggtggaaggtggaaggagggagaggatcaggaaaaataactaatgggtactagccttattacctgggtgatggaataatctgtacaacaaaaccctatgacacaagttacctatgtaacaaacctgcacttgtccccgaacataaaacttaaaacaaaaatataatgtaagtagacttaacactcctgaactgtacacttaagaattgttaagattatgtgggttttttaaccacagtaaaaaaaaattcaaaaaaccaaaaagaaaacataattcagctaatcccttaaaaccttccaaaggtgtcctactgtgcttagaaagagagaaaaaatgactgttgtctataaggtcccgtaacatctcgtctctgcttccctcaaagacgtttcctattgctgtttcttctttacttttctcttgaacttctctctctcctgcttaccgtaaaacatggcaaggtcattccatcctttgcatctgcagttacttcatcctaaaattctctacgcctaaattcacaggatgaattacttgccatatttaaggctctgtattaaatttagagaagaaatttgccatttatattaggttgatacaaaagtaatcacggtaaaactgcgcttacttttgcaccaacctacgaatcataacaaaaaaaaaaaaataaagattcttaacactgttgttatcattaatggtattcattatctgtgcctcaggttgagacctggtttctcagtactatgtgaatgtaaagtttttattttgtaggatttaattttaatggcagttaagatcacccttcttcatggcaccatacatttggatgagattttaaaatataccactgatcttgagaaaagactgattttatttcaaaggagtaaccagattttgttgtgctttcttttgtcttaagtaacccttaacctttaatgcagagaggatcttccagtaaaatcccattatctggtaaaggtatttttggggggagctggccaacagatttaaaatggaggaatttttttcctatgcggttatttgagctccttatatattctggttattaatcccttgtcagataaattggtaacgaaaatatggtacatatacacagtggactactattcagctataaaaagaatgagatcctgtcatttgcaacaacatagatggaactggaggtcatgatgctgagtgcaataagccaggcacagaaagaggaactttgcatgttcttgcttatttgtgggagctaacacttaaaataattgaactcatggagacagaaagtagaaggatggttaccagaggccaggaaggatagtgtggaaggaagaaatggggctggttcatgggaacaaaacatagttaaaaagaacgaataagtcttagtgtttgctagcaaaacagggtgactgtagtcaaaaaaaatttaagtgtacatttttaaataagtaaaagagtataatcggattgtttgcagcacaaaagattaaatgcttaaggagatggagacccatttaccctgatgtgattattaagcattgcagatctgtaccaaaatatctcatgtaactcataaatatatacacttaccatgttctcccaaacatgaaaaatataaaattttcaaaatagaaaaaactgtaggagaagtcagatttgaggagatgtaaaataaactatatccctgataatgcaggagacgctccataagtgatgggatgtttactcaaaggcaaatgtgaagttggccaaccttagacaattggccacatgcgattcagggcaggggtggtgtctgttcctgtgattgaagcagcttcatatcaggctcctgtcttcctagggatgcttatagttactgaaagcttctgactgtaacttcctctatcctgagctctttgatgggagtcagtagagaaagagaagagtggaaacatatgtatgctctcttcctcattataaagatttatttttattagcccctttgtctcatgtggctggcattgaacagccacaccggaaccattattggattctgcaagcatctctgaaagccggcttttcagtcacctcaagttgaagtgtttttgagatttgaactgcttttgttcgtggaaggtcacatgtgatgccacagaagccaactcccagtttcccgatgccgttctgctcttgttgttgatgacacgctgagtccctgacctggctaagctccctcactaagaaagatgtgattttggtcacagaggagaccaggtgagggacagcaggcacagatgacaacacattattatcattcatttgttcactgactacccaagcaattggagtctgttggattccatgtgatggagaagtcgggaggatgaaagcctgcgtatgcctccagaggctccctaccaaatgatttttaatagtctgtatccctcccacaaacacagttggttactctactgggcaatgaagtttaaaggttggagaggctccaaatctgggcacagagaaatctcagcttaattgtcccaaactattaaaaaaaagacaacaatttgttgccagtacctggcggactgctaaaggtttttgtcatttgttaagtagtgttgcacccttagtgctgcacccttaaaaaaaaaaaaaggaaaaaaaggtatgccctctttaatacttactagtggctgactcataattttaagcatgaaagacaaggagtggatttgaaatgtggtgtgtgctgcttctgtctcccacggcagcatccaatgctgtcacgagctgttaaatgatgagttctgaggggtgtatgtttaaaagcaacattgaggttgcaagcatccaggaccattgaggtagcgtggatcagaatggcttttccacgtaagagcaggcactggataaagcccagtgtgcctcctggtgttacgctgggttggtggaaaagcctctggaaaatcccaaaagagaaagatggaggagcgaagagtgtgatactctgatactcagatgtgttggtgcccccataaaaggggttcacaggaaatagggaggaataggccagtgtgctggttcactttggcttgacacatgcaaattgcctaaaatctcttctatgctttttcttagtgtctatcatgtagcagaaatgaatccctcttggtagattgagaatatcatacgcaaaatgaagacctgggaattttcctgctctgttcctaggccctggactgacatgggagaattttaaaacatgcgcttttagaatcaaaattagttttcatgtctgcagagacaaggagcccatggaaactaccaactggcattgctgagaataattattgtcaaattgagtccattgtgaatagtcctcatacataattgccctggttagaatgagcgccaaagagggagctttaatatttactaactccctggtgaagaaagaaaccttttgctttattaaaggctgtggtgatagtaatttgctgatggaatgcattagtgacatgcactatagatggattttataagaagacattgtccagaagagattattcaaattctactagtggctttcctctttgtagaagtatctagacttgaagtcacggctttcttcttttgataatatcttgattcagtaggaaaccagtgcctgtgcagctctttgtaggagtgtctatttcataaagttcagattatgtcagtatttcataacagccaggtctttccctgagacttacccctacagggataagagaacaagcaggacatggtggcttatacctgtaatccaagccctctgagaggccaaggcaggaggatcccttgagcccaggagttcaagaccagtgtatgcaacatagtaagacctctcttctctacaaataaaatgaaaaaaaaaaaggaattcgccaggcatgatggtgcatgcctgtggtcccacttacttgggttgctgaggtcgtaggattgcttgagcccaggaggttgaggctgcagtgaaccatgatcacaccactgcattccagcctgggtaacagagcaagaccctgtatcaaaaaaaaaaaaaaaaggtaagagaaaaagagatttatgcatgtatttaatgaaaaacatacattatcattagattaataaaacttcaatcaagagtgctcaaaattcaagcctcgggtaggatagggaatgcgttgcattcaggccttggacatgtttttcttggataggtcatggagttgaggggtaagcatgggacaagtccagcatcagaccaaagaagcctaatgtagagggtctggaccaagactgggtgttgctagacattacacaagagcctctttttagtcttctgcctccaatggacacccatgactgatcctaggaaatgttacacatttccagagttctcccaagaaaatgggaatatctgtgaggctttctagttcagtccccacatgctatgaggacccttgctgtcttgtgttttggagaccgtgacgtcactgtcttgtttctgtggccacaggagagtcagtcagcaggagcaagaggatggagtagtctcattgtcttagccacagccaagcctaagctttgctctaggtcaaatgatccaatgctggcccatgaaggggagtcaactgactttattttgaaggtttttaactagagagaatgtcaactctgcattggccttctatcttttgctgttacacatgaagttttgtattgggatggaaaggagaagcagaataattttgttacgaattcctacttctcatcgatgtctccttcccactgtgaaaatacaaaatagcacatcaatcaatatggcacagtattgaagaatccaagtcagccagttctagtctggcttcaaatcccagctctaccacccattcttaagtgaaatcttaggtagctctctgagcttcagcgacttcatctgtaaactcatgagagtaagaatgcctagcatattggggcttaggtaagagtaaatgagttagtgaatgctgggcacttagcacagtggttgccacgtagcaaatgcctggcaaagggactgggctgctggtagtgattctgtcagcttctcctccttgttgtctaactttgtgcttggatagcattccttatggcctcatatctacacatcaaacttttcaggggaagagagagcacattggactcatgactctgtgtaaaagtttggagaccatgaggccgggcgcggtggctcacgtctgtaatctcatcactttgggaggtcgaggcaggcggatcacctgaggtcaggagttcgagaccagcctagccaacatggtgaaaacctgtctctactaaaaatacaaaaattagctgggcagggtggcacacgcctgtaatgacagctattcgggaggccgaggcagaagaatcacttgaacttgggaggcggaggttgtagtgagccgaaatcgcaccattgcactccagcctgggggacaagagtgagacttcgtctcaaaaacaaacaaacaaacaaaaaaaaacaaagtctggaaaccatgacatcattgtcttgtttctgtggccactgcagagccaatcagttcaagcgagagggtggagtgttctcattggtttggactaggacgcataatccaatactgtcacctgagggggcgtcaggctgaaagagatccccaagtggaaaacgggctgatgggaagaacagaaatagggaaaataaagatggaggaggctcaacacatgtccactgtgctttgcaaatggcgcatgtccaccttacagagaatcaacacctcaaggcatgaactgtgttgctctgtaagtccgtagccattggtcgtcaagaatgagcttccctgtcattaggtgaacccagaagtaatcagccctaggtgtcacgttccatccagtgctctttctgcttttgagccacttactgaaaggcttatctcccatcctttggggatgctctctgcttaaaaggatgtttagaatgccatttgtagcacacacacgtacacgggcaatcctttccacttcatcttaccatattcatctgaatctggcttcccgagagtctctgtagtatggcgtggaggcttaagagcttctgtgtctttcagagggtagaaggagattcagtcgactttcttttgcccacatgaattgatgctatgctcctttaagtgccaggtttagtcccctgctgagatcacacttacctcaactaaattatttttcatttaaaagcagccatccattcacagtcttttatttgtgtttcaatgatgtttgtaaatgtgctctagcagttgaaagtgtaggcacgtatgtgggggagcattcctgatgttcccctcaccacgcatttgtgtacccctcacatgccctttgtctgtgtctcatccatctctaacatgaccacaaaaatggtgtctcctgaagtgttcaaggatctaccctcctccatagtcatgaagtttctagtaataatggtaattattcttattgtaataaggaggaaggggtggaggagaaaaaagtgatggagaaaaatggtgtctcctgaagtgttcatggatccgccctcccttgtagtcatggagtttccaataataatgataattattttaataaggaggaaggggaggaggagaaaaaagagggagagaaaaggggagaatgaggacatgaaggaggaagagaaggagttggagaatgaaaagaaaaacaagaacaaaaacaaccagagaaataacagtgtagtattagcacatctttgacacaagcttcaataatttctgaagaagtgaaggaaggaagaaaagaatggaaggaaggaaaggagagaaggagagaagaaatgggtgtatattacaggtttacttatgtgctaagtcctgtggtcagaccttgacatttcattttctcctgtaatgttcactctggctatacaagatcagtgatttcattatttgcactttctagataaggatgctgagcaaagtggcttacttttctgtattcttcctctcctgacccatccattttatgctcagctgctaggcttgtctttgtcagacacattgcttatgccagtcttctactcaaacaaccttcagaagttcccagttgagcattacgtaaaaccaaacatatgagcctgagatttagagtcctcccattttggtcctggacatatttttcttagaatctaagacataactaatatgctgtctacccactttgggtcatacccaaatggccagttacattgttcccatgtcttcccttgagagcagacatttatgaacctctgtttaaatagaataatttttttctaaagaagcctttttatggatcaaaatccttccattattctctgtgcttacagagtcttaagtctaaataatctctttaatctgcctgccttctcttattccatttctcaaaaccctcccctgctttgacttcaggctaccccatacctccactgtgctgaactaatgttagccataaacatacttgcacctgctgtttcctttacctggaacagctccttcatccgcctgaagtctctcacccaccctaatggcctcttgggtgaatttcactctatcctttaacacctagctcaaatgtcagctttgcataattttccttgactctcctagatggaatgagtctgtgaaacctgtatttttttaggtactggtactgaaatacctgaaccctgtatttagacttcctggttttattttttattttattttattttttgagacagagtcttgctctgtatcccagagcaatggtacactccaatcccggagctggagtgcaatgatagaatcttggctcactgtaacttccgccgcccaggttcaagcagttcttctgcttcagcctcccgagtagctgggattacaggcatgtgccaccatgcctggctaatacttgtatttttagtagtgacaggattttgccatgttggccaggctagtctcgaactcctgacctcaggtgagacttcttgtctttaaattttagctctgccttctatgaaatgtgtgagtttagataagctgctatctaatcctcagtttcttcatctgtaaaatggacataggcttcaaacccatatcacatagttgtaagaaataataaaaggtgatcatggaacacttagcagtattcaacagtagcactcaacagcccctgttgttaagattattttatgttcatatgtttaaaatgtctttgtttcagaggaaaaactcctcaaacataaggcttgttaattttttataaccctagcactttgtacatgaagagtgactagttcataaaacccaacactttcatggaattgaaaaatacttttttattgaataaggcattggaagacaatctgttgattgtcaagatttcagtaacatcaccaattattcgtggtgctagttgcaagtaaaatgaaaaaatgttgttttctccattctcattgtggtttggggtaacttcgattaaaatgcatatataaaccagtaatttcaccaatagttggtagagacattgcaacacaaaacctgcccaggtgtggaggatgggcatacagtggggtattatgggaatgttgcatttgaaaaagagccccagtcttggcaccttgacatcttcctgggaaaactaaccgctttcctccacaaatatgctctgggggcagagataaagtatgaggctaggtcagaagctgtgagcataaattcctactagtgtagacatcaacataatgaatgttccttttagcctctcattccaaatatagaggtggaaggcatgtccaaggttgtgacacaggatgactggcttgttgtgggccacttgtgaccaagacatttcccagtacatgctggttcctaatttaggtccttggctcgcttctgacaagccactttatggaagggcgtgatgatatatggccttcccctgctgaacagctcgcattttgacatcacccacaattctgcatattcagtttgctctaatccagacataactgttctcccttcacctttagtattcaaggttgcatcctgatccgaatacatctgtgtttggggcaaaactggagggtcgtcaattaatcttaggcatgacagtttattactccctgaagtctctctttctccttctctgctggacagagaaacagagaattcccatttctgataccagtgtctcctgtctcccagctggcttctctttggcagcacttctccacctacactgccgaagtgggagaggatgtgaggatttatattcaaggagaatttagaaatgctttgtgtttcagagagtgctttgcctgggtgtttaatcccgtgaccatcaaacccctcgagatagtacttgatggctacaataaactggcctctttcctattgtctcttcttgattacaaaccctgtcttgcacgatggtttcaaaattatcctcctgcactttctgccacatcccttcatggccaagatttttccaagttgtaaaatatttttgcttttcttccattcgttattttattttccaattcttaaaagtacataaccagagattgtatgagaaataaatgtcttataaagtctggggccttaatacttgtggtgatgataatgagatgtcgatagtagtgatgatggtgatggtaattgtgatgatggctattttgcattttggagacatgagacccactgagttaaatgatgttcttgatgcctcattgactctgaagttcttgtctgtctttgttgaactaattcaagttggagattttccttttgtttcttttcacccctaaatgtcaccattcctgcaatggatgaaaatgtggatttgttttttaggaagtctaagtggatgagattaatagcctgccctgtggtttgttaaataaacttgataaggttttattgattaccttgagggttgtctgggccaaacaccatgtaccatttaagaaacaaacattagttaagaaaagttttcatctcacttgaggaggggaaaaaattattgcaagatacgtgatccagggaaaggacaaactgagagattcatggctcaaggctttctgtgggtgtcaagttgggggtcatggggaaagaaaaagtgcaccaatcaggggccaggtgatgaccgtgtgtcatttcaattaatgtgcttctattatacagatgggcacactgagagtcagttattttgtgtagttttctctgggtcatgtagatctgattccagttcaaaatcatgctctggcacctcctgtgctgggaaaacatcctgggaaggtgaaattcagaccacttactgcctccagctcttggggcttcttgacattgtcctagtgtttgccttaagggccacccggagtaactgccctttgaattttatctatgtatgtatctgtccatccgtccgtccgtccatccatccatccatctatctctgtctgtctgtctatccatctatctatccatctgtctgtctgtctgtgtgtctgtctatctatctatctatctatctatctatctatctatctatctatctatctgtcttcctgcagaagtagcaaacgtgccccgttcttccctggagctagcaaaagcagggatagcatttggtcagagttcagccacacacttcttttctttctggcttaccaccacctagtggggccagaaaataaagggggaaatattttctcagtgggctcccaaggactgtgagaagataaacacttaattctaactactttctcccttctcggtgagaagctgccacccatcgtatgcacaaagtggaaaggcacaaagtggaaagcttgacttgccaagccagccaaatgtctctgcagtcaagatatggggggaaccgtctgtgtaatttatctctaaaatggaattggtaatacctgccctgcctaccacactgggttgagtgaagagtgggagtgctctgtgcaccagaaagggtcaaatgaaatgagaatagtcaggtgatactattgtgttgcattgtcattgcagttaatacttccttttggagaagaaatactgtacatggggatatagccctccaccttgggaaaacccagagaatattcatttctgatggaaactgtggctgggcgcagtggctcatggctgtaatcccagcactttgggaggccaactcaggaagatcacctgaggtcaagagttggagaccaacctggccaacatgacaaaaccccgtctgcactaaaaatacaaaaattagccaggcgtggtggtacatgcctgcaattccagctactcaggaggctgaggccagagaattgcttgaacccgggaggtggaggttgcagtgagctgagatcacgctactgcactgcagtctgggtgacaagaatggaactctgtctcaaaaagataatagaagaaaactctgcgagaactaccaattacccaccacctattgtatgcccggttctgtattagcaactcagtagacactttcttatttagtgtctaaggtcttcattatctccatttcataggactgagggttagcaagatgaaaggacttaaccagaactaaggcaactgatatataccagaactgtgggtttggccccatgctcttaaccacccttctgcaatgactgagcaggtgctttgggtcagtaggcatggtattaaactatcagtctgtcttccttcctgggagagacacaaaaacattgagaactcatgggcatgtttccaccgtgcaggtgctaaggtttcttatttcgtgaccagagaccaggcacattcagtgaactgcttcattcggaggtgcttggagcttcttcatggccatcctttgcaacttggagtatgcaaacaacatttcttctctaaattaaaagcttccaaagttatgatggtatgtgctttttaaagaaaggatgtattcaaaatttaaagcgatgttgaattttgatagtattgctttgtaggttgttaaattgtggctttagacaatgagttgtttatagaactacaaaatccttgtgaggaattcagatttgtctacctttcttagagggtcctaatgaggttgtgttttaagaaatgttacatagactataaaatcctaatttttaaaacaatctggttcattgtctgaagggcctcatttaacacatagtctctgtacacttggtaaaaatcataaaatgaaattattcaacgtaactgccatatcagtgggactatttgtttataagcaaaaaaacattggttctaacttgtgaaaaaaaataattcattagaaagatatgtgggcacctttagcttgaaggggagggctgaagactatctttgaaaagggcaggacccaggacagttctgcagggcctcagcagcaggaaccctgcttagtttgatccagacacccttagaacctctaagtggcttcgtttcgatcaagtgccagtcccttgatttggttataccaagccatctgcttaattaaccccacaaagcaggtataaggaggcagagggaacttccaaaaaggactttgaagtgctattgtcaatagaaagtaggcagacgttgctgagagaaaaaaatccaataaaatttctgtgaataaccagtgttggaaagagtgtagggggggaaaaaaataattgcttcgccactagagagatgtaaattggcataaattttccgaagggtaatttgtcaatttatatcaaaacctttttacaatgtttagatcctttaatcaagcaattccacgcacaggaatagcggctgacgacaatcaggcaggtgggaagcaggcttactagaggctcaaaatggtgtttttctgtaattgtgaataaatgggagaagaaaaatacctaacaatgggtattgcttaaattatagcaaatagacattatgacagggaagcctaggctgtgctactgttgctcattggtcaaggaaaaggtgcatgcacgtttttaaagaatggatatgttaatttctgaagcccaagacatccctgtctaacattccactactaattgcatttctcctcctcatttaattttaattaaacctttccttccctctctccctcccttcctcatttcttttttctcttccttcccttccctcccctcccctcccgtcccctctcctctcctctcttctcttcctctcccctctcctcccgttttatcccctccccttcgcttttccctccctccttcctctcctctcctctccttccctcgctctctttgtctttctctctttaatcttttttccttaaaacaccagcaatcacacatgttaaggccatattatgtttcaaagaaatacttgtaggctagcttaggaattctggctaattatagccttgtttggatagccagaaaacaacaacaagaaaaaaaaattgcaaaatttctgggacttgactttagatacgctttgtaaacatgatttctatctcctgtacaactgtgattcttaaagctaaatagtgaggaatcctcatgtctaaaaatggaaggcttagagttaggactaagaaatgaagtccttatcactggcccattttaatctgtgtttgggtcttgttgaattcgagctaagggaaggggaatacttcttttgcagggctcaggaattaaaagttcagctctcacttttctcaccaaggttatcgaccagcttctacaaagccaaatatttgttttctaatgaaagtgttaggagatttggcagagtaaaaacgtccttgcatctagaaaaactggcatgtgttttctttgaatcaatttccaaagattatgcagtatcttttaatggcactctggggacccacagtgtgtgtgtgtgtgtgtgtgtgtgtgtgtgtgtgtgtgtgtcttaaaaattaggatgaacattttatgtctcccaagtagataaacctctgccctacccccagtgaagagatcataaagcacaatgttattaattcagaagtgatgggagggaatgccataattccagagatgatatttgttaaaatattgatggcttaccactttcccctgttggattaatttttacccaagctggccatttatcagaaggtacataatgccatcgtattgggaagatttttttttgaaagatatttatgaagacatcaacttcagtcaatgaaattagacagttaaaagatggcaaaatatgctttggcttagcataaggaaagcaattctggatgaagctgtttctattaatttagctgacaggaaagtgtgagggtggcttgtaaagttaaatatgacctgttcagaaaccataacttgggttggcattcagtaccggggttaatactaataaccaggttaatctttaggtacagtacctaagaaacagtgaaccataagaagggatattttggtaaaggagactgaattgtgtcttcttctgcttaacccatttttatgccttccatgtgcactgataatgcaacccaaacctttgccttgacctgcaggttttgtggggtatagccccttcctgctcacaaacttctctctctagccacactctttgtttctcttccttgatcccacctaagttcattttggactcggggacttcgctttactcctggctttgggatgttgtccaggttctttaaagaaccagctccttcttatcttttaggcatcaaagaaccattgtccatcctacataagaaaactccttcctgggagtcactagcatttaatacgtttattcatatttactgctctttaaaataatcttatgtgtttgtttgaattgttcaattgcctttttctgccaactggaacgtaggtagcatggggtgactgtctttgtcctgcttactcatctctctcttctcagcatgcagaggaatatctgataaagagcaagtacttgggaaatacctgaggagggaaggaagagaagaaggaagagacagagggagggggggttagtactggcaataagttgataaagctactagccatttggacgacagaggtgtttagatggtttggtgtggggctgaggggcatcggaagctgtgattttgattgtgtctatgaacttggcaatgttaacggtcattgaacatgggtgcacattttgtccaatgcagtgaagaactctgaaggcagctccagtctttcagtggggtgtgcccatacttgatcactatcaccctatgctaactggatgactttggtacgctacttacccttttttgaccttgcctttcagtctgtattatgagtgcatctgtcaaatcagagattttcacattctcaagattttatccaatcttcaaatacatcataagtatgtttgttttaatgtcatgaattgttcaaatctgttaaagaacttcaaaattatacattcatcagaacagccacatagccccattggttgactataaaaaagcgactattacatcctcatgaaatgccacttatttagttacattttgaaggtacaggtaagattttctttgaaaaaaatgtgccttgctaccacagttttttatatttaatttttatgagtacataataggtatagatacttatgggatgcatgagacattttgatacagggatacaatgtgtaatacacacatcatggagaatggggtcttcatccctcatgcatttatcctttgtggtataaataaatccaattacactctttattttaaaatgtacaggtaagttattattgagtatagtcaccctgttgtgctatcaaacactaggtcttattcattctatttcatgtacccattaaccacccttatttcctcccccgacactacctttcccagcctctggtaaccatccctgtactctctatctccgtgagttctatcatttttatttctagatcccacagattagtgagaatatgcactgtgtgactttctgtgcctgacttatttcacttaacacaatgatctccagttcattctgtgttgttgcaaatgactgtatctcgttcctttatatggctgaatagtactccattgtgtgcataccacacttgctgtgtgcattcatctgttgatgggcacttaggttatttccagatctttttatggcagcagtgtttaccgtagttctacaaactcactttcgaagcgtgtttgtcttccatgttacctcgttagacatcaagttcctagtaaacatttaggatgagggtaagggtaccacaaggttgtgggcacagtttttgagtttgttttgtgttaaaagggcctgtggaggattgtgtttgtgttctgggactgccataacaaagtagcacagacttctctcacatttctagaggcttaaagtctgaaatcaagatgtctgctgggccatgctccctgtgagggctctaagaaggaaacctacctggcttgtccacagcctccgttggttgtcagcatccttggcattccttggtgtgtattgtcattgccccaccttcttcctccatcacctggctccttctctgtgtgtctgagtctatgtgtctccaaatctccctctctttataaggacaccattccctggatttagggcccatcctgagccagtatgacctcatcttaactaattatatcggcaaggaccctatttccaaataaggtcacttctgagtatctgggtaaacataaattttcagaggacactcttagtacagagatcttcatgttagtgggaataggctgggttactgtttgtacaggacattccctccctccacctaaattatcaacacaaaactgtaaaacagagatatttggtcaacctgtatttattgggaattgcttgcaaacatcctgaactatagtaagtgttagaaggcaaacaagaagataagaacaattctagcttgaagaactgtgtgatgtcactgaggagcaaagtggcactcagagaaccactgcagaattatcaaatcctaaacttactggggagtatgtgatgttagagtttggagaagtgcttgatgaatttgggctggtgtagttgagtacacttctcctgagcaagagcgtgagctgagccatgaagcattggtaggaccctggagacattgagaagtgatgctataaggtatcttaaaagtcaatgaagatgtttgtgctcaagtcaggagcaaatgcatgtttcactttgttggttggtgctgctataacaaaacatcacagactgggtaatttctaaagaacagaaatttatttttcattgttctggagactgggaattttcagacttgggaaatgtcacatgaaggcaccagcaggtctggtgtctggagagaaccccgtctctacttcctagatggtgtcttgttgctgtgttcactggtgggaggaacactgtgcttttaggtggtggaaaggagggaagggctgaaaaatggtcttactattgtctccagcaattttatagggtcatgaatcccattcatgagagcttttctcccataacttaagcgcttcataaaggcaattcacaactaagtttgaacacatgaattttgaagtagacacaaacattcagaccatagcacacaggaaatgcctgtgtctgctacaagcagagaaaaaaagcaagggaactaatggtggctgaatgcgggaagtaaaggtcaagtaaaaatgaccccaagatatccagtatgagattgggaaaaatggaattaaacacttggaaatggtgttctcatcacttacatgaccaggttttcattccttggatgtgcgatagggtaagaagataaagtgagtcatggaatctttacttgaaatgcaattcaataaacatccacctcaccaaaccattctttatttcaggactggatgaattaattcgagtgtttaaaaaagagggggctcaccccaatgtttctgccaccattgagtaatagagtattgggtttcctatcgtgctgttatgattgggacaagcggagccatttgtcttttgctacatgggagaggtgttaataccaagcacatccagttatgttgtgaaaggctctgttgtaattagtctgagtcgaatcatcaatcaagagattctgcaattataagcaccagtcacactacattgctgtagaaggcggtcattcatgctacagcaatacttgtctattaggtctgaggctagatgctttatacacaatatctcatttaattcttaatgaaataccctaagagggccaggcacagtggctcatgcctgtaatcccagcactttgggaggtggaggtgggcagatcacgaggtcaggaaatcaagaccatcctggctaacatggagaaaccccgtgtctactaaaaatacaaaaaattagccgggcgtggtggtgggcacctgtagtcccagctactagggaggctgaggcaggagaatggcttgaacctgggaggcagagcttgcagcgagccgagattgcactaccacactccacccttggcaacagagcgagactctgtctcaaaaaaaaaaaaaaaaaaaaaaaaaaaaaacaaccagaaaaacagaaatactctaagaggtaggtattattactatccccatggtacataaaagatataatcacagagagattaaataaatcacccaagatcacatgcctgtgcattcacagaagagaaattcaaatctggaaatccaacttaaatctgcttttaaacgttattattagccgcctcccaaaagaatttgactatatttttccattagtctctttgtacccattgcctttctttttaaattattttatttattattcaatatgttaaaaccttttaaaacattcaaaaatataaaaagggatatagggaaaaagtaagtctcctatctacctatgatctctgactccacatttccctttccagaagtaaagacgcgttaccagtttgttttgtattttttgtattgtctgtatattttcagaaatgtgatatcttaggtatatactaagaggggtgtgtatgtgtgtgtatgtgtgtgtatcctctccttccttcctcccccaacaaagtgatttctgtacaggctacttcgtccttccccccatcacttaatgtatttttggggcttgggggtgtctatgttgccagcctgtgaaacacgtggataaatattcaagttgaatgtataatttttatggatttttggttatgtttctgtctgttcactgcctcattcaggccacttgaaacacatttttgttttattatttaggaccctctaaattgtaattgcatgcacctgcaatgatgtggaaacccccttatcttgaggactggtcttgattgtgttcaaagccacatatttaaggagactggagagcctgtggtttatcctcctgagtcagagcctgaaatcgttgaccctaaacccagagtgttttgtctctcaccttgtgggcgagttaatggttgccactccgagctgctgcctctgtagggtagggacgtgtggatgcacacagcagaggctctcataaggataaaggcctccttatgcacaattcaaaagagtgaccacacccctcagtcacgattccatgctttatccactttcttcctttgttgtcccttttcccatggcatcgctgaaccgtcatttcctattcatgtttcatgctctccttacctgtgtgttgatttgcatggatttctctatgttgaatttccttctaccttacatcctttccaccctcaaagatcaacaaaatcttgtcaccttcaggaaacctttcctgattcacccaactggaatccttccctttcttttacctaaaccttgattctgttatctttgtcttcggcacttttatcctccccccataaattgccctgctcatagtagttgctcaataaatatttgatgccaatcccatggaaataccagcatatgtgtgcatgcccttcaactctcagagacaattagacttccacttcccaaacttaggatgcctcactcattagagaattgacaagctgcctaactgtttgcacagtctccaacacattataaatatttggataagtccaccatcaatgcacagtcattgcagagccaataaaacatgaccttgactttctcctgtttgtttacatgcaccctacagcatcatctccaaaggcaacaggagcaaatggtgaacagctgggcaaaggaggtgtccttcacacgtcctatatttggaactggtggaaatagccagtatgattctgtgtcagtttaacaggatagatacgattttaaaatgacatcttcattgtgaaccagctgtgggcaggggctcatcttgatatcacttgtgctaggctttgagtagggcagagtttctcaaccactccagtattgatatttgggaccagatacttcttggttcaggggagctgtcctgtacactctacgatggttagcagcaccttgcttcaacccactaggtgacagtagcattccacaccccacctcccatccaaggccaggttgtgccaaacaaaaatgtctccaggcattcccaaatgtctcctggtggaagaaattggtgtaggggccagaggaatatttattaaatgaacaggtaaaattatccatgtttgaacattatcaatttctatttctctacatgaagaacaattaatcctccttggcaggtgtgcaagagaaacgcattttactcaatacctaattaattggttaaaaaacaaaaaaacttcttgtaaaccgcccccaaattctagctgccaccttgttatactccgaaatgtggtgaatttgtgcctccatctgttacccaatctatataacttgacatttgctaaaaagtaccctattaaagagggttgtttttattgtaaactacttttcaaataaaagcatattgcattgactgtaagttctactatgcataaaaaataatttaccctgtccaggcacggtggctcatgcctgtaatcccagcagtttgggaggtggaggcaggcagatcaagttcagaaggtggagaccagcctgaccaacttggtgataccccatctctactaaaaatacaaaaatcagttgggtgtggtggcacacacctgtaatcccggctacttgggagactgaagcaggaaaatcgcttgaacctagcaggcagaggttgcagtaagtcgacattgcaccactgcactgcagcctgggtgacagagactccatctcaaataataataataattattattaataatatattattatttatcctaaatgtaacattgagtcagctgttttcactgatagcacagctatggtatgaagtaagatactacaggtatattgaaataagaaccattagtgatttattgctaaataattgcatagactccacaacacgtacggaagaaggtgtttaaagttctacaaaacgccaagttgtagtaacacttgagaatctgaactgcatgtcttgttgatatttctttaacatttttattaaatattatccctagtttattgaacagagtcagctcagtgagatataaacatgaggtgactttttctccactcactgctcccaaattcagaattgcatattcttccccttcccctagaaataactcagatttttcaactttctggtcccttttggttattagatatagtctcaatgggtatttatgtctctgtcattttctctttcaaagtagctattttacaatgtgtttaaagtttcttttcttcccttgtcagtcagacttgtagcttccgaaaaggagacagtgtgtggtgtttttctttcctccccttcttttatcttagaatgaagagggaggattttgtatgactttggagcattttttcctttcttcttccggccctctagatctgatggagtttgggggcaggaagaagcggcaaagagtcatagctctcaagctcaacagtgtgcttgcattcctcttatttggcatggtaagcatgagtgagtttactgtcactcacatagttccagcagaaacagctgagcttgagccagtttggtgctacattccaagaggctcacctgcaagatggggagacagtgggctgtagcaacattgttgctatttgtctggtttctttgttgtaaatattcaaattctttctttctcacgatgcataactatcacagatacctcaaatagacatgcaggggcttctttgctccttgtattagtctattttcacgctgctgataaagacatacctgaaactgggtaatttacaaagaaaaagagattgaatggattcacaattccacatggctggggaggcctcacaatcatggtggaaggaggagcaagttatgtcttacatagatggtggcaggtgaagagagagagcttctgcaggggaactcccttttataaaccgtcccttccccacccccatctcatgagacttattcactatcactaaaacagcacgggaaacacctgcccccatgattcaattaccttccaccggatccctcctacaacatgtgggaattgtaagagatataattcaagatgagatttgcatagggtcacagccaaaccatatcactcctgtttcttgatttggaagatccggctccagaaaaaccccaatcacctcccttcctggtgtctgttccaaccatgcatcgcacaggccattgtcccccaccttgcaggtgagcctcttgaaatgtactagcaaactggcccaagctcagctatttctactggaactgcatgagtgacagtcaagtcacttgtgcttaccatgcccagtagtaggatccaggttgtttccctgcttcccttattcccactctgcccccggtttttcccaaattctatttttctccagcgctcagggacatctctgagacagccatcaagtttgctgtgtctgtagacttctaactggggaaagacatttcaacctccccttgttgcaggagcctctggtatttgcaggtacttcacttagcatggactcatggctttgtgggtgagctgaggagcaggtaccagagctctcagacataggatcagttttcttaagacatcttactcgttgctagattgttcctaagacctatggatgtcctgattatgattacatttaggacaggttctcatgaacgtgggaaaatggtgaaatatttttacttttcatagtttttaattttaatatcattggcttttggaaaatacctattgttttaaaacagctacctagggtttcaataaaagtggccttaatgttctattcctcagtgtacgaatgacccattctcggagcatatgttgtctagtagcccttgtcctgcctttctaggagatagagtttctcatggacccaaacagggcttcttaatggagatttataacatcaaaagggattacatgagaacaaagtaattatccttcgtgtatgagtatcaacccaatttacgaaggagtgaaattagacactgcagttaattacagggacagtctcaactttgtggaccaattagggctcattggttgcaagcaacaggaaccaattccccttctacattaagcaaaaagaatacttattagcagtagtcagtgagcttacaaaatttagaggtagttgaaaaagcagtgttggtagcatgacaggcaccaagccactgtgaggtctcctccatgggaagaaatgaattccaactaagtcttccgtccatgtatcattctgctccagttctggatcccagaagagcacatcccattggccagacttaggcaatacctccccttcttgagctcaccctggctgggagagctaagatgtcaaagaaagttcctttaggaaactctttatcttccagagtgggaaggcaaagtacccaatgtatggtcttacaaaggctgcataaaatgggggagctgtaacttctcttgggtactcttaggaaaaggaagcaccaaccagtgagcaagtgatctccattcccttttcatagagaaggtcgatttctatcctcttgcctggagggtttcagagctgccctaggctgtactccactccagggtggccctcagagaccattactgtttcctcatttcttgaatgtatggaggaccctccagttactttctgctttaaggcgatgtttattaaacattgtttctattagggctgtgctccttcctctgtaccctttaaatattcatctccctcatgctgccatccccttcatggagatcattcctgcagagcggtagtccagtttgctctacttcctggtgatcgtctcttctcgagatttcttcctgcacatgcacactctggactgtgcacttttctgctctggattcctctcctggacagttgcactggactccattcccatttgtctgagcttagggtttatgtctttttagggcatttaccgtccccactcctgtgttaccgtctctctgtgctcctagcatgtacacattgtggaatgtgagaaggcaaagatctcagactttccatgtgaattgaagacccttctctggccccttgagtgccagtgtcaccaacaccactggtcactctcctctcactttctacctgtacaaaggacagtctcccagtgtccctgtggaacattgtgattactcgaagttgtcctagctacttgggaatgagtcctaagaagattcatcttacttctgatgcatcacatgctctgtgttgcaaagcacacttggcatagccaggagcatcctaggttggcctagtgctagatggcaggcattgaaaactgtcaacaccagtacaggaacaggaaagacaaaccatggaactagatgagaccctgatactgagttgtggacagatcaactatagtgatacaggattcttgattgtctgcaacagagaacttttctaagtaacctatgcacatgataatttgatttgaatgcttttggggagaatgcagtatcatcaggaaaatttgagaacctggctcagaaaatagacaaaagggatgaaggtaccattaggatccctgggtagaaactccctgctaaggatgctgttaccagcactgtgatcactgccacgtggcaccaccagcatccatagtcctgaacacagagcagtggttctggactctacacttgacacagcctccagggatggtgcttgattgatcctgtgcttttacctagccccttaagacccaagacatatggtaacatacagagtcaagtgattttttttttttccttgaaaaagcaccagtgcaatttgaggaggaaaagcaagtcttttcaacaaataatcctggacctactggatgctggaatggaaacatttaactcagatccatgttttccatcgtagacacaaattaactgaagataggttgcagacctgactacaaaagcaaacactcgaaagcccctggaagggaacataaacatctgcctttgaaaactgagcatggtcaacattttcccagataaaacacagtacgtactaaacataaaagagaagtttgacagacttcctcaaaattaaaaactttgtcccataaaaagacattaagagaatgaaaagtcaagctgcaaggaggaaatataacaatgtatattatatatatgtgtgtatatatacacacacacatacacacatatacatacatacacaaagagctgtggctctggacttaaatattttatcaagagaaatgaaaacatatctgcacataaggcttcttcagagatgctcattgcatgtttatttgcaatggcaaaagaagaaaaaagggaaattacccaaacatccatcaataaatgaatgcataagtaagttgtatagtcactcaatgaaatgctatccagcaataaaaagaaatgaattgctgacaaggacatcagtgtgtatgtgtgtgtgtgtgtgtgtgtgcatatgcgtatgtgtataacatactcagcaagagaagttatccaccaaagagtccatgctttatggttctagttttatgaagctgacgaacaggagaaattggcctatggggatggaattcaggatagtgattgtctttcacccgctaagatgcctcttcagtttctacccaaagacttcatatatatttacctctaggctgtccacaaaatggagatgtgtgaatcatgcttttcatgccattgggaaaggacatcctgttcacagcagaggtgatacaggagcattaatcaccaaatgtttagtaaatattgatacccgggtgatttacactaatcgtcacaagaccgcaatctaccttttatataaatgcaataaaaaaatcttggttataaaagtacttgcttcctttgcattttttctgctgggggagaagcacagaatgcaaagagggagaagggaattttctaaggagatggcatttctatgcactttgactggggtactggttcatgtatatgtgtgtgttggcaaaacaccatggaactgtatacttaagatctgtgcagttcatgtaattacacatgaatgaccatgaaaagtccaatgaggcatatcctagtggtcaagcctggtcatatgtgcgcattcaacatacagaaaacttgtttggtttctgtagcaggaggtatgagctttctgcaaatacaaatggtatttgaaggaaggacagtcattcatgacacaggtctgctacagcattggattccgcatcctgcagcaaaagccaggttgggaccatggttgggatgagattccatgggaacaagccaggagtgaacaactgcagttagagtggaaaacgtgtgctggtttgtctgggactttttctgtgtgagcactcaaagtctcatgtcctgggaaaatcctctgttctaagccaactgggagagttggtcaccttctttccagccagagctctgtctaaagttacatctgatggagaaattgagggatcacactggaaaaagtgaacccagagatttactttgaagctcctctgggtatgaggtcagtgtgggataattgtcatggacgaagattcactagaagtctcacaagccctgccaccctaaatcacatcagaaaagaacccctatgcattttcttttcataccacccaacatcctaaaaccatcagcttagtgttttcactcccattccctataaactccatgtggtttgttcacatgtcaggtttattcgtcagtgtatctttagcacatgtaaatggctgtcacaaatgcttaaatgattcagtgaatgattgaatgattcaatgaatgatcccatccatcaaccgttgctccaggcttcttgtaaagaccaggatcctgacccatggacatttttgaggctttaagccacagcccttcgagcaagggctggaaggaagcctctttcatctttctctggggctatcacaaccagcatatgtgtatttaattagtcactgcctatttttatatgttacacaagctcagtttctccctctctgttctctttttctcaatagtggcaatgtagattttttaaagtttatttttcagtttcttcccttttcctgcagtctccctctagagatgacactgactttaaactttgacccactaagatgcctctttagtttctatccaacgacttcatatatatctatctctaggctatccacaaaatggagatgtgtgattcatgcttttcatgcctttgggaatggacatcttgttcatagcagaggtgatacaggagtattaattaccaatgcttagtaagtattgatacccaggtgatttacacaaatcatcacaagaccacaatcatcacaagactacagtctacctcttgtataaatgcaacccaaaaatcttgaattataaacttacttgcttccttggacttcagataaatctctagtatcctcaagagtctttgaatactttcctgtctccagcaaatctcgtgggaaggaaaaaaatagatatcactttgcaatttatgtttttaccagcatgcaattgagtagattcaattgactccaaatgttttgcacattctaatttctgtcccctattgtcctcccctgttgacttcaagttaatgcataatatgatatgggacatccctcataaattccgtatcatcagagtaatgtggctttgatgatgtactgcattttaaattagctctgtcacaaaaggacgatggggggcccaggaggttttttttttctttctaattttccttctgttcttgaagtgtgataagtctaattatagttggcagcaaacagaagtgtttcttcagctagtatggcttgtgagggttcttggattgctatgatatcttcagatttttatagtaggtgtcttagacccaacaagtcaagatggcttctaagtggaaaggttttaaaagattaaagagagattaacaatacaagaagttagtaacattgatctgtcatggccaagttcagtggtgcattcctgtggcttattttactcatgggaattaaataatgataacattttcagaatcttagaataatttggagaagaggatatgacatatctaaattatgtgtatacaaagtaatttttgtttcttctaatactctactagtctaaggggattccttcctatccattgtcttttctggggaaagaaaccaaatgtacagtcctacgtacggtaggaagaatagctatagctcctctcagctctggtataggaaacatgctctaatgaattttccttccagcgttccataccagtgtttctcaagcttttagtgagcacagggatctttccaggaatcttcctacaatgcatattctgtttcgtaggtctgggtggagcctgagattcggcacttctaataagcttccaggtgttgttcctgatgccggttcgtgcaccagaatatgaacagcaatattttatagggtgttaagcaacagaaatgtatttgtacgtggatgtctctgcaatagaattgcatccagaggagaaatgaaatagcttacaattatggatgaattgtgtaggtattcatatagaatagctaacataaatggagccatgcgtgtattatttaacactcacaacagtatagatagacacagtgcttatctccatgacagagttgaggggctataagcttacagatgtttagtgatgtgatcgagttgctgagctaacactcagtggagtttgaacccaggcagtatgatttcagagaccacgctgaagtatctgtactgctcatggactgttgccctgaaatgcagtttatttgtctgaagtgtaatgtctggagttttttgcatcttcatcattataaacctcttacaaatattaattgagttccttaggccattccttaaggttttatagcagataagagaagataatgtggttccaactgaagaccaccaaatagtgctcactggtagctgaaattcaggaaatgatttacatatccagcaggagtgattttctttatatatagaaaaatatatttaaattgagttaaatcattatctgtagtaattatagctgaatggaagaaccggcctaaagagcaagatttttttttttaataaaaaggatatcctaggaactctacagtgatttgcagattaattctatctttgtttatatttctactttcaaacttttttattcaggtaaaattcacataatataaaatacagatacataatataaaattatataaatataaaattatgtgaattgtaaactgtacaattcaaggacattagattcacaatgctgtgcaatgattacctccaataagcatgtggaaatatgctcaacaccattagtcattagagaaatgcaaatcaggccaggcatggaggctcatacctgtaatcccagtacttgggaggccaaggcaggaagagtccttgaacacaagagttttataccagcctgggcagcacagggagacctcatctctacagaaaataaaaataaattagctgagtgtggtggcacacatctgtggtcccagctacttgggtggctgaggtgggaggatcacttgagcctgtgaggccgaggctgcagtgagtggtgattgcgctactgcactctagcctgggcaacagagcaaatctgtatctcaaaacaaaaaagcaaaaaatgcatatgaaaatcatgaggagacatcatgccacacccactaggatgacaagtaataataatagtaataacagaaggtaacaaatgttgtccaggctgtggagaaactgaaattctcaaatattgctggttggattgcagaatggcacacctgctgtagaaaacggtttgggagttaaaccaaggtaaacacagaattctcactaacttttgacgactgaatgtgtttgcctttttccagctgttggttgttttttttcatggcttcttccagggcctctgtcttgtttgctaatatgcggttctttgtcctgtatccattcagtagccaatgtaaaatggtgccaaacttactattttagattgaagggattagctcctctttccagtgattttaccattgtctgttcttagctggtgccaggttggaaagggaagagttgttggctggtttgttggtgtttttacctccaggtactgtgtcattccaatgttatttttactgtctcatgtggagtgtcctatatgatttgaataaaagtcccactccattgctgtctctgcaaggctgactcctttgaccctggcagaaagaacagttgatgatatttggtgaaaaaaaaaaagaaaatttgcccatggtatgactgttcttctccttggcgggaaacttctacttgaatcattgtgcagtatgatggaggcacttataggtttaaaccctaattatgccacttggtagtgtgtataagcatgggcaggtccttcaatttccttgtgcctctgttttcccaaataaatcatggaatagtacttacagaaatggctaatgattaaataagataatgcaggaaagcatttagcgtagcatctggcacacagcagcactccacatcaacgctggctgttattgtattattatcatggttacttctgtcctagtttttactctattacatagtttgggtctatttgcacaatatacttctttaaaacacacacgtacagtcaggtgcagtggctcacacctataatcccagcacattgggaggctgaggcaggcagatcacctaaggtcgggagttcaagaccagcctgccctacatggtggaaccccatctctactaaaaatacaaaaattagccatgcctggtggccagcacctgtagtcccagctccacgggaggctgaggcaggagaattgcttgaacctgggaaatggaggttgcagtgagctgagatcgtgccactgcactccagcctaggcggcagactgaggctgcatctcaaaacacagacacacacacacacacacacacacacacacagactttagaattatctcattgtcttcctacaagctgtctttttgcttctgcatgaacttttaaaccttctccaccaaggcaaggtaactttaaatggttttccccacagatagccagccaatgaaaaaattaccaatgtcttaacagaaaggaactttgttactttcaggtatacacagcaaccctgcagttcaacagtctctgtcctgggtagggcctcacgtgacttgactttgatgaaatagagaagcaggctgccctctgtcagttgaagaacccatgtttttagcataatgacctgattctgtatgtggcttggggaatcctatttgtgaatctgaggtctatctttatgttaatgattcttcattactttaacattcttgaaagtaggttttggccttagaatttgtgcaattctccctcaattgttctttattcgtagatagccatcatataagctggctggctgtaaaaaaaaaaaactcaactcaggcctagcgtggtggctcacacttgtaatcccagcactttgggaggctgagctgggtgggttacaaggtcaggagatcgagactatcctggccaacatggtaaaaccccatctctactaaaaatacaaaaattagccaggtgtggtggcatgcgcatgtagtcctagctactcaggaggctgaggcaggaaaatcgcttgaacctgggaggccgaggttgcagtgagccgagattgcaccactgtactccagtctgggcaacagagcgagactctgtctcaaaaaaaaaaaaaaaaaaaaaaaaaaacctcaagtcagtctctgtacagacgtttcaagaatgcctaatctgtggtgtctgtgttgacaaattcttatacaatgctttaaacatattcagattttaaattttattaacttacctaattattcacttaaagtaactctttaaaaagactggcttatcttactctagctgtacttttttttgctagtgaaactaccagtggattactttatctcagattgtattcatcatatttctccattataaatccgttaaaatgtcgtttctctgacttcttggagttgaggtctgggattatctgctatcagaggaaattcctgccagaaccccctagacatttccacattgcaaagcagcacgaagagcaagcatgagtgaatcaagttcttatataaagagggatcctaggataatgctacttttagagatggaaaagctctaagatatttccaagtaaaagaaacctgtgtttcagagagggaaaataacctgagtgttcacagtgagttggtagtaggacacagatgagaactctttcattctatgcggtaatggctctaggtcctcctgtcttaggctctgaagggagacagactgtagtctctcctggaatagcccgggaaggaactttgacatgaagatattcaacctcccaatggtagaaataggtgactctggcattcattcattcatgtaacaagtatttatggagcacttacccaatgccagacactgttctaaacagaggttatggcagtgagcagcactggacagttccctgctcacatggagttggtcacagtgcagggatcagacagtgaataggtaagtcagtgatctgccgagaaagatgacaacagtgtcacatcagggtgacgtagtagtacctgagatagggcatagtgaatggaatattttttctaagcgcaatggaaagtcactgtagagttttaaatagaggagggataggatatgacttatgttttaaaaatctcagtgacacctaggtggaaatttaattgtaggaagagcaagaatatcaattctgggcaaatgctgtaggtcagagatgatggtagctgctaagatagtagctgtgggcaggagctaatgatagaggaaggatactggacataaatatgaggactagaccctagacttagtggaagaggtgagcgaaaaagacttacaaacaactttaatggttcagcttgagcatctgaacagattaacccaaagagtttacatcaggctctgtgcagcaggtagtgttcactgctttagtgttcattgatttacatctccccctttttttttttaattaaagagattaggtctcactctgtcacccttgctggagtgcagtagaatgatcatagctcactgcagcctcaaacctcccatctcagcctcccgagtagctgggactacaggtgtgcaccatcacacagagataacttttttttctttagagacaggctattgctatgttgcccagcctcgtctcaaactcctggcctcaagtgatcttcctgcgtctgcctctcaaagtgctgggattacaggtgtgagctactttgccccaccaacatctattttaaaaataatcttgagatctataagccattcctgaccagaggtcagatacttatctgtttcttttctctttcttgagtagcacctcacacagggctggattgtggggtgttctaaatgcaggggtgaggcaggtgtactggagggttttaccccatgtgtgctttcctctgagctcaacaactgcagctaagaaaggtgtctcagtggataatcgcatgatccactgccctgtgtgggaccatagtcttttttttttttttttttttttttgagcaggagtcttgctctgtcacccaggctggagtgcagtggccttttctcggctcactgcaagctccgcctcctgggttcacgccattctcctgcctcagcctggcaagtagctgggaccacaggcgcccgccaccatgcctggcggctaattttttgtatttttagtagagacggggtttcactgtgttagccaggatggtgttgatctcctgacctcgtgatctgcctgcctcggcccccagaagtgctgggattacaggtgtgaaccactgcgcccggccgggaccacagtcttaagacgctggctctgccttcctgggtgccacagttaccatcttttgtaagtctgtaaacttcattggcctggcattgacttcctctgggtacattagtggggaccacaccgtgctgagtcacagttagaaggggcgtctgtcttcacagtgcggcatcactcttatcctggatgccctactctttatcattcctcctcctctcactctccctccccagggccacactatcgtttggcagtaatcacatccaagccaattttgatcaatagttttgttcatttcaaatggaaataagctccgtgtttagcagataaggagagttacactcaaaatgtggcacatttgtaccccatcccttaggtggaacatggcaggattcttcaggagggaagaggatgcactaggcttaatgtttaacattctttggatggcgtctcctccatgccaccgttagctgtgagctcagcaactctgggaattggaacagttgcccctccttgagactctttactgcttgtgacttgacacaatggaagggcagatttccactgagtctctactcggtggcttctcaaagacttccactgagactctgcgcacctttattgggttggcctgattcaagcctgcttgcagaggcattttctttcttgactctgacatgtggctcagtttgggaacccacttgttccctctctgagatctttccgcctgcattttgggctttgcgctttttataccttactgtggctccaagaaggcctttactgctgctttgggttgttttgctgttgttttgttttccacttagatgccctcccggtctggaagatttttgcctggttggaaagaggcaccttggcaggggaggagagaggagaacctacgggattatgtggaagtctttccccgaggttcacaccgaagcatcttagaagggttagaatctctttctaaacacttagtaagacacgttttctgaagtgtcactacagagtctaccctggcagaagaagccacatctttccagatacacctgcatgaaaaaaaccaaaagaagaagaaggggaacccaggaaggataacacgagatagaaaggccatcttggcatttggggaataaaaagtataagggcattttgcttttaaatctaagaaaggtataaagaggagaaatgttgaaaagcaccttgtctctggtttcttatgtttgccaaatattagcaagtacctgagatgctcttctaggtgtctgtcttgtgtgccatctggcccatgagctgtttgagatgggagagtatcttatctgtctttgcatccccagcaccagtagattgaaccgagtaacttccacggtgctcatcccaggggcaacaggccctgttgaacaggcattcactttatggtacttggaccacacttggtggggaaagaggtacttcttggccaccacaggtgtggttgcaagaaattagcctcataactttgaatggattcaaatcaagcatatctagagcatagcagaagtgtcatcaatggtggaaaaccaccttttcccctcttgcaatctgaggaacacctggcaaacatttccacctaaattagttcttggcttcactggtccagcttagttgaacggatgttctgggaggcactgtaatttcctgttttgtaggatctcataggaaatttttcatgtgaattcaactctgatctcttcattattgattatatgcaactcttggtattgttttctcttagcattcgatcgtattgattcaaatgctgttttcattaacttcatgggtgcatataagagactggatggatttgaggatcataacttcagtttcgctgactgcgtatccaccccatactaactgtgggactctatataagtttgtcttttcaaacctcagtttccttgtttgtcacatggagatgataacactcctctctcaaagatattgtgaaaattgaatgatgctgagcacgtagattagtcagcgaagggtacccacgaccagtgatattatgatggggcttgatccaagttggaatccgttacctttgcccagtaccattgtttgcacatgtctgctttttatgattattagttaagagtttattttcttacagaggattaggcaaagggtgattaagcataggttattcagtttaaactaataaatcttttttttataggctgaccatctgtcagggaagtggcagaaggcattccaataggactgagttgaattaaattgggagataaaagtaataacaatggctttcctccaaatgatatctaaaaatccgcgtactttttccctagcgccatttttgccactttaatccaaactacccgcatctggactacaagcctcctaactggtctccctcttttccttgccttcagatccaatctttttgtaataggttgatccttttaatattcaaaacaggttacctttccccatcttttccccctcctggccttcaataaaaacccaaacgtaaaataaaaacggataacttggcctgtaatcccagtttcatctggcctcttgcctttctctccaacccctctctctctttctctccaggccatcattcttagggctttcaacaccctgtcctccatgtcatttctgttgcagccttggagacgtgtgcctctccttctgccagaggatgcctcctgtcgtggtcacttggcaaggtccactcttatgtcacatctcggtttagactctgcagaaacgcaattcccaacccctccgataactactctccaccccaaagatctcactgtactaattgcagatttattgatgtggtgcttgttaagttactcaccatggtgtccccagaacccatgttagtggcattgctgaataaaaggtgcttcaaactacgaagggcttataatgtgcattttcccacttgaggctgatggcatctttgtgaggaaggcatatagtggacagcctcaaagctataggagagtaatctaaagcccactctggtgaaaacttggaaatgttaagaatagggtttgaatcccaggtgtctgatgccaggcctaaagctctttcaacttgagtactgcacgtgctagatagtctctgtgtactgttgtctaaaacagggatttgcaatcttttggcttctctgggccactttggaagaagaagaattgtcttgggctctaaataaaatacacaaacactaacaatagctgatgaactattaaaaaatcacagaaaaagattataatgttttaagaaagtttatgaatttgtgttaggctacattcaaaggcatcttgggccacatgtgacctgtgggccatgggttggacaagcttggcctaaaaacgtattgtttgtctaggtagggtcatgattcatgaagctattgagcaagcattttcatggcactcatatcgcctgtcagactttgtcccaagtgcattgtaagctcttccttgcctaatctgcacaaagaccttgtaagatagggtattagttagtatcacaaactgggtggctaaaaatgacagacatttattgcctcaccattctgggccaaggagcccaaagtcagggtgtcagctgggtcatgctccctctgaaacctgtaagggaattctgccttgcttcttttgactcctggagtaatggcactctctggcatattgtgattggcagctccatagcacctctgtctgcttctactttcatgtggcattctccctggctcttttcacatcatcttccttctgtctgtgtctgtctttgtgtccacatttctccttcttataaggacacatccaccttactgacctcatcttaatttgattcctttctgtagattctttttgcaaacaaggtcacattaccaggtacctgaggttaagggtttatctgtctttttgaggggacatgatttaacccctagcggatacatatcctattccattttcacaaatggggtcataggctccataataggaccaaagattctgagcttgccattggcaatgacaagttcaaacacagatcatgcctccgaagtccatgcttggtttgtggaccacacagttttcaaacccttaaatcaaagtgtggtccgtagattcaattaactttcaaaaagtgaagtagggctctttttcttgactcaaagtgagcttagccaggagaggcagatttttaaagtgcctgagcatgcgtattattactagctttgcctgctgaagcagaaatgtgttcttcccctgcccaactctattgcattgagaataaagtatctggcgctcttttactaagatgcaagccattcttcattttaattggtggggaaacgtttattataaaatgctcttcccccagaatagttccctaaagtggcatatagtatctgttttttcttcctcctctttcttcctgggaatcattaccagccccggctggtgatttataatcacattcccaacaaatttcactgttgttaatgactacttattttctatacaaatgatttttgctctccttcctgaggataattaactaagaaactggtaataaattactgataatgatcagtttgtcagagatgattgtcgaatggtgccatcttccatagtaactagataaagtatctttaattgctgataacagaacagacaaattgtggttcttttttttgttgttgttgttattgagatattcatgaaatcttcctcctggaagtcaggcagaataacaccttttttctctgtctcctgagggaggggaaaaggaagaaacagtcatgacttacagacttctagaaatatagtaaatgtgatcgctttttgaggtttgtaataagatagctgatctttgtaaagcagagatcagagaaaatctactctgggatacatttcgtttagaccaggggtccttcctggtcatgtgtgatttttttttttctctcaaaatgtcatctttcctatttgcatctaaaccttggccttcaaatgtgacttctttgaactctggaaaggaatagtatttaattcacagtgtttctcacggttaggatgctgactaaaccccagactgcaagcgaggctgtgaaagacccttagctgggaaacgtagagaagacctatgacaatggatgtacactgaaagtcctttaatcatagcccttattatctattttcttattgacaagctcagactattcatcgtagtaagaattgcaggacctactattaacttcagttctttgaaggatacacatatttcacatactgaaggctggtttacatttaatccagttaaatgtgtcactttactgacatgccttgaatattgtgagtcttgggtattgccatcctttatttataatctccatcagtcttgtaaacttttgttttgttttgctagatgtcagcaactgtcaaaaaagctatagtgtccgagatcatttgaatcattttggcagtttagaaaacagagtggtgcttaaaagaatagaaatgagaattccaaaggcggaggtctcaatatcaaattgttggggggtatgtagtgtctctttgggctttttaggttttgttatgagaagggaaggcacaaccagcatagaattagaatgtacaaggttacaaggatgtttacacactgatttcttcagaatttcttcagttccaagtgaaaaaagaaatttttttaagtttcaagtaagctctccaggtagtcacagggatgacaaagatacaaataaaacacgaataaactttcaaataagctgaaggaaaaaagaattaaattatagaactgggaagcacacggggtagacttcaggcgcggttgagtcagaagatttcacgatgtcgcaagaactctgattctctcagatctgcttcctctcttggtaccaggcatcgttaggtttcttccacacgtagtcttcgagaagttagcatccttggctgggtgcagtggcttgcgcctgtaatcctagcactttgggaggccaaggtgtgtggatcacttgaggtcaggagttggagaccagcctggccaacatggcgaaaccccatctctactaaaagtacaaaaattagctgggcatggtggcggcgcctgtaatcccaggtactcaagtggctgaggcaggagattcacttgaaccctggaggtggaggttgcagtgagctgagatcatgccactgcactccagcctgggcaacagagcaagactctgtccccaaaaaagggaggagggaagaggaggcggggaggaaagagaaggaagaggggaggaaggaggaggaggagggaaggaggagggggggggaaggaggaggaggggaggtgggaggaggaggaggggaaaagggaggaggaggggaggagggaggaagaggggaggagggagtaggaggagggaggaggaggagaggagggaggaggaggagggaggagtaggagggaggagggaaaaggaggaggggaggagggaggaggaggggtggaggaggaggggaggagggaaggaggaggaggggaaaaaggaggggacgagggagggaggaggaggagggaggaggaggaggaggggaggagggaggaggaggagggaggagggaaaaggaagtggggaggagggaggaggaggggaagaggaagaggaggaggggaagaggaggaggagaggagggaggaggaggaggggaggaggaggatgggaggaggggaggaagggaggaaggaggaggaaagcattcacttgaagatactgcagcaaattgtagggaaggctttgattggctaatttgagtcatgtgcctacttctgagcaaatccctagacgatagggctggagtcttctgagtggctggtctccagcctcatgacctacagagtaaggtaagaatgaggggaatacagctctgactaaatgaaataggcagatgtagaatggggcaagggtggttttccaaagtaaaagattttaggtcgatcctaaaacaaaaggaaacacaagcacacagtagtagagagaccttctcatggacccttacgtactttgactactacccagctcagtttgctctgcttaccagttcacagatgctttctttggctggctttgcttttacagtggattttctgacactttttgaacattgtctaagaggggtgacagtttcaaatccacccaagaagtggacaccattccatactttatgactgaatctaaaatgctgttcacttgtgcctccagctgaaacatttttctcttcgctctgtttggagtccctctccctcccctctctctatctctcactgttcttcatggtacacttcttttttgggggttggcggggggacagagtcttactctgtcgcccagactggagtgtagtggcgtgatctcagctcactgcaacctccgcctcccaggttcaacaattctcttgcctcaaccttccaaacagctgggtctacaggtgtgtgccaccaggcccagctaatttttatattttcattacagacaagccttcaccatgttgaccaggctggtctccagttcatggcctccaattcgtggcctcaagtgatctgttcacctaggcctcccaaagtgctgggattataggcgtctgccaccatgcccacctaattttcgtgttttcagtagagacggggtttcatgatgttgaccaagctggtgttggactcctgacctcaagtgatgcacctgcctcagcctcccaaagtgctgggattacaggcatgtgccactgtgcccagccttcatggcacacttctaattctttccttcttcatgagctttttccagcatgagccaaaatcaatttcttcttctgcatccccactgaaattgttatacttcataaaatactttgtacctacttcagttttagtttctaagaatttatgtctttcttgagaaacagagtactgttttgtgattcttgcttcggcacttcacattgattagaacaatgcctggccctaaatagatatttaattctggtgagttcttcccagacaagtctaaaggagggtgtgaatactcgggcaactcaagttatcatcatttgggtctggctgtgttcacttatgggaatacaagtgtgggcattaatagtttggaggagcacaggagaacagtgagctgactgcagaggaggagatggattttgtttctcttgggggccccaggaattttgcctcctggacccattttatgtgataatggctctgcgttttgggttacagagctcaactctctgagattaacacaaagcaaagggcttccctgtatgtctatatagatctagcccaactcaggataagcagcttctcactaattcagcaaatgttgtgtagcatcagctatgtgttggacacatgtaatgagtaaatacatatgtgactgctgccctcatggttggagctttgctactgggatggtctagtctggggctgcctcttattaccagcggcatctcagactagttattcaacaactgtgtgcctaaattttcctgcctgtaaaatgggaataaagagatacttcacagagctattgtgaaaactaaaggatcgtataattttacgctgtctaacataagtaaccatttagcaaatgacagctattacttgtagctattggctcatgaagtctgcaggctggtagcacacacattcatcaagtgataatatttaaaatgtaaattatgacataattgatctgaaggggaggtgcttggtgttaagaacacttaaaataaggaattctgtaaaagcttgcctgggaatgtgtagctaatatagctacagataagactattaaaagattagagccaaaatgaataatgtatccatgtctgatgattgataataaggcagcagttgtggacagctgagatggtccttttccaaccgggacgtcagagctactgtgattatcatgccaattacatctcacattctgccaaggtggttcttctctctcagtgcgttggtcatttcagagtgggaaaagccttcagctcagtgtccttcaggatccagtctactctttaaatttttgagagttatttggatttcagaaggatttgcctctcatcttctagtcatatcccattaccagtcaattcagaacatctattagttcagcaggagaggaaaggatgaatttccatgcctcccacctttgcttggtaacaggttatgcttttagaaatcacttcatgacctactgcttcctgctgggacaataatgttcttgtgtgtggctaagctatgcccacatttttaaaagttggaacacatctagtaaatatacatacctttgaaagtcctcatttaagctgaattagaccagtgaatagagtaataatgaaagtatttgaaggagggcaaccccttttctttaaaaggaaagagaataactaatatcaggaaaccaatcataccagtgaatcagagcccagttttggggactgaaagactcagggtgaaattgctgtgactccttgggctagtctctgtagttctcagaaactcagtaatgtcatctgtaaaatggaataataatgcccaattcatgtgtttgtagtgaagattgaaggagatactacctgcaaagtattcagatgtttgcctggtctatggtaattgccgaataaatgttacctgttatcccagtgttgtgtgcattgatggcaatgataaacaacaatacttgaggaattttgaggtttgattcatcattcttttaccttctgaaatttggcatccttggaaaatggaaaaagaaacaaaatttgtatattccttttgttgcagaaatgggtaattatgtgatatacacatacatatgtgtgtacattttataccaaaaattatatagaaaatgtacacacatataaatacacatacaattatatgtggtatgtatgaatgtattatgtgtaagatatatattataaatatataatatagagtatgtctggcagtatattctgttttgtgttatacataatataacaaaatgtatgttattagattacatagatttctggtatctatgttacaatcttttctaattaaaaattttttaaaaagtatctaaagaaaaagcatcagctgccccctgcaagttctctgaggactggcttttattattatttgttttgacacttcagtggcagcaacttccagttacagccagagtctcagtatgtaatcccgtggaaacgtccctaggtaacaggatgtgcccactggtcatggaagtcagttctgttaaacagggaggattttatctgtctgaataaatatttctgcagctcttctcacgctatggatttgagatgtgaacaggcaagaagggtcatcactataaatcaatagtttccatgaagttgccaccgatttagagcagacagcagcttttgggttgaaataaagatcgtgaagtgcagacgtaggcagcaaatgctggggataatgtgtggagtgtataggactattcagtgaacgtctatcaaggatggatagaaaggagaatgctctttttgagataagttagctaatcgataattggcaagggaaacatggaaatacttggtggaaattgatgccacctacaccaatccacacaagtacatgcacctcaaacctaccacccaatatccaattgtcaccaagtctatctaatcacatcttactcacctttgtgctactcacaagttgccatggaggtgagagtagacgcggtggggatggacgatctctctcaggacaggatgatagaaaaggaagaaaagaagatttgttttaaggatgggccacttctatgaatggttggaagaatggaggagagaaggacagcaaaaggtgataggagaggtggcaggtgaaccagggagggacagtttcctaaagggtagaaggaatttcatggagacagcaacccgtggatggtgccaaatctcatcatgaattgacaagagtccttggacttaccttcctgggagtcggttttatagattttgcacaactttgtacctaaatcattcccaacaattaagtgtgagttcccagagggcaggtaccagggtttattcattttggaaaccccagggtctggcagacatattagggatgaataaatgtgttttgaaagtatgaatgaatgaatgaatggataaataagtgctggccttaacataacagtttaatgtctgtgcaaaatgaaaataacaaagtgttaaagaagtaattagaaattggcaaaatggggcacaagaaaccatcttacatatgtggtagctctaggggtttaagaaataacatccctttatttccctactgagtaagaaccaatggagaaagaagctgggcaggaaggcaaaaggaaataaacaatcttctttcatttagcctaatgtttttaaggttctgctcccatccccgtgaagtgttgggaataggcaagtctatagagatgcgaagtagattagtaattgcctagggatggagcgtggactgcaaatgtgcacgaggcttccctcccggggtaataaaaaaaaagttctaaaattaaattgtggtgataatggcaccactgtgtgaatatactgaaagctactgaatcgtgtaccctgaattagtgaattttatggtttatgaactctatctcaataaaactggttttctaaacaagaaaacaaaaaggtttccgcttattaaataaacccaaatttaaaggtatggccgaatgggcttgcttgtactctcctgatttgtgcagacttgtccatcagtcactgaaagtgtggaaatcttcagtccatcctctggcctccagtagacacagacacacacacacacacacacacacacacacacagacacacacacaaaggtacacagacacacacacagacacacacagataaacacacagacacacagacacacacagactctccctctcactctcgctctgtcgctctctctctcactcatgagtgctgtagctgagaaagaagcccagagtatgctttttctgccagctggagaatttgacctagggctaagtgactagcctgagtacatccaggttcttttcccaaaggaaccaatttgataaaccattccttcttagcatggaggaatgagaagctggggagaggcccagaatattatgctagaaaaattcttgcacatggaaacacagggaaggaggataagggggtgcctccattcttatgtctcatactttttatgtccagtagtgtctgcatttctatcataaatactcttttaaaatcaggagtcctagaccagagaatgttccctgcattccatatcaggtaagatccaagtatacaaagcctgtctctttaattaatttcctttcacccaaatcctatccattgggcatgatcaatagttataaaacccatcatttccagtgttatggtaatgcgaaagcttgatgaaatatgggtttgaccacacagtagtcagaagtctagttcttcatgtattaaaggataccattccagctgggcacggtggctcacacctgtaatcccagcactttgggaggcggagacaggcggatcacgaggtcaggagatcgagaccatcctggctaacacagtgaaaccccgtctctactaaaaaatacaaaaaattagccgggcgtggtggcgggcgcctgtagtcccagctactcaggaggctgaggcaggagaatggcgtgaatccgggaggcagagcttgccgtgagccaagatcatgccactgcactccagcctgggcgacagagctagactctgtctgaaaaaaaaacaaaacaaaacaaacaaacaaaaaagatatcattccatctattgtgtgtttatctctgtttagttacgcacttgtgtgtagttgcattgacatttaggcagacttgcctattctagacattttcttactatgaaatgcacgtgactagcacagtgtctggttattagtcaattctcattaaatattggctgcataagggatggggatcataggcattcggaatataggaggatcgactctattctggcattattggatgaaaggggttctttattggaaccgactacatttttttgtccttggtaatattagtcttactttgaggcactagggcattttgagactagtgaaactcccatggccttcagaattataatttaaatcttctattcctccagaactcaggacatttaatttatcatgattcataaaagaccagtaataaaccctgtctttatttaaacgtgggcggcattgacttcccgctgtaggaattgggtgttctttatcaacgtctctctatctacttatcacggatcctgcatgtgtacaaaaaggcatctttgtcagtcagggggagattttattaactaaaggttcatttgttcttcaagtgacactatctctttggaattaccagatgttgttcaaactgtgccggctctccttttattctgatgatggcaaatgttgaatgtggtgaataaatattgggcactgtcctcggtcatctcaaataaatgtgataaaatgaaaacatgtcgcctctgaggtctcatttgttcccaggaagtccacggcgcattaaggcccacagacaatgaaagacgaatcagccattcactgggtattccattatgagacattcttgtcattttccagattgaattttagattaatatatagcctgagataagatggcatgtattgagatgatgccacagtgccatggccaaattgttttgttataatcacatgatatagagaattaaatgtattgtgatgatctgccgtagaaatttgcatttaaaagaaaaagtggcagaaaataaattaatagtaaatttcttatgacttagacctgaagaggctcatgtgactgcaggtgttatgttttgacccttctttgctaccatggcaagactggtgactgtcttctgaggagaagtagaggagatttcacttaactggatgatcacagagttgaggtttttgtcatccattgctgagccatgtattaaatattcattatatatataaatatacacacatacgtatatatacatacatatatatacatatatatacatatatatacatatatacacatatatatacatatatatacatatatacatacatatatacatatatacatacatatacatatatacatacatatatacatatatacatacatatacatatatacatatatacacacatatatatacacatatatatatatacatatatataataaaaaagtgggaaagaacaatctggcaaaacagacattttggaatcaccatgcccttctttttcgggtgatgcatgacacccatgaattaagatttaaaagaggatataaagcagaatcttgctttcacagtggggagaagaacttatgaatgctttgaaaataattgctaagaattatactcaaatcgtattacatcaagaaatggagatgtgaaccagactgggacagtacgatttcacaataacagccacaatttctctaatttattacattgtcatctgtcttgtgatttaacatcctttttcacagtctgcagtaatatatggaattactaaaagttggcggctgtctgacgttcagaaatgttgaaagaaatgaagtatttctgtgggtgttgccgaagtcctgttgaaagggtagttaagtatcgctgattaattcccattctatctctgatgaaatggagaaggggaaaatgctcctttcgaccaagtatctcattgcaaactgcagcccagaagttgcataagcattttccttcttcggtataaattgatttgctgtgaaaaatttcagacggttccatgtcaaggcaatgttttatttcgtggtgcaggacaaatgtagagctaagtagatttgtaggctaatttattggtcattttaatattgtgtattctcccctttggtgtgttaagtacttccccaatgcttcttcagcgatatactgcttatggcatgcccaactcatcttaattaaattctttcttgccacaacctcatttttgctcatgggatacattgctgtcactgtgaaacattttctaggaaaattgagatctatttttcataaattaggctcttttttaaggctctctatgttagtcacttaaattaatattaagttattatgtactccaaatcagtgctttataagtctttcaaaaaatatcggttgcccagaagcctgggaggagtgcgatagagctggagcgtaacgtgcaggtgtgttgggttagtgatgggtgaaatgactctatgtggctcgtccccacctcccattgttagaggcaatcagagaaagcattttgcaaatcgagaataagaaagaggccttacagagcatgttgccgctgctgctgctgctcctggcacccctgctgagatcagctcagtgcagtcttctcttttagaaagaggagaagagtttatcctgaactgtgcattttttagttttagaaaacatggatttcctgacaggaaatgggaagctttttgaactgtatgacttgagtcatctgtcacgttggaaggacattggaaaaatcagcctcctgatgtagaactttgtcatgactttcaaaagtttccctacaaattgacacatggggcttttggcttttgtcctggggatatggcagttgtcatgtcaatgtctagaaaaattgtcccttataaccaaagatggctaattaaacaaaacaaaacgcccaaacaggtgcttattcattccctccgtccgtcccactctcacacaggtaaagaacgtgtttcagctaagatgattaacatgcttcccccacccccaccccctgacttaaatcctcaagcccactagctcttgccttaccgccatgctgacttttacttccccaaacatacccagctcctcctgagtgggacgttgtgagcattctgctccctctgtctggaatgtgcccctcctgcctcaccacaacctttgcagagttagcttttacttctcctttcactctctactcaaaaatgccgcttcctccaggaaagtctttcctggaattcccacccctaatgcaactccaactccctaggatagatgagaatatgtctgtatttggtctcatagttccttgtacttttcctccagtttatatatacatatgtgtgtgtgtgtgtgtgtgtgtatatacatatgtgtatatatatgactgtttgtgtgtacatatatatatacacaaacacacactcacatagtcacatgtcatgtcaatgtctagataagttgtgccttataaccaaaagtgtctaattagacaaaacacccaaacaggggtttattcattctctcagtctatttctctcacatatatttagaacatgtatatgtatgtgtgtatatgtgtgtatatatacacacacacgtatgtatacatatatagatatagatccacacacagctgctagtaccactgctgagatcatctcagcaccatcttctcttttagaaagaggagaagagtttatcctgaactatgcattttttgagaaaacatgaatttcatgttgaggaaatgggaagctttttgaactgtatgacttgagtcacctgtcgtgttggaaggacattggaaaataggacgtgtgggtgtatgtgtatatatatacatacatacatgtatacacacacacatatatgtgaatatatacccacacacacaaataagtacataggtatatatctgtgtatatatatccctctataatctgtgtgtgtctatatatctatatctctttatatccatatattgaacacctactatgtgccaggcgctcttcctgcatttggaacttgttggtgtaaagacgacaaactgaagttgttccctgaagctcccttatctgcctaaagtctggacccactaaaaaagaaaacaagaacctctggttccttccctgagttctcattaattgaactcatattgcaggaagaaagactgatgttttccaacccacatgaacagacttttgtcacaggccattgttcttcaagcccattgagttcccgtaaaaatcacttactacctatgctaaaatcatccacactttcccatttccctttcccctaagaagaaggatatataaccatctgtatcacattgtgcggtggggtaatcactctgttattctgccccatgcatggtaatcaattcgtttgccatttatcaaaaaaaaaaaaaaaaaaaagtcaagccctcatgaagtcaatattctagttggggggaaaaacaatgaaaagtgtgcgtgatgcctgagcaaattgtgttagaacatgagcagtgctatggaaaaaagaaaaccaaaacagaaaaggatgaggagggcaggagagtgggggtggaagaatccattgcaattttacatgaggaggagagggccagtgtgggccttactgtgaaggtgacattttggcataaagccagctgcatggatttggaagagcattccaggcagtgaaaacagtcaaagcaaaagatctaaggcttgagagtagccgtctgttcaagagacaatagaagggccagagggagtggagcggaaaatagcagggaatgagttgagggaagaagcaaggtgaggaggaggtgcaaaccacttaggacttgtaggcattcagggcctttggattttacttgagtaaaatagggtcttgacttacatttcaaatgaataatttgaacttctgcattgaaaattgattatgagggcgcttaatgcagtttatagctgtgtacttgtgtgattatgtggttgatgtctgtctctctcatagactgtaggccctaagagggctggagtactgtctgacttgctcttcatggaatctccaagatcaagcctagtgcttggcatgttgctgtccaataaatatttaatgtgaaaggataaaatgaatgcaggccacatcaagatgatgctagttggcattcatccctcagaggcatgtgctgtagatagtcaatgtgcaaatttcaacttgtatccatccacttaaagacaacttcaaacgcaccctccaaccacaggcttaagttgaattatctgcttaattgttgctatgtgcagctgtttttcattagtgctgttttaatttgcagtctatgaactttgatatttgtaacaaaaagtaattggatactagtctggaaggcttccctccttaaaatgaatatgcttcacgcccaagcaaatgactggaaaggttccctgctgtctactagggaaaagattcacgggggcaggggctgtccacagcagaccagaatgttacagtctgctgggtaaatgttccatggtttcagaattaatatgcatgcattccgtaatacatatttacctggtagtctgtaaccattcagtagaactgttacagtctagtaagtaaataacatgtttttcaaaattagaacgtgtaccaaatatgtatttacccaataggctgtaacagttctgaggaaaccttccctgttgttagtctatcaggctgacttatggatatgggtttaatgttgttttgaatatgaacacagtataaaggaagatgtgtgatttttagaagggcgaggggttgtcatgtagaacaaaccaattttaggaggaaaattcaattcagttgcagaatctgttcctgctattcttttcctttcttttattttatctttttgttttttcttttatgctagttgctggaagattgctaatgacaccaggatgaatttttaaatactgtaatttaattattggtaacataatatggctttataagtgattagtggacagatttctgaacatgtgtaggggccagttttttagttgctaacctcatggccttggaggaatccacaagttggattctggtgaatgatttaatgacggtattggcagcactttgcctaatgagtatgtatcactctggcctaggtaagtcaagctaaagctaaccacattcacatcatccacctagatctgttatacaggaacaaactgtgtagagatcattatgaggccatgttggtgctttaaggcatggagttttcagcgggatattactcatttccatcattactgatgttcagctgcatttctactgatgtcggctgcatgggtagagaattagactccatagttcaagatagttcatgggtaagtaacattgtagtcaagagtttgtggctctggaatcagatgacttgggtgccagccctctgaacttgtatcagtgatttaaccactttaagacctgattaccttatctgtacaattagagattgccttatctgcacactaattgtacagaacagtcattgtacagataaggcaacactagtattcactttataacattcttgtgagtgaaatagtatccataaactgtgtatcactcttcagagcacatattgaatatttaataggcatcatcaacttttgtctatgatcactgtggaaattcagctgtgctggcatacaggaggtatatgtagcaggattagcaagggtgactcagtccaggtttccaagtatttagtttggaagtaaatgaagacacgatgtgtgtaattggatatttcactaataggttataagtggttgtgcaagtttctaaacatcttgcatgtactaataaatacttttagttgacaaatgagaaagcagccatgaatctgagtctcttacttggaaccaggtgaaacagtgatttatgaaatgccctttaaaactccttggaggttcacattctgcacaagttgctttttttctttctaattgagaaagctgctatattttgagtctgtgtaagcaactgcaggccttgattcttgattcttttctttctttctttctttctttctttctttctttctttctttctttcttttttttttttttttttgcatagttgttactgtttccttgggcagagagccataggatgagtcccacagccctttcctgggtatgtccttctgtgcaatgtaccttccatgaagcttaccagcatgttttatcatgtgttcaatgtcatttgcacaattagactcagatgctgcaggggcagggggccatggagtatactcacttcttccaagtgctgtttccccaggcccaagtgcaatgcctggtgcaaaatgaatactcaggtggttcctgtgttgtcgtcctttgtgactctgtctctctgaattagttctagtccatggcactgcgtgacttccaagacaattttagcatcctgtgcaacacgcatgagatttagaagcattgtctgttgacattattctttatgaacatttactgagagcttacaatgggccaggcactattctaagcatttcacatcaatatttcataggaatccatttaagtccatcttattattaccctcatttatcagatgagaaactgggatcccccctagattggatgtgtataagttattgagatgtaagtcaaaaaatttggtgcatccctagagcccagagtcccttacatctactctaccttgtctcccaaggaaaatactatggtcaggagttgggtaagccgataaaaagatggctgggtgtggtggctcacgcctgtacttccagcactttgcgaggccaaggtaggcagattgtttgagctcaggggttcacgaccgttatcagcaacgtggcaaaagctcatctctacaaaaatacaaaaaaagtagccaagcatggtggcacacactggtagtagggcacacacatcagtagggcttgggaggtggaggttgcagtgagctgagactgagccactgcaatccagtctaggagacacagtgggatcctgtctccaaaaaaaaaatatatatatatgtgtgtgtgtgtgtgtatgtatgtatatgtatgtgtgtgtgtgtatatgtgcgtatatgtgtgtgtgtgtatatatatatatcccattaggtctgcctgccacagtggggatcattcttcaacatgagatttggaggggacagacatgtaaactacagcacccatgttgtttctgcttcttcccagcaagctatttctagccacccttcacctccaccaaccttaacctcacaatcacttctggatgttcttgtagcctacactgtggattgttctaggctctttaattttctgttttccacgaaagtctgtaagcttgatgaggataaaagccatgattgccttgcttaccctcactgtgaatgaatgaatggagtggtgcagaaactcaagagcatcatgtacatatggaacatgctctatggtttttaatgaaaatatgtggcagtattggctgggctgcagtgcatacagtggagtattattcagctataaaaagaaggaaatactgtgttcgtaaaaacatggtgtgaacccaggagacagagcttgcagtgagccgagatcgtgccactacactccagcctgggcaacagagtgagactctgtctcaaaaacaaacaaaaacaaacaaaaataaacaaacaaacacatgggtaaacctgggggacaccgtgctaagtgagataagccaggcacagaatgacaaataccgcatgatctcactgatatatggaatctaaaaagctgaactcttggaagcagagagtagaaaggtggttggcaaggtttgggggtgggggaaatggagagctgttggtcaaaacacacaaatttcagtaaaaagatgaacaggttctgaggatcttgttccccagtgtgggtggtgatggatgtgttaatttatttgattgcggtaatcattacacaaggcatatataaatcatcacattgtacaccttgaatctgttcagtccttatttaaaaattttttaaaattaaagcatttgcggctgggcacggtggctcatgtctgtaatcccagcactttgagaggctaaggtgggaggatcacttgaggtcaggagttggagatcagcttggccaacatggtgaaaccccatttgtactaaaaatacaaaaattagctggatgtgctggcatgcacttgtaatcctggggagactaaacaagaattgcttgaacccaggagacagaggttgtagtgagcagagattgcatcactgcactccagcctgggtggggagactctgtctccaaaaaaaaaaaaaaaaaagcatttgcaacagggaaggtaaactacagtgataacaaaatactactcattgtagaaaagacaaagtacaaatagccataggcccccaaatgtgaaatgactttttcttttcttttctttttttttgtctgagacagagtctcactctgttgcccaggctggagctcagtggcgcgatcttggctcactgcaacctccatctcccagattcaagctgattctcctgcctcagcctcccaagtagctggaactacaggcgcccgccaccatgcctggctaattttttgtatttttagtagagatggggtttcaccatgttagccaggatggtctcgatctcctgacctcgtgatccacctgcttcggcttcccaaagtgctcggattacaggtgtgagtcactgcgcccagctcccagattcaagccgattctcctgcctcagcctcccaagtagctggaactacaggagcctgctaccacgcctggctatttttttgtatttttagtagagacgggggtttcaccatgttagccaggatggtctcgatctcctgacctcgtgatccgcccgctttggctttccaaagtgctgggattacaggtgtgagtcactgcacccagctcactttttctttaatttttgctataagctcacctgatgaaaaaaagagctggaaggattagcagctatgtgaggctatcaatcagggtaagacaggctatgctgtagtaacacataacccccaatatccatggcttaaaagaaccaatgtgctttgtttttgtttttgtttttttcctcacatatttctctctgttcatcctgcactggctgggagtgctactctatttgttcttcatgcagggtcacaggttacacctcttctgcgattaccaggacagagaacaaacagagttaattgcacactgttccttcaaggtgttatcccaaagtaatgtgtgtcatcactgttcaaatttattagctaaaacaagacattcagctatgcctaagtccaagtaggcaaggaggtacaatcacctccgttgttttgaaggagaaacataattttttggtgaaaagcaactgagatccaccacggtgagaaaaagccacaggccagtctcacagcatcatggcgaacagctatgcctaattgcacctcgattctaggtgtgatcctgtcaaaagcagtacctttaagatgtgtagttatagtattgtcattctaaaatatgtaacttttaggaattttgtggctagacgtagggacctccatttgattttttttttcttctcttcttagtgagcctagtttgaaatgttggctttcttaatctacagagactttgtcattaatgtgtaatgaatatctggtttcaaaccataggctgcttatcccttgactatttgtcgagacctttgtttgccgaaatactgctttatttcatttcttattatctttagaaggtattactgataggtattcattttgacccctttacgcacactcctcaagtctgtcttctccacaggctaaatcagtattccatccacttttcatctttactgttcctggcactctcatctatatgagaaacaggatctgtgtttgacaagcatgcttaccctttgcttactgttttaataaaaatttctatcagcgtttttatctgcagtagcagtcgagacactgtttgatattgagatgctagatttcatggactttgaaatattttccccatatcttttttggcaagtctttgaacatagaccacaaaaaattgacatgttggagatgaatttacagactctaagttaactaatgactacctgtcccagcttaaattgtgttctaggattgaaacattatattacacagtcaaatcgttgaaattaatggtcagactcttccataactgagttagtttcccatgagactgatactctattaaatgagcaggctgtccagatttctctgcatcgcctttggtttggggataatgttgacccagtcttggcagtttcaaagcagtaccaagcagtcagactattttaaatggggaatgatgaatagcagcttcctaatctccaaatttcattcagatacggtatcttatttcatcccctttatcctgtgaggcaaattattattgtcctgaacacagagagatggggaaactgaggcatggatgttactctgtgtgctgaagattatacaactactgagtagctcaggttcgtttggtctttctgtccctagatagcctcttggctggcagttctcatgattcaggactcttctcaaatatctctcatgagagaggcctttcttggctgctccagccacagagacagtcaccctggttctctgctctgtcaccttcatagcacttattactatttcattgtgtttcttatgtgtctgcttgttctcagtctctgtccacttgagaacaaaggaaaggaccttgtctctttcatttcagcgccacatcccagcactacaccagtgcctggcacccagtagatattctgaaatgtcagtggatggatgcctatttacatactgtgcttttcttgtccctcagggccacatttttgagttggtccatacaaagcaacaaattaagcatttagggctttatggacaaaccccactatttttttaaaattttttaaaattcctttttagagacagggtctcactctgtcacccaggctggagtgagtggtgagattacagtttgctggagccttgaactgccaggctcaagcaatcttcccacctcagcctcccgagtagctgggactacaggcgcatgccaccatgccaggctaattatttaaattctttgtagaggtagggtctgactatgttgaacaggctggccttgaacttctggcctgaagtggtccactatttaaggtctttgacagtgcagctttacgggtaatgacatgtattagttatctaataccatgtaacaaattactcccaaagttagcctctcaaaacaacaaaagtttctttttcatctcatagagtttctgaggtccaggaatctgggagtggctctagctctagtttccttgtgaggtggtggttcagtacatcagctggggcagccgtcagtgacagttggaagtactgcttctagactcactcatatggatattggcaggcctcagttcttcaccacatgggcctctttacaggctgctggagtgtcctggagacatggcggatggctctctaccaaattgagttatgagacagagaaagcggggagagaaaagggagaaagaagggagagatgctaagatggaagccatagtcttttataacccaacctcagagtgacataccatcacttctgccatgttccattggaactcttgtacagtgtgggaggagatggcacaaaggcacgaataacagaagatggggattatctcagggccatcttgggggttcattctcatgtatcttattctgattctcagaagagagccctggatagaacatgtaactctgtataacagtaaatcatttcctaatgtcttcttccatttcaggggccagttgggtggaaagtttgattaccagtgtgcttataactcttttttttattattttttgagattgagtcttctctgacacccaggctggagtgcagtggcgcgatctcggctcactgcaacctccgcctcctgggtttaagcgattatcctgcctcagcactgcccccaagtagctgggagtacaggcacgtgccattatgcccacgtgatttttccatttttagtacagatgggatttcaccacattggccaggctggtctcaaactcccaaccttaaatgatctgcctacctcagcctcccacaatactgggattagagatagctcttggataatatgctacttaagaatacagattctggtgtcagcagcccagctttgaatactctctctgcctcttgatatccatgtaaactgaggatattttgaagcttttcttcttacagaattgtggaagcaatgtataagttatctaatactctgtattagttatctaatactgtgtaagaaattactcccaaagttagcctctcaaaacaacaaacatttctttttgttgaatgagttttcatctcattgctgtagaataggatcctagtagtatctacctcatggagttgtgaggattcagtaagttacttcatgtgatgctcataccagaatgtttgccagactaagggcacttaggaagtgttgacttttattctttggattatcccacagctaatcagtgccaaagtaattgttgcttcccatagcttatccttcactagatggaagtgtcctagacagacctctgagacgaagtcagtctaaacaacttctggcaagctatgagctgtaattgggttaaatagttgcgacgtggagaaatctacttttctgttgcagaagtttcatgggctctgtcaacctttctgtccatgggtggttttctgtgggaacccatcctgtgagtaccttgacaataacagcttacctaccatccagaatttagtattctcccttcattctctagagaaaacccaagcataccttcctgagtggttggccagtggctgaattccacggctgtttcgttaagttctctttaagcagatttttcaagtcttccctatttatatcttttgaaatccaatctccttcaatcaattttaatcccctaatgtgtttgctataagtactgtacaattcacttgtcctcaataataaaattcattttggtgcagcctgccggtaatttgtttgagaagaagtcgttaggaaacccttgcattctcttctggtttagaggacgaccttcagtattgatagcattttgttgtcatgcgcttgaagtattctttcatgattgacagtgccgtttaaataatggactacagagccatgtgcttaaatgaaatctgactacactaatttcgttatatattaggaaacttcaagtgttctacaaggacacgatttcattgaccatggatttatattttcagtttgtatgaattatacccattgtgtattgttcccccttcactgtaagatactcttttgttttgaaaatcagtgtttttgtgttttaactctcaatgtatgctgcataagcaaaggattgtgttccaggcccctcctggaacaggccaaagtaagtaaaatcgagaattttttatatgaaagatagaagaagtacagcattattgactcagcttaatactgagttaatacactctaataaggctcagaagatataaaagatccactgtactctctctatatatatatatacacacatacatacacatataaaatataatttatacatgtatgcttaattggaaaaaataaagatcaagagcatgttttattgtttatctgtatctctagctttttttaacagcatataaagacaaagcacctttttatttaggcttggctaaaaattatcagtcatatgtagatgattttgcagtatccgccaacttcctactcaggaaaagttatagcagatggcagaatttatgtgccatgtggcatttgtttaagtgtggaaatagctaatattttttcctcaattattataactattttacttttaaagactcaattaactttgaaataccattcttgatgggtgcctcagttaaggatgggatggggagaaggaagagaaatttgaaatcttgcagggcctttgattgaataacggttatattgctcattaatcagaggctctgggtaccctgttttcaaaataacattattgtttactaaatatagactcctgtggaactgttaaggagaaggtcctactgagatgagcaggcattgtggattggcctttctactaccaaggactgggattcacatttgcaagtttgtgggtcctcagggagaatatcttggagttgacatcatttcaggcatatagcccgtaatttgttttgacaactacaaacaaaaggggtctattcccaaaaggcttcttcgaaaattgtcagaggctcttgccgttgataatgtgagctgctgctcccagggctgagggcctgagaaccacagcaggactggaatccagtgggaggagcaaggaagctgcagggggtgacggtgggcatccttccagagagaagggcacatttgaaacctaggagaccattcctgtcaggaatcaatatcaggtgactgtgatctatggcagagacccagtgctcggagtgatttttttaagttgtgtatgcttcatatagattttctttcctgatttgagtttttctacttgggtgaaataaaaggcaaggggtttgtgtgctggggtagtcggggagagaggagaggatttgatggagaacatcaaggacctgttgcttgcctgttttctaggaatccttacctgtaatcagctcattacagagaatcttggggttctcttgagcctgctgaaggcatgcctcctgagatccattgaatagagcaaaaggatcagtcaggaaatatttattacacagaggaaagaagaatgcaccagcagagttctgggcctgctgcagccactcagtaaatattttttgagtgaattaatttatcaaaaaagcatatgtaaaaatatgagtcattatcatgagtggtttgattgaggatgatatttcttttcttagtttttacaactgttggtaacatttgattaattacttttattacaattatgattatcatcattttatatacagttgtactccttgcctgtgttaacaatttggtgatagcctttcacatttttatacctttacatggcctgtataagtatacagttttgtcctaatatacatgaaataataaaaagtggatttttctgccaatacacacttagcaagcgttccagggtctctttatgtattagaacataatctcattgtcatctcattctttttaaaacgttacttgatatcccgtcgtggaagtataatatttatttaaatatgttttgcctatatttgatttcataatgtatatttttaagtgacaaatctgtatcaaattctataggacatagagaataaacccatgactcttccaagttgtctgagatctagttatgaattttgcacattttcttaatgagtatgttctgcttttaaaacattaaaggttgaagaacgttttaaatctacttacaggatcaaaactatgcacatgaaaagaatgtctaacctttgttgggctcttatctaagagacactaagcgtgcatgtacaaatatatataaactcattaaaatcccttccattatttagcgtgaaccgtagcatagccaggcaagattgctgagtcttccccagatggac[133 bp omitted]ctcttgcctcagcctcccgagtagctagaattacaggtgtgagatatgcacccagctaattttttgtgtcttttagtagaaacggggtttcaccatgttggccacgctggcctcgaactcctgacctcaagtgatccacccaccttcgcctcccaaagtgttgggatttcaggagtgatcccgcatgcccagccatcaataaatacttactaagtgcctactttgttcccaagagtgctgggaacttagcagtgaacaaaataaataccttccctcggggaccttgaactcaagtctagtcagggatcactctattaagagatcaagtcaacactcaattctcctacagactcagataggatagtattttaatttctcgttgatctgctccctcagaccctagaccatgggcactgcagatttttgcaccttttgtagaggcagggtttcaccactaccagagactttaccatcatttctatgtgaagggaaacagtgccctttcagtagacaacgttaaatcagccatcagacgtgggtcatggtgggtttgccgtgactgccacaaacacgcctcaccgaagtctgccaggggacgccataccctcccctagaaagtaagaaacagagaaaggctttctcctgccccggactgtctttctctcagctctaagaaatttctttacagctgttactttatcctggcctgtctcttgagtaagaaaactgctggaaagagtctgccattcactcagatcataatcagggagcctgctgtcactcaggaagggctttaaaaaattcttctgatttactgtgagtgcaaatctctgatattcctgcatctccccatccatcttattttgattttacacatagtgcgattttgaaaggaagcggtgtttttggagaggtagaaaaactctggaaaataaggcttatgacgttggccatcagcacggggctgctgtctgctgtgtgacatgctcaggggtgacgcgcctcccgaaagagacacttggtagagaaggcacgggcgcgaagcccggctgcgggagagctgggagcctgaatgtcgctggctgccgttcacagcaggctctctctgagcaccgtggggaggcagtgacacccgctggcctcgcagcgacactccggcagctgtcctgttttccagcctggacgtgataggtgtgtcttggaggacagtcagaggaagacaggcaagccatactggcctccctcgaggttataccctcgcttaggttaggttgcttctaacagacatcctccgcgggcgttgaggcagccagcttcactgtcacccagacaatttttctctcgctctgccaaccctgttcccctttcaagaatgtttaaactcttcattcaagcgatgagagggaaacacttgagctgcacactcaaggagatgtgggtttccattctggccttgcgatatattattggtgggaccgtgggtgagtcacttaacttctctagtcctcagttttcttatctgtaaagtgggctccagcatacggcttaactgaggtaacacacgttgttcatgtcagctgttgctttcatgccggctctgcctaggtctccccatggcaacaggataggagttctctgcctgtgcgtcagtttttcactagcgtgggaatgctgtgaggagggggcggaactcggtgtagcaagggtttctgtccgtatcttctattttttttttttttttttttttgagactgagtcttgctctgtcgctcaggctggagtgcagtggcgcgatctccgctcactgcaagctccgcttccagggttcacgccattctcctgcctcagcctcccaagtagctgggactacaggcgcccgccaccaagcccagctaattttttgtatttttagtagagacggggtttcaccgttttagccgggatggtctcgatctcctgacctcgtgatccgcccgcctcggcctcccaaagtgctgggattacaggcgtgactaccgcgcccggcccgtatcttctattaagaaccagcaaccacgggctgggcgtggtggctcacgcctgtaatcccagcacttagggaggccaaagtgggcggatcacgaggtcaggcgatccagaccatcctggataacacggtgaaaccccgtctctactaaaaatacaaaaaatttggcaggcgtggtggcgggcgcctgtagtcccagctactcgggaggctgagggaggagaatggcgtgaacctgggaggcggagcttgcagtgagccgagatggcaccactgcactccagcttgggggacagagcgagactccgtctcaattaaaaaaaaaaaaaaaaaaaaacagcatccaggaatgctatcgtgtagttgctttgagacatggcctggggtctccccgcaaggcgacaggacagattacgacacgttgtttgaaatctgcctttagaaaaagacacggcctcattttatgcctgtgagtgatttttcttctgtgtcatatcataactctgataaagataattacatcctagtgtctaaaggcaatgatgtgcttgattaagcctatgcatgttgtttggtccttgtatatttatattttcttcaaatttaaatggatactaagtcctctcaacattgtctatagattgctggaaactgtgactttaagcaaaatgacgtgtaacagaataccttttaccatgagctgattgatacaaacaagagttaagttcctgcagcacatttctggtcataaaagcatcactgatcttctaaataaagacccaaaacacttctaaaattaaacatgaaaacacatgtgaaccatacatacattttaaaaagattaataaagggctaggcacggtggctcatgcctgtaatcccagcactttgggaggccacggtgggcagatcacctgaggtcaggaatttgagaccagactgatcaatgtggtgaaacactgtctgtactaaaagtacagaaattaactggtgtggtagcagacgcctgtaatcccaggtactcgggaggctgaggcaggagaatcgcttgaacccaggaggtggaggttgtagttagccaagatcacagcactgcactctagtctgggtgacagagtgagactccatctcaataaaaaataaataaataaataaataaataaataaataaagattaataaaaacatgcaagataatttagccagtttttgattaatcagtgatggtggtggtaggcatggtgcgttacatcaaaaaataattttttatttttgcaaagcaaaaactgtcaggagcacctccccccatcacacagttcaaaaacaatgactagcatggcaggctcactgggcaccttcataccgcattgtttattgttgtgcacttttatgattagcatctactttatcagtttttatttggcagtcgtgagtattcattctttcattttgcaacctgcttattccagttcaggctttcgagtgggtggagcctgtcgtagcatctcagggcacaaggcagggaccactctggtcaggatgtgctgacacacacactcactcatgctgagacgacgtagacatgccatttccccaaacacgcacatctttgggatgtgggaggaaaccggagtacccggagaaaacctacgcagacatggggagaagatgccaactccacatagtggacccagttgggaatcagatttttttcttatcaacattgtaacataatattattcgaagacctgctgtactctgaactgttcattcttctaagggtcttaaaaacttgaggacattgaaatgctatggctcaccctcctattttctttcttaggtatgtttttactgagtcctctgaaccttctttgaactccaactgggaggaaataacagctaatggggggttgttcctatttttgttggcagggtgagggaggtggtgactgaggtcaaactatgtggaaggatattttatttactaaaacaaaagaggcaataattttttactgcaacgttagggatttatgctagataaaaggaagttcccacaatcctgggggaagggtgttaagccaaggcaaagatttcacagctgttgggaaattgctttctgaaaatactaaaggatacagtgccagagtcactggccatctgctaataatttatgttcctcatccccagcaaagataaagaacctgtaaagaaccacccatctagggatacatttccagccccccttttatcaaagcggtgacatgtgaccgaattctgcccagtgacatgtgggaagaagtggctctttcaggactgttcccccaaaactgtctttgggatgctccaaacttctttattcccccaatcctctgatgaacatgcacctgacattggatgctacatgttaaaaacggagttgtcatcttctacctgggtcgctgaatgactgtgtggatcaggaagctccccactcttccctgccatgactgaactagccactgtcatctggagggtgtctgtaatagcatctagcattgcctaacatcatactaatggaacactacatattttcatctgaagtgatatcagtggaatttccactgaaagcaaaggtttagattttggagcaataatgcttaatatttgtcagtaggagcttattaaatataaataccagtcccagtgcttagaactttttatgtgctgtctcctttcattttccttccaactctccagtttgtatcagtcggggaacaccaagttgtgctgtggtgacaaatagctctgaaatctcagtgatataacacaacaaaggtttatttcttgctgatgaagattcactgaggttctgggacactctacagagaagctcttctgcatgtattggctcatcattcccagtggttttactcttaggaacccaccatgtcaataagtagttccacatggtcccaggggaagtccacctggatgtctcacagtggtagtcaagtgctttgacaaggaagtgacacaccctactatcaccaaatcccattggccagaaccagtcacatggcctccttttccctcctgtatccctactatgtgctcaggaaaaaaataaaccagatagtgaagcaggaaggactatatggaaggatattttatttattaaacaaacgaggcaatcattttttactgcaatgtcatacaaatgagaaggctgggattcagagagcttcagtcactaggacaaggttacccagttaggaaagcacaggttttgtgatgaagggtgtcacccaacagtgcttatttcattgaagagccatttctaaaattacttttctgtgttacaacaaaaaataaggtaataagttagtcctcaagcatcttgcagttcagagctggaaacagacaagtaaaacgaccagttacctgcattctaactactactagacatcagatagcactttacatatcattacctcatatcttacgtagtgataagggaatgtgagaaaacttttgcaagtcatcacaaaacacttttttcaggggcataagaatcttggcctaaaatggatcatcatgtaacaggctgagaacagggtagtgggaagttagcgaagcaatgtccccgggacacagcagtgggtgaaagtgtgttgtgattcatgaccttatggatggacggtgttctcatccatctgtccttggctgggtagctgatggaacagtgatctgcttctctgggtatttgggagaaataaataaaaatccatggtaaaatgaagctgtgttctgcattttactcagcacaagcattctgtcctaaactccaaacattgtgcccaatggggatgtcggctatgggtattggtgtgtgtgcgtgtgtgtgtgtgtgagcatgggagaaacagagggacataggaagagacaaaaatatagagaaggagagagaaccccagagagagagaaacagagagtgaagaagaaacagaatattttccatttatttcaagtcagttatcccaagttttagtgggatcaaagtaaaatagataaaaatgtatttattaaatataatatagatttttttaagtatatttcctggttgctaaaaaataatctttgctcgaggcataagaatgatacaatggactttggggacttgggggaaagggtgggagtggggtgagggtaaaagactgcaaattgggtacagtgtacaaattacggctctggtgatgggtgtaccaaactgtcggaaatcaccactaaagcacttatttatgtaaccaaacaccacctgttttcccaaaacctatgaaaatataaaaataacaaataatttttgaaaatatttgctcaaaaatgaggctactgaaatgatgttatgttttcttctattttggttctacctagagaaattttaatgttttatgccaagctgttcatgcttagttctgtttttgttttgttttcttttttgttattgttgtttttgtttttgagaaaaggtcttattctgttacccaggctggagtgtagtggttcagttatcgctctctgtaggcttgatctactgggctcaagcagtcctcccacctcggtctcttgagtagctgggactatatgcatgcaccaccacacctggtgatatggtttggctttgtgtctccacccaaatctcatcttgaattgtagttcccataatccccatgtgtcatgggagggacctggtggaaggtaattgaatcatgggaatggttacttccatgctgttcttgggatagggagcgagttctcacaaaacctaatggttttgtaacgggcttttcctcctttgctctgcacttttccttgctgctgccatgtgaagaaaagcctgtttgcttccccttccgccacgattagaagtgttctgaggcttcccaagccatgctgaactgtgagtcagttatacctctttcctttataaacactaagtctcaggtatatctttagtagcagcgtgggaacagactaatacacttggctaatttttcaatttttttgtagagacacggtctcactatgttgcccagggtggtctcaaactcctggtctcaagctgtcctcccatatcagcctcctaaagtgctaggattataggtgtgagccactgccgccagccttcagtcctttttaaagtggtatacatattctatgtataggttcatggacctgttcatcttttttttgttgttttttcttttttcttttctgagacagagtcttgctctgtcgcccaggctggagtgcagcggtgtgatctcagatcactgcaacttctgcctcccgggttcaagtgattcttctgcctcagcctcccaggtagctgggattacaggtgcccaccaccgcacctagctaacttttgtgtttttagaagagacagggtttcaccatgtcagccaggctggtctcgaactcctgacctcataatctgccctcctcagcctcccaaagtgctgggattacaggcatgagccaccatgcccggccaggcctgttcatcttttaagggtttatgttgtttgactttttccatcacaaatttttattcacctcagtttgctgataactatttccaggtaagctggagtcataacacacatttgccaattatctggagaggagcactacttcctaattatgtggtcattgaagagctagttgatcattaagctacactgatatgcaaagccacaataataaacagcaggcaagattaaaaactccgtaagacataatcccttatggtcctcttcataaacatacaaataatgaaaaaataaatacacgtttgctcaattctgcaaaaccagaaatgtcacagggggggatgcataatagtgattgtattgagggaccaaccttggttgattcttttgtggggtatacacagtaaactcagacataaacctgcaaggtaggcatcattattctccttacctttctagagatgagaccagctgaggctcagagaagtaagttccctggccccacaaagctaatgaagccctggagtttagattcagacacagattctgttatccccaaagactaagaccctcaaaacatgtcaagtgttaaccgatgcctaaatggaactcaatttttccagaaagaccctgcatatctcatttgggcttgcttttttttttttttttgccctttttttcccccaaaatcataattgcaaaggcaagcttctgaagcattgatcaagaatatattttgctttggatgaagaatgtgaaaaatgtgattttagaagaatgctgtaaatatttctcccacttcattttcttttcccttctcctttttccatgctgtgccttttgagttatccccatatactctaagtgccaggtaggtccacgtgggacaaccagagtctaatgagttcctgcgccacgcccacccctaatgaagcatcttcaagtaggatttctaaagacccagggaagctttccctttggtgatttgcaaagtctggccactttagaatttatctcctgcacagggttctgtgtctttgctttttcgatgatccctgtgaagcatgaacccagcacccttgccttcctctttgttggagatggtggttatttgtttgagtcttttagggtgctttattttgttggtttcactgttggcagctggtacaggcttccttcccccagctgtgttggctgttgttttgggaaacaagccttgctcttttccatgcagacctctaccctgggctctgatggtctagctgaggtgaagcaaaccgtaggtgagtgccaacaggggatggccccttcctgggcagaaggcggatatcgatctcatgtcagtcatgttgcctgtctatgaaaatactacatgagcttctcagaaacaggtgatctattgatccccaagctgctaagggggcctccctcatgggttctgcttagctccttaatgagggactcacagctgtgtttatggaggtcacctggaactagaggcaggttttactgggaactctcaaactttgtgaaaattggatgtgtgtcccagattcttagctttggtgttatatccctcaaaggatgccactgagattacatgtccaacacaatcagaggcatttcaacatgtcaaggttttcttttgccctaggcattcatataaaccaatcgttatgaaaccggggcatttttgcttcccaaaggatattgataatctttggttgttgcagttgaagggatgctaccagcatctagtgggaaaagccaggggtgctgtactgctgcacatctaacaaggcaaagaccagctccccacccaacaaagaattattgggttcaaaatggcaatagcattgaggctgagaaagctgatttaagtcatattaaaatggaccccttgtaaatataaaacacaattttgtgatagtaaaaatttccaaagaatttttatcactttcctattgaagtgaattaactcttaatagctcattgaatttatgattagctattatttctcagtaatcatcgcataaacttgaaaattctgatgagaaaaataatgtacaacttattttccaacatgataaaatatttatgaacactaaatttaacaattaatgatgctgacataatgttgcattttggagaaatataattaagcagttattaattttgtctttgttccttgaaatgttagcgccaatttttttttttttcaatttttagatgcccttggacctcaaaggccctgacactgcatgtggagtcaggtgcataaaacatccttgaatctattaattctgggcctcctcaatgaaaggttaaattcatttaaaatacttaaatgatgacatcgtagatccaagaggtcaaataaaataaggatttagtctttttttctctcctttctttttccctccaccatttctctcttctcacttcttcatttctcatcttcttcctctcctgaccgctccttcctccctttctcttctttcctcccctttctttccttcctctttcccttccctcccctttcctagcttcccctcccctcctcacccctttttgaaatgttggagttcatttcaacagaaacaactgagctacagttccagctggttttctaagctacagttcaattattactattatttgcaatttttctcccctcccctcccctcctcttttctcctttccttgaatctattaattctggacctccctcttcctcactcttctctcctctcctctcttgtctcttgctcgatgtctctctctctctcacccttctctttggtgttcactccattctcaggtaaattctccccacaaggaagaggatggatagtatcagagccagcattctccactcagaaagccagctggaagatagagatctcatttcttggttgcttcagcaaaaggcccaggagtagttctaatgggtcctagcataaataaatcactgtggtccggggcacatggcactcattggccagcttggaacacatgtgcaacttcaggaccaggaactacctttccctgagacacttggtctgacagtgggaaatgggtgggttgcgtgcagagcaatgggcctgctgatgccaaacaagaggaatgataccagccaatcaacaaatgtctgctccttaaacaactgcaatgttaagttttgggggagcatctcacactagccctgtggatgaacagtgcttagtcaatggaggaaataactagaactttattagcttccattttacattttattcctttcttccaagtaattgggattggggagagcatcttgttacctgtcgcctttttaactggattctatccattctctgtaactcttagttctttgctctctggctggttttgtcaaggtaactaggtattttaaatcacagtgcaatttcttgtggctcagaaaactgaactgaagtagtaacttttaataggtcaattacattatttttcagcagcctgctgcagcctaatgaaactgcagtttaattaggttggtgtgacgccaaaataaatgtttcattcccagcttgttttatttactcattgaaaagtaggggaatctacaaataataggattggaaaatgttaaaggctaatcagtttggctgcacttgtttgtaaagaaagacgattgtatcttcatcactccagtttggtagttgagaaagctgaaaaacaaataaacaataacaacgacaacaacatttaaaaaaaaaaaagaaactcaaaattgtaggattccttagtagaaggttcttttaacaataataaagtcaactgcaaatactgaaagaccattcagaaagaaacgtaaccaagtcagagtctcctaatgtattctgtgttcctattgtgtggtaagcattgtccctgctgtaattacatctattttctcagtaaaacaaagggaagtcttgtagatgaagttttagggcccatcaaaggtagtactctgagtgtgatcaaaccacactttcactatttggagctcagtgagttaggaactagaagagcagagaacagcagaaaagttgtgttttattttcattattattattattattattattattattattattattattattgagacatggtcttgctctttcacccaggctagagtgcagtggcatgatcttagcacactccaacctctgcctcctgggttccagcaattctcttgccttagcctcccaagttgctgggattactgcccttccccaccacacccagctaattttttgtaatattagcagagatagggttttgccatgttgaccaggctggtctcaaactcctcacctcaaatgatccacctgccttggcctcccaaagtgctgggattacaggcatgagccaccatgcccggcctgtgttttcttttaaaatacagcacccctgaatgacctctagctactcccagtccttccaccctcagctggaagatgtgaattgccacccaccaaggcaggaccagcctggcaccgatcactgaaggattgtgattaagtcagatggttttgccagcagcctccagccgatgtctcatgctgagctattgtttcaacaaaaaatgagatgtctggtcatgttctctcttcctggggcagagattggggacctgcgttgaaaaccagtgacaacttccctttgccttactgaagataaaggggaatcaggcaaaaggatgctcaaccaaagctgcaggcaagcggattcccaggcagaacctggtcaaggctttgtaggcatcacttcttctctgagacacagagagcttggcatctctgtgcactttcataatacacaatggttagcattttaatctctggcagcctcatgcaaagaaaaaaattattccaaggcagtgccaggaatcctaatgtcctccatggtatttttccaaaacaattccttaatagataactatcatctttcctatcttacagaagaggaaacctttatcgtcatgtaggtgtgaaacaagaggtacatttgcagggctgccatgaagcattgtcattacacacatttatggtgtgaggaagtgctgttatagtctccaaaactttgaaatcatctcttcttgacttttacttcgactcttttttcaattttaattctaaggttgacttgtattctcggtcccctttgaatagaaccttagatcccccatgtcacattcaaaagacatgtttcaagtgccgtttttcatcttgacatgttttgcaaggtccttgcctctgtgactttgagatctgtttaattcactgcggtgggctgggtaggactcttccagtcttgtgatagtgctgtgttgctggttagatcaatgacatagactctttctgtttaagaataatgcagtaagcaatggtgaatgcttggaatgataactgtaatcatgcacctgttcactgcagttcaaagggggcaaaaacaggtgtacctttgctggtcatcacagcaaaactaatttagtttttttcttctttctttctctcctctttgacaatttgtgtaggggtctgtgcattaaaatggataattttaaggaaattctgtaaaataggtatgcatgagtattgtagaagtatcatgtagtagagatcatacgcaattatttctgtattaattaaagtgtgtccagatacctttaaacaacagttttaaacgttcaaaacagtggaatacatgttgcccaataagtgaaataatatatactgcaatgtatagaacaggtactagctgtatttaatagtgaagttatgcttaatttgaaatgcttcacatttgtttataaatccatcatcagaagcaatgtttgttatgatcaattcagacgtttggaatcaggaggtccagaaggcagccgtaggcagttgtttgtgcattcagactacagagtatcaagaaaatcccaatttgctcagataggtaggtgtgaaaaccaacaatttctttgaaccactcgtcttacaacctcagtgtattctatattgtgcatagatgacagaagaaacattcattcctaagatacctacaaaatgagcaaaaccagcagcataaatggacccagtagtaatctatctccagtgcgtcttaattttgtgcatcatccatttgtgactttcttttgttctttctgttaatcagagatcttttcagtggcaggtgacatatgcccaacttgaatggccttaaggaaaaaaacagtattgtctcatgtgattgaaacatctatgtatatatagctggtttggggcaaagctgaatcaagatgatcagatgatgttgccaggaatacttcttcccacattacacactcttctgtatgccatgtattttcaggctgttcccttaaagtggcaagatggcttccagcagggatacgcttacatcatcccagctcaggagcctgacggcaaagagaaccttctcttcagtggttcaggataagtcccggccagatctcagttgcttacccatcctaagaagcagggttttgttttaactgcactatcaccacgtaattataggagaaagggaaaaggtttcttcaatgagtctttaaaatatttaacattaaaaaattgacactaaaaattgtatattatgtaaaacaggatgttttgaaatatatatatattgtggaatgcttaaattgggtttaaatgagttaaattaatacatgcattacttcccctgtttattgtgtgtgtgtgtgtgtgttgagaacacttaaaatctattcctttagcaatttcctagtatacagtacctaattattaactgtagtcaccatgatgtacaacaggtctgttggatttattcctcttatctaactgaattttttttatccattgactaatgtctccccagctcccctctctccgcactggtaaccaccattctgttctctgcatttatgggttcacttctttaagattccacatacaaatgagataatacagtatttttctgagtttggcctttttttttgagacaaagtctcactctgtcacccaggctatagtgccgtggtgccatcctagctcacagcaaacttcgcctcccaggatcaagcaattctcctgcctcagcctcctgagtagctgggattacaggtgcacaccaccatgcctggctaatttttgtatttttagcagagacagggtttcaccttgttggccagggtggtcttgaactcctgacctaaagtgatccacctgcctcggcctctgaaattgctgggattacagacatgagccaccacgctcagctgtgtgcttggcttcctttaaggcatcttaatgctagaagaagctagaccatgacagacaagtaaaaaagaatgaaaatctactagggtagaggtttttagtgtaaaaaacagagagatgatttttcaaagaaagaactctcctcaaccctctttttacatacaaacttgtagaaaaattaaaacacacagtgaaaacccatataacttttgtgtagtttcaccaatgattaacattttgtgacatttactttctctttctaccctccgtcttcccatatatattggacaatttgaaaattacaggcaccatgaacaactcatgcctaaaggcttcaacatgcttctcttaaaaacaaggcggtttttgcctggcacagtggctcacgcctgtaatcccagcactttgggaggccgaggagaatggatcacctgaggtcaggagtttgagaccagcctggccaacatggtgaaaccgctgtctctactaaaaatacaaaaattagctgggcgtggtggcacacacctgtaatcccagctactcgggaggctgaggcaggagaattgcttgaacctgggaggcagaggttgcagtgagctgagattgtgccactgtactccagcctgggcacagagcaagactgtgtctcgggaaaaaaaaaaagaaaggcagttttgctatacagccacaaaacaattcttatttttttaatgtagatactaactggaacatgcatcgcacttagttgtccttatttctttcacagcttttgatctagaagagtactctcggctgggtgcgatggctcacgcctgtaatcccagcaatttgggaggccaaggcaggtggatcgtctgaggtcaggagttcgggaccagcctggccaacatgacaaaacctcgcatacaccaaacatacaaaaattagccaggtgtggtggtgcacacccgtaactcagctactctggaggctgaggctggagaatcgcttgaatctaggaggtggaggttgcagtgagccgagatcatgccactgcactccagtctgggcaacagagtgagactaagtctgaaaaacaaaaaatgagaaatgcaccttcctccctgcattttttggtcttctatgatgttgatttacaaagttagtcttggaccattttcttgtagaacatctgaaaatcaggacttacttgattatttccctgtcattcagttcaacttcagcactttgtggagagtgctccccaggccatgctgtctcactgcctccttagctggaggtccttgatgtcactttctcccatgatgtgtggcagtaaagttggtcactgggtaactgacaaatttccccaggatacactagtcttgtacttaggaaataacctatgcatctgtactttgatactacctaactatccttttttccatcatcccttcatcattgaggaaccttttcagaatgggttattacactgatagtagtgacatgatgcttttctaattttatcattccatctatattacaaaaaaacccctaaatattggctgtacccactttagtagaaccatggcacccagctagaataccactgccagaaaagaaactatttttaaactatttggcaaaaataacagaactctaaccagccaatgggttctccttgcctgctgcctagacaaagctgttttatcaagacagggaaattgcaatagaaaatatgtgtaattcacccagagccagctgtatgggagaccagcgtgttgttattactcaaattagtctccctgaaaacccaggaactggggtttttcaggattatttggtgggtagggggtcagaaagtggaagtgctgactggtcaggttggagatgagtcacttcctcggtggggtccacagaccagatgagccagttgatccatatgggtgatgcccactgatccatcaagtgcagagtctgcaaaatatctcgaccactggtcttatattttacaatagtggtgttatcccaggagcaatctggggaggttcaaaatcttgcagctcctagctgcaggactcctaaatcataatttctaatcttgtggctcatttgttagtcctgcaaaggcagtctagttcccaggcataaagggggattgtttggggaaagggctgttctcatctttgtttcaaaattaaactataaactaggttatttccaaagttagttcagcctatgcccataaatgaacaaggacagcttggaggtaagaagcaagatggagccagttaggtcatacctctctttcactgtttcgatttcctcagctataatttttacacaggcagtttcaactccacctgtagctacatcatgagcttgaagaaaagaatcaataatgaccacaatttccagtcactcctcttctgatagaaaggccaagaagtagctcttagtcttggttggggatctcttggccaaaaagaaaaaggaaagagaaaagataactgaaacagtgacaactgagagaagaatgatagcgttttgtaagcatcaccattttttcagcgttaaatactcagaatggagtatggggaacttctaagttcacatggcatattcaaattctccttgtttagaatttcaagagctattacttttctttgattcagttcgattatctttcatgatcctcagaaattgtacttttctccccatttcagactaagaaagtccttagccaaatggcctcaaccatcggatttgcctgtaggtgtcattcatttttgttgtttcttcccacctccctggggtttttcagtagtgcttcctttcaatcaaaagctaattttttttgtgtgtgtaggtggtatagaattccatgcttttacacagtagcaggcctgtatttgatgtacctggttcagagacaattgtcctttatagctttcgggagtaaattcaatgagagccccctgcgactagtttgtaactcatttagtgagagttctacaggattatttcacaaagcagttctcagcttaagaagctaaattggcttcatggggcctagctggaggcctcttcatccctgcattcagaggatatttacatgcatactacgaatctttctagaaaatgggaggagggttcgtattgacggtcgtacatttcctcaacttagctgtccgtgaagggtgttgggatgggtgtttgataattagggagaatattttgtttcataatacatggacagctctgtcatattggcaagtgcgtttgacatgcaagaattgtacagttataaggagtgacccgtggcaaaagcagaccatgcatttgcacatttaggttagtatagtgggtaagatgagagactttggagtcacactgcgagagtcccagtgctggactacactttgggaaggtacataacctctctgaacttggttttggcacttgcaagatgtggacaagtataattgtgtgctgggcaggatagcttatgtgtattaagtgctgtgattattcttagatttctttgtctaagagttcgcacactgtgtattatacaataaatacattcataattgaaaaacctggccaggcgtggctgctcatgcctgtaatcccagtgctttgggaggccaaggagggtggatcacttgaggccaggagttcaagaccagcctggccaacatgatgaaacaccacctctactaaaaatatatattttttaagtattagccggtgcagtggtgcatgcctgtagtcccagctacttgggaggctgaggcatgagaatcacttgaacttgggaggcggagattgcagtgagctgagattgtactactgcactccagtctgggtgtcgtagtgagactctgtctcacaaaaaaaggaaaatgaaaaacctttgtgttatgcatattatacagagccctttctaaaaagaacagcagggcgacccctgcctgagttcctggtagagctgggagaggagaccatttatgcactgggagtgacccagtcatttttgtcagatgatagaaactgcttttcttcagtatatctctgtcttagtcttagctgttgtgacacggggcaactctagtatcttctgctttttctacagcttaatttctatctaatttgtactattatatttaattggaaaattgcccagaaagcagagtctgcatttgtaaatgaagaaggagaagcattttaaacgcactaacaaacctcactttttaaaacaagattaacgtcttttacatgaaggaacccttttgaaagaatttgggaaaagacatgagaaaacacatttgctttgtgaactggaattttatatttggaactggcttcacagaagacagagatgttaagtaatatttgatgggtgtctactgtgggctgtatgacttcctaagcatcctattatttaatcatatagttgtaaatataaaacttaacagtttcagacttccatgtgtgtgaaattggagatttggagactttagacacacgttccaatgtcagggtaggacgattgagtcagccagaatttcacatgtatctctccaacttcttttctttctgtccctcctttaacgtctctgcaatatttcaatttcagaaaattgaaagaataataactaccagccattgggctttcttttgtgtggtactaggcagtaagttggacattgcatacatattaattctaagcttcctccatgatggatattatctgcagttgtacatttcttctcctttctcttagctatccacaaagggtctttggatgggtgcttcataattagggagaatattttgtttcataatacaggaacaagagtgtcatatgggagggtgcattttacatggcaagaattgtgcagtcctaagaaatgaccagtggtaaaatggagcgtgcatttgtacatttaggttaggatagtgaataaggtgagagactttggagtcagattacaggagtccatatgctggctccaccatgtaatacctttctttgctttgaagagatatacatatggggaagcggaagttctgctactaagtaatggaatttgctatctgtttagttttgaagctcatagtcccctgagaaatgtcgtgtgtgtgtgtgtacccacctgtgtgtagatgtgcacagagagctccccctggtagatgaaatagaggttattctgttgtaggcaaatgttccctggacattaaaatactggattccagttctattcatccaggcaagttgctgattagctgtttttttctcaggggtttcttgagcatgtgattatgcagagagagtggagatcattggctgggcacggtggctcatgcctgtaatcccagcaccttgggaggctgaggcaagcggatcatctgaggtcaggagttcacgactagcccggccaacatggtaaaacctgtctgtactaaaaatacaaaagttagctgggtgtggtggcaggtgcctgtactcccagctacttgggatgctgaggcaggagaatcacttgagcctggaagacagaggttgcagtgggctgagatggcaccattgcgctccagcctgggcaacaggagtgaaactctgtctcataaaataaaataaaaaagagagtggagatcaccctcttccacgtacccatctctctctgccctactggatctcatgtattccctaaaatgtattgctcaatacagggtgtaagtttaccaggtggtgttataatcagttcaggcactaaaagaaagggttaaaatcatgcggaatcacagagaaaaaataatgatctgcctatcctttttcctgagagtttcctgatgccccaagaggaaatattcagtttggtgatcgcctctttttgatgacatttgccagttttccttgtactagagggagaattgagcctcaggctgacaatgggatccatctagaatcgaggattgtggctttgctttggtcctatttgttttcatttgttgcttctcttcatgatagaattcctggttttcaaattatgctggtaatgtgagtgccctgttcatttgtttttcagaatttaatgtatgccaataaaaaggtgaattgtttgaaggaagtaagatttttacttcttattttacagaggcatgccattcagtagcactggaacagagaggaggagaaactggagagcagaaaggcaggtggcattagcatatgtcagattttcaatgaggactacggatatggcaatattgggaaggtgatctctgaatgatggaaatttaggaaagatgtttaaagtgcttgtctctcattgcctagcgatttactggcattgtagactccaccccaatgcttttgttcaatttggcgtttaggattagtcatgcacgtggaagattccagcctccctccgcccagtgttacagcttggactgaatatttattaactacccagggaacatcacactgtttgaggacacttgagttcatctatatccacaaaatgtgtcctcatcatgttgaagtggaacagcaattcataagaaatgacaggagcttagcaagaatatataggggaaaatcctttgtctagtaagagtgtgaagtgcccaggaaggtgcttccagcaaataatgctgaatgttggtgactgctaaatgaagaaggaaacacgaagttcagatttaacagaaccatctagacagccatacttcccatgaccctgggaggccgacaagatcccatatttaacctatccttaccaatgttatgagaaaaacaagaatgcatgtgcgattataaatggtggctgactttcaattttaggttgagatacaaaagcaggtggtgggggggtctgtggcaaactcggcaataaatgccccaggtgaagaggctgcccagctctcacagattgttgacatgtaggaatcagtgcctctgattttccaggaaaagtcaagaatctaggtttttaatgtaaaagctcctgtttttcaattatgggcaactagtttattatttaaactacttgggctaggaccctaaataagtatgttcaggttgtggattgtacaactcaagggacccagcacgctcatctttgtacttttttttttgagatgtttttattgaggttcacttactatatggtatgcgtatgccacaaaattcacctatttaaagtgtacacttcagtgttttttgttggtttgtttttgagacggagtctcattccgtcgcccaggctggagtgcagtggcgtgatctcagctaactgtaacctccgcctcccgggttcaagcgattctcctggctcagcgtctggagtagctgggactacaggtgcgtgccaccacaccgggctaatttttgtgtttatagcagagacaaggtttcaccgtgttggccaggctggtcttggtcttctgagctcgttatccacccgcctctgcctcccaaagtgctgggattacaggcatgagccaccgcacctggccttccgtggtttttaatgtattcacagagctgggcaatcatcaacacaccatcagcgcattctaaatttagcatatttttattgctccagaaagacacgttgtccccattagtactcacaccctgtacacccttaccccaccctgtagccctacacagccagcattctgctctatctctataggtttacctattctgggtatgtcatgtaaattgaatcatgtaatatgtggcctttcatgtctggcttctttactaagcataatgttttcaagggccatcaatgttgtaccatgtgtcaatttaattcacgttttgtagccaaataatattacgttatataaatatacgacgttgtgtttgtccattcattggttgtcaaacatttggattgtttccacttttcagctattagaaacaatgcttctatgaacattgatgtacaagtttttctgtgtacttacgtttttatttctcttggatatatacctacaagtggaatttctgggtcatatggactctatttttaacattttgaggaacttccaaaccgttttccaacgtgggtaccccattttacattcccaccagcaatgtctctggcttcccttttgtccacatcgtcacgaatacttgttattatttctctttgacaatagccattttgataggtatgaagtacagctcatcatggatttgacttgcatttccctaatgattactggcattaagcatctttttaatgtgcttgttgggcatttgttgtatcttctttggacaaaccctattaaaaaaatacttcgccaacttttaaaatagggctatttgtctttttattaagttttattgttggaaacttttttattaagttttatataagggttttaatggaactttttatttttaagttgtatgtaagggttctatattctgaataaaaattttcaaatcacatgtgatttgaaaatattctgtttcattctgtggatttcctttttacttcttatatgggattgtcagcagcacaattaaaaaatggatacagtccaatttattttttattgcttattcttttggtgtcattttttagaatctgtttttcaccccaaggtcacagagatttactcctgtttcttttttctgggagttgtatagtattagctctaacatttaggcctatgattcattttgagttaaattttgcatgtggtgagataaggatttgcatttgtatctttgcatatggatatccagttaccccagcaccattcattgaaaatcctattttctcactgaattgactaggtacttcttactgactttgaccctagggtgcgtcactgcagttgtttaattgtagaatgtaaatatatgaaggtatattaattctcctactagggaaaaattaactgcaaaaggaggggtcccactcctgtgttcctggcatttttagtttctgcatcagcctcaactctaggataagagatgggtaattcttaatgagaacagaacttcagaataaaagtctcagctggaaaataacttgattttcagtaggcttgttcatatgttgtatatatgtgacttagataatcattataaatacagttgattctaccaagtcttttgaactgtaagtcttagctgggctctgagcaaagcccttcttccttcttggatatacatgcatgcacagccacacacaatacacaaatgtaccctggtggataaggcatttacaattgagaacagctgatagttctatatagtgctatatcgagatagagaaatagctaaagatgtaaatatacacacccttgatacattcatacacacacacagcattaagttaggcagcccctggtttctgccactagcacagctttctgaatgaatgagctctcgagaggggaacttactggaaagctttcttatcaacttggtaaaggtttgattttcttgccccctacagtggctgtttgtcaccctgactgcagctagaattgctgtgttctgttctttttctggagaaattacaaaaggagttgacatctactgtataaaatgaaacctagcaaattttataaattactaaggacgattctctaatcttcatatctcatctccagcatccaaggaggtggagaagtagttgggtgcgtattcacctagactttgttttgcagtaatgtgtgccagttttataccctaaagccatctgagtccccttttcctttccctgtctccattatccatctggataagccagatcttcaatatcctagcctcctttaaaaccagggacccaaccaggcgcggtggctcacaccagtaatcccagcactttgggaggccgaggtgggcggatcacaaggtcaggagtttgagaccaccctgaccaacatggtgaaaccctgtctctactaaaaatataaaaaattagccaggcgtggttgcaggcgcctgtagtcccagctattcgggaggctgaggcaggagaatggcgtgaacccgggaggtggaagattgcagtgagctgagatagcaccattgcactccagcttgggttgagagcaagactccatctcaaaaaacaaaacaaaaccaaaaaacagggacccaattctggctgctgaaacatcagaaagaagtccacaggaaaggtagccaggattttcttccagtttaaaaggagcaagccacataagcagccacctttttctgcactgacagttacctgtgccttgcctttgggtgtggtgttgatccttggagctgccatggccatcttggcaccatgaagtgagtatcctcagaacaaacatttgttgggctaaagagggtgaaacagaaaagtagaaggaactttggtccttaataacaccgggagttgctcagaaagtccagggctgccttttattctggaattcttatttaagacaaaatgatatctttatggttatagtcactttggtcaggtttggttttctggtacttgtggcagaaggcatccttatagatgcacctatacatataccaatgtatccacatccgtgtcttcacacacacatctgtttcctatatgcagaacatgcattcataaatatgtagggttttttaaatgtgatcagacactatatagtttctaacttgcctttttttcattccactatataattaagacatcctttcttgtcaggatctaaaattattatttactcttttaaaagactgcatgttattttatattatgtatggacctgatttatttaatactctcctattagtagatgtttaggtagatgtgaattgattggccagtacaaagtaaaagtgtaaccagtgttataaaactaatgttcttgttatctcccagtaatcctattaatcagtctgtagaaaataaagaggacgtcagaccgatatatacaaagatgattattccaatattaagcataatggagaaacatgagaaacactttaaaagttcaatataaaaggacttgtagtttatgatctatacatatgataaacagtattatgtgaccattcaaaatggcttttaagaatacgtagtggctggctgggcgtggtggctcacgtctgtaatctcagcactttgggtggctgaggcaggcagatcacgaggttgggagttcgagaccagccggaccaatatggtgaaaccctgtctctactaaaaatacaaaaattagctgggcatggtggcatgcacctgtagtcccagctactcgggaggctgaggcaggagaatcacttgaatccaggagatggaagttacagtgagctgagattgcgccactgcactccagcctgtgtaacagagcaagactccatgttaaaaacaaaacaaaacaaaacaaactcctctgtttcccatcccagtgtcagcacgtaaggtgacaactgacaagatctgtctcataatgtgaataatggttttctctgggaggtgagaagatgaatgcttttagattaaaataaataccagtcagtatgttccaaatcacctgatacggtcatttggcgttatccatgtacttgtacaaatttttctcttctaacccacatgtttctactgttctcatccaaagacgtgttgcaaatcattatccagaacatgggtattgataactgcaatgttcttggggctttgcataacttccaataaagcaaaaccacatctctgaatccattttaaatttgcagtcagccaggggtcctctaatggttgtgcgttttggggaaattgtgacctgggtctagtaatgagtctcttccttgggagttaaagtactctgggaacatacaccatctatctcagaatactttgctgaaataagaataacaaggacgcttcaaaaaaatactaagcgacacacctaaagggcttaaacactaataagtgagagaatctagtggctaggaacttcagttctcaagccagtaacaaaactcctaccatttcttacttgcaaaaacttgattttcccccgtgtaaatcaggctaatctttttattcctttactagtgacactaatactattcagcagccatatggcagagtgcttcagaactgctgctgtggagccgaacttctccactactctgtttcccatcccagtgctcaccacctagttaagccatcttgagcaggtgcgtgtaacttaatgcaaccttcagttctgtatttctgaaaggcaattaatgagagcacttagcttagagagctgtgagcattacatgagctaacacttgttaggcaactagaacagcaccctgcacatagtaaatattctgtcagtggtacaaagtgttaacccacaatcaacaaagcattgaacgcagtccataactcacagtaaggtatgcaacatgttgtcctattgccatcttcttcccaaagcccagataactgcaaagggcatctgggtggcactgctgggactggaacatgtagaggaagagggttagggaagcattcatgggtttttcaagctcatttttctcacttcccttaccagacccatcacccaatttagtaggacacagaatcagattattattactttttgtcttctcaaagacacatttttccttgaaattaatggtggtgctgatgaacacgaaatccaccagacagaatctcggggcttttgttctcagtcctcccctacctggttctctctcctcccccatttccctcctgcccagcattgagctccagctgagctactgtcaggaggctgctctgctaagcagtctgtcacatgttccgttacaatcatgttttattatagctttcaaaagatgacctctcattctgcacactcgtgttcatagaggacttctggcattctgaaaagaaccagatagcagagtctccaaaccctttatttgcttcagctgataactgctctggccagagacgaacgctgtggtgattataagatgtaatttactacaaaagaccgttaatattacttacaaacctgccatcatttctggggaaatcagaactgaaacagtggacgggacacatctgaatccacctaaatatcttggcctgatagaattacaagtttatagatttaccatttaggaaacagccccgttatgaaacatttgtcctcacagacagacagtataagtaacaagcaagattatatccttttatgtggatcaaggacatagtcaatgtaagaaaaaaaagatagaaaaaaaatccctttagaggaacgtaaatgctgcccttgtgaattataactggggaattagatctatgaaaaagcctctaatatgactaaacaaagtccctcaggtgatactctgagtcagaaaagtgtgagaaaatatagcctcttaaatgtgattatagtcagagctgcagttactccctgagaaaggacatagaaggtagaggaatgaaagaaaaaaacagtgtttgaaaactttttgtgtcagaccagaaattatagagtagcaacagcttagggatttaagtaacccctttagcctagttgtaaagcctttgggctttaaactgaagaacagaaaggaattagatatccaacttagtacttgtttttttaagatcatgaaatggaagagtcttttttgctgaatgacgaattgaaccagcatataattccaactagggctataattagaaagatacggctctagtatttaagcttcttacactctcccctctctcatgaactttcattagagtttcttgtctacttggttatatttaatggagatgaaggtgagagttacggtgcttttgttggtattgtggccagactccgggagagtcctaaaatcggtgtttgtcatttacctctcctctttgagaaattttaagggaactctacatacaagaagctataccagcgtaaggatcctggaccattctactcatagttttgcaagcaccctatgcttggagttagctctggttaaaggctgtaaaaggaccactgttcctccatcctatccccagtccaatccttgggactagctcgctcaggaactctcagaggtacatattaaaaagaacgtataagaggtcagatctgtaggagaggcttcatcttaagtcattctcccgggtatatttgttgaggtcaagagcaaggaaggagaaaagatatagctgagtttaaccaaagcaaacaggaccttgctcagccaactagtgctgcccgcatggaattgaagatgttaaagagaggggttagagcttgaagaggatgttaaagagaggggttagagtcacagtttgtgcattttaaaggacagtgaccttgactagtggtaatggggtcaaatcattaattcagaccattcagataaacaactcttctctcttgtcaggtaggacaggggatggaggaatgaagtacctagaagcagcttggtaggagaacaaaggcgtcctatttctctcctttccctccattattcatttattccctaagttgtttattggccatttgtctgtcttctttggagaaatgtttgttcaaatcctttgcccattttttaatttgtagtttgttgttgctgctgttgaattttaggagttctttatacattctcggtattcattcctgataagatagatgattggcaaatattctctcccattcagtgggttgccttttcactcttttaatagtgtctttgatttgctaaagtttttaattctgaaaaagtccgacgtattctttttcctttttgttgcctgtactttttgtcctgagctgtttataaggaaaacagcaaaccgtttgtctgagtataggatggtctctctagagcaagaagggaaggcaggtgaatctcatgactccagctggaaggagagaggatcagtctgtgctgaatccccaacagctgacctccaagaggtcttgatgttcttacagaaaggccacctgcaggacagggttgtgtgtgctgctgggaggccaggcggggactcctgggaaagccttctcctggctccagttccatttggctcatctccaaggtggccaggtactcactgatgcatggacagctcatatgttcatctgtgaactatgtccaggctcaagatgagctggaagtgcaattttttttccacttgctgctttatcccttctgtgcattcctcttgctatcatttagcacctggaaaaatgtagaattcaagatcagaaagacaactggagctcatgccccacacacccccaccatcacatgcaaatgaaattactgaggcctggagtgcttaagactctttcccaaatcctgtcactaataaaacgagagctggagattgggaatcctgacttgagccggtgctgttattaccctttttctaatcatcagtgcacccaaggaaaaagaagtttcccaattttatttatttcagtaagtatttactgtcattgtctactcttcatcctagtagcaaaaaaataaaatttgcaagtggaaactaatcatcaccgttgtggtcttagctgaattgttctttacagatctaaagagagaccacagaaagatctgaatggcagcatgccttaagaacaagattgacccagcttacttgtctcagggccaagtatatggcagaactcagtcatctaaaggagagactgaccccggggaaaggcagcccacattgccagagcttctgattttttcaagagaacctggcagttggagtcttgtatgaaatagcttgatgtatacaactaaaggatttaagggaatctgtttcttaaaatttaatatgaaggccaccatctcctgcacaaaacaaaaatctttttgtgttatcaaaatggactgttgatttaagaaccttgctcttgctttagatcagagccctcaaacacattggaatgattcggagagctttagaaaacatgcatgccttagccccactccacactccatgattctgagcctcttggggtaggctctgggcatcagcacttgagaaagcccccccgggcagccgctatgtgcagctgggggttatgcaccactaggctgactgtagtgtgaacattgaggatcctaccccaatcctcttctttcccatgggtaaggacatctggactgtgattgctggacatcaggatggccttaatattagggttaacatctgaatcattggctgccttttttatttctcgtcctgctgtttgggtactttatagacatagacagttgtccatgtgaccccatttgcctcgagttgcttctgtagagttttgatcccacactttgtgatgtgtctcagctctggggcgagggggctgttcagtgaagttggtttgtggcttcttccctctgatctccttttcttctcccagccttgggggttctgcagctaactgtggtcctttcatgtagctgcctttggtctgctggggactttgaaggtttgcctttgaaacacccagatccctttttggttccttcctctaccccatctgcttctctccactccccttactgttggcagcatcccctcgccttggcagtccagcttttgagagtcactgtgatcaacccagcaattcctactggggaaaaaaaaaagaaaaagtagggagccatgataggtgcaccatgtctatcaaagccatcaaaatggctattttagaaaaaaacctcaataaatattattgttgatcttgttacacatgataacagcattttcttatttttttaatttattttttttaagagatagggccttgctttgttgcccaagcaggacttacagtcttgcatttaagtgatcttcccatctcagcctcctgaatagctgtgcattcttgttatataagaaagtatctgtaatttttagtggcacaattggattataaagtagaggttaaatgataggaactctggagttgcttcaaatactttagaaaataaatgaataggtaaatagcaaggtaaagcaatggtggcaagctcttaattactgttgtatatgggtactgagtatataaaacccattatataacatgttctacttttgtgcatattgaaactttttattaagcatatacacatgcacacacacgtataattgtcagccctataacattctacaattcaataggaatatatgattccaagattctataattctttctttcttaccaattaattggtgcttgagattgatgtaactgaatgaatagatgacttcataaaaagtaaatgagcttgggcctggtggcacacgcctgtaatctcaacagttttggaaccttaggcaggcaggttacttgagcccagaatttgagaccagcctgggcgacatggcaaaacctcatctttaccaaaaaaagtaaaataaaattatatataaatataaatgtatttatagtgtgtgcatatatataaaaatatataaacacatgcacaacgtgtgtatttttatatatatacacacacaaattagctgggcacagtggtgcgcacctgtagtctcagctactcgggaagctaaggtgagagtactgcttaagcccaggagctcaaggctacagtgagatgtgatcaaaccactgtactgggtgacagagcaagaccctctctcaaaataaaataataatttataatgaaaccaacacatacaattaaagaaataaaaaataggccaaatagcatctatacttcaccttcccaacatgttagcttttacaggtagctgtctggcatttgtttcattgctgtccatctagtttggagttttgctttattgatttatgatattatcaagcacagactgtgaactggatcttatattgtggcaatattagctttctggctgctttgaatttgcagtcttaacccccaaagagagaaatcagaaatgacagcattttggccaaatacaagcgtccagtgcatttgtcatcggagtgatcggagtgaatctctcatttttacttgtgctgctactttacatgtagtgacttcaagtacagagtgaaaacttaatactcgttcattgttccagaaatatttattgggtactggctccccgccaggctctgggcagggcctagatgctgtgtcagcgaacaggagagattcagtccgtgtgttcgtggaggttgcatttagacgggcatttcattatgaaacaacacacgggaaactatacttgaaatatgcatcctggcaggccacagtggctcactcctgtaatcccagcactctaggagtctgaggcgggtggatcacttgagggcaggagttcgagaccagcctggccaacatggtgaaacctcgtctctactaaaattacagaaattagcggagcatggttgggggtgggggcagtgcctgtagtcccagctacttgggagactgaggcaggaggatcacttgaacccaggaggtggaggttgcaatgagccgagatcacgcccctgcactctagcctgggtgacagagcgagactctgtctcaaaaaagaaaaaaaaagaaatatacatcttataatgctgaatgtatttccagtaacatgcaagtgttgtggggagataggcagagacttggacaggtaatcggaggctaaaataggaatcctgtgaagtactactgcctttgatattttttccaagccaatatattagaaagccacttcttcctggaattcatgtatccagacacatttttatcttgatgaatttggggttgcatgtctcaaaaatgactgtacgtgttttaaaattttatgttctggggtacatgtccaggacgtgcagatttgttacacaggtaaacgtgtgccatagtgatttgctgcacctatcaacccatcacctagttattaagccccatacgcattagctgtttatcctgatgctttccctcctccttcccctctacgaggccccattgtgtgtagttcccctccctgtgtccatgtgttctcattgttcagctcccacctggaagtgagaacatgtggtgtttggttttctgtgttagtttgctaaggataatggcttccagttccatccatgtccctgcaaaaaacatctcattcctttttatggccgtatagcattccatgttgcatatgtaccacgttttctttatctggtctatcattgatgggcattttggttgactccacgtctttgctacagtgaatagtgctgcagtgaacatacgcgtgcatgtatctttataatagaatgatttgtattcctttgggtatatacccagtaataggattgctgggtcaaatggtgtttcttgttctgaatctttgaggaatcaccacactgtctttcacaatggttgaacaaatttacattcccactaacagtgtaaaagcattcctatttctccagagccttgtcagcatctgttgtttcttgactttttaataatcgccaaaaatggctatacattttttaatatacctgaggctgctgccttccaaacctactgactaatagtccctgagagtggaagtcagcactctgcattttagcaagcttcctagagaatttgtgggtgaacagatgagtgttcatctgactactgattggggacaatgacagaaagatatcagaatgtgctttgaaccatcttggaacaattcattgtggttattaggattaaaagggaagagaaatgtcagctctcatattcacatcccttaaaaatcaagcattaggatataataattcatttaatataaatgttataaccatatgaccaatttccagttatcataagcagttaggtctttcagtctctctcctctctctctctctctctcgctctctatctctcttcctctctctcttcctcctctgtctctccttactctttcttcctctctctcccctctcttctctctcctatctatctcctctccctctttcttcctcctctttccctcttcctcctctctctccgtcctgtctccctcctctctctctctcctctctctttctctctcttcttcctcctctatctctcctctctctttctgtcttcttccctctctgtattatgtctgcctatgtgggcatgtgagtgtgcaaataagaaataattattttagaattttgtggtttccccctgctgtatatggttccaaaattcagtgtctacaacatagctcccgaataatgtttcacatcctaatgagcgatcatagaatgggagaacaaacttaacatgacttacatcctcatttagcctttaaaattctctttgtccacaaacctccttgtttctggagttggcaacatactgaaatagaatatatacaaacttggaaacagctatgagcttgacctaaaaccttaactctgaccctttactgggaaggctttggtaggtgatacatcctctgtaatattttatcttctacatcaaaaaagtccttcattgtacagaattttgagagaaattaatgagacaatgtctcatagcacctgaaacaacgggttctcaagaaatactatttcattgattactcctcactttcttaactcttaccagacctattttgagtctgtatccttggtatcatcattttttctcaaattatttctaaggcagcattggtttgtgttataatcattaatagatacctgaattaagtgaaatatttcaaagtaaagccatatagtatcctgtggggaaaagcctatcttttgagccagaaagactggcttaaatcccagtattattgttcacctctttgtgggttttgtttatatgtttatacacattagttttaccatctgcaaaatggggataacagttttcacccttattcgtttcctgttactatttcccaaattgtcacaagcttagtgacttaaaacaacagaaattgcccaggtatggtggctcacatgtgtaattctaatattttggaaggctgaggtgggagaatcgcttgagaccaggagtttgagatgagcttgggcaacatggcaagaccccatctctacaaaaattaactagtcatggcggcacatgcctgtggtctcaggagggtgaggtagaaggatgacttgggtccaggagtttgacgctacagtgagccatgattgtaccactgcattctaacctgtgcatcagagcaagagcttgtctcaaaaacaaacaaaaacagaagttggtcatctcatagttgtagagatcagaagtctgcagtgtgtctcactggactaaaatcatggtgccagcagggctgtttttttcttgagcctgtagaggagatcttttttcttgcccttcccaacttttagaatccactctgctcccttgggtcacagccttttccaagttcaaagccagccatggccaggcaagcctttcttccatcaggtcactctgacctgacccttctgtctccctctcccatatttgaagacccttgtgattacctggagcccatcttgatgatcctgaataatttccctatttaaggtctgctaatcagcaaccttgattcccttttaccatgtcatatgatacattcgcaggctccaggacagacatggacatctttaggggccacaattctgccttccacagccactttatagatggttgttgggattactgggaagatgtagtaaagttcttagcacagtggctgggtatggagtgtagtatgttctgtagatggagaggttgacgtggaaaatgattttcttttttctcttttttatttttattttttgagacagggtctcactctgttgtccaggctggagtgcagtagtgcagtctcagctcactgcaatctcctctgcctcccaggctcaatcctcccacctcagcctcccgagtaactgggacaacaggtgcatgccaccacacttggctaatttttgtattttttgtaacaacggggtttcactacattgcccaggctggtatgatttttctaaaatcaaggcatttccttaatttaaaaaaaaatttgtttatttctttactggattagctgtttgggggaatcctgaagttaaccctatgtaaagattcacccagatggttcagtgtttccttcatagataaccccctttaaaaacactagcaatgggtcaggcatggtgaatcaggcctgtaatgctagcactttgggaggccgaggcaggcaaattacaaggtcaaaaggtcaagaccatcctggccaacatggtgaaaccccatctttagtaaatatatgaaaaatagctgggtgtggtggtgcgcacctgtagtcccagctacttgggaggctgaggcacgagacttgcttgaacccaggaggtggaggttgccgtgagccgagatcacgccattgcactccaggcctggcagtagtgtgaggctctgacacaaaacaaaacaaaacaaaacaaaacaaaacaaaacaaaaacccactaacaatgatgatgtgggggaaaatggccagacagaaataaaataagaacggaggtagatgacattcaaagtgtgtttcatggacctcacgttgattctcaaagcctgaagctcttcggtgtgcattagactaaattatcattctgctgagagtgcatctatgttttcttttccactgtttgtttttaaatgttgtaaaaacaataataaagtatggcattattagtaagcatgaattatggaagaaactcatctggaccagggaaacattgacattcttatttttttagaggaagacagagtatcccactatcacccaggctggagtgcagtggtgcaatcatggctcactgcagcatcaaccttgccggctcaagtgatcctcccacttcagcctccagagtagctggaatcacaggtgcatgccaccacactcagctgatttttttgtactttttgtagagatgaggactccctttgttgctaagactgctctcaaaatcctggtctcacaggatcctcccaccttagcctcccgaaatgctgggattaccggtgtaaactactacaccccacccgatcaacattatcctgattatacattaactcaggtgagcttcatatatgtgaagaaacactgaaagatcagattgcgaagtggtcttgttactcagcagcttccgccaaacaatcactaccatgataacatcaccaacaaaatgtctgtgactttcacatcccctgctttgagaagtagaaataaaaatgttctgggcatacataccacttatgaattgactgccaaactgttcttttaaaagtaggtcatttgatatgcctgttccactgataacatatcttaatatatagtagaccataaaatgtggaagatcataatatacaatctgcattcacttagcagcaactttttccttagctggagcacagatatacttaataccaaattagaagaaagtgtatgttattgtggaaataagattttaccattaaggcctaagaagcaaaagcaggaaaccaacaggaacccataaatggttggagatgacaaagtggactgtaatagtctttgtgtagttatttttttgagggggaggggacgaagtctctctgtcacccaggctggagtataatggtgcaatctaggatcactgcaacctccggctcccaggttcaagcaattctcctgcctcagcctcccaaatagctgagaatacaggcgcacaccaccacgcctggctaatttttgtatttttagtagagacagggttttgccatgttggccaggctgatctcaaactcctgacctcaggtgatccatctgcctcagcctcccaaagtgctgggatgtcaggcgtgagccactgtgcctggccgtcttcatctgcttttacatgatgcttcctgtttccctcggagaggtctccttggatgctctttgcccccgtgtgattctggtactcatacaacttgacatttcttctcatcacatgagactccacagtgagcatggtttttcctatccgtgttccgctgttcaaggaaactgcctgcagatgctcagagctttctttctcctttctttgtgctttatcagagcaaggatgattccggcttaccttgtccgtggcttctggatattttcacccagtagagggcgtgagtggaaactctgaatgcaggagaagccagaactcatcttccccttctctctctgcttcccaaggcaccctgagtcctccctcagggccctcctccaaggccctgtctcccgctgggcagtgtccaccatggcacgtgaccctggtttctggtctctgaagacacctcctcttcccattggttgcaagggttttggtagcttctgcagtcacctcttcctcaattctgttaccgttccttctttggcctctcagatctcccgagtccccttgatgaaaaaattccttttggttgaaaagtcccggaatagttcctgtttcttgcattattctaatatatttacgtctaaaacaaccctcccctcttgcatatggtacatgatgcatctagggattatccctggtaagaatttgctcatcttttattttctgtttgtttaattattttgaaggaattttagactcagggtaagtttagctttatagagagtcctagtatactcttgaccaatattcccctaaatgttaaaattttgcatgatcacaacacatttctcaaaactaagaaaccaactttgggatgatattacaaactaaactgcaggcatacgtttttaataaaaccaacattgccactgcttttaaaagtagtaaataaaaacacatatcatgtatgcatatgtgtgtatgtgcagatctctaattacgtatattgacttatttaagtttcacgtgtacttacagcacaaactacttttacaaggcagttggaattggatggtgagcttgccatgaggctagagccattcatttcccagatgttaaaaacatttgtttggcccgggtgtagttggtcacacctgtaatcccagcactttggaaggccgaggcaggtggatgacttgaggtcaggagttcaagatcagcctggccaacatgacaaaacccctcctctactaaaaatacaaaaattagccgggtgtggtggtcggtgtctgcaatcccagctactcaggaggctgaggcaggagaattacttgaacctaggaggtggagactgcagtgagccaagatcatgccactgcactccagcctgggagacagtgagactctctctcaaaaaaaaaaaaaaaataataataataatatttgtttgttccagagggctgtttccttaaaactgaaagtgaagattaccaaattcagtttgacaaacaaagcccccgtacagttcacgtgccaagtgagagaaggcaggtgccagtcccagcatgtgtgtgtgtgtgtgtgtgtgtgtgtgtgtgtgtgtgtgagtgtgtgtgtgtgttttggaattcacaggataaatactgtggtacaggaactgtcaggcctgattaatacttttgcactcgcggtgcatgtgccttgatctataggcattatgcttgctgcgtgggtccctcacaaggcagccattagcatcagcttccaagcagctcccccactgtgcacttcccttccctgtcatatgcttggctgtcatctttgctaaaggattttcaggttggtttgcaataagggtaaacttgggaaggatggagagcaatttcctttgaatgctcaggatggtgggggctggttcttagcacacagaaaatccatatgagaatgcctaggacaaagcgggggaatgatttctgtatacggtgtggtgtttagtacgtgaaacccttaggcccccttaaagtcttccgctccaacccttaaacagttaagcatatagattagcatcacttacatgcaaggacattgtaaaatatgatatgtttacaaaatgctatggaacgctagatgattattaaacataatgaggttgaaatctaattccataatatgaagatgcccatgttttattcagtagaataagcaacttgtagagtaacataagtagtgtgttatctcattttttaaaaaaggtagataagtaccaaggagggcagatcactcgaggccaagcgtttgagaccggcctggccaacatggcgaaaccccatctctactacaaatataaaaaattagccgggtgtggtggtgtgtgcctgtaatcccagctacctgggaggctgagggaggagaatcacttgaatctgggaggcagaggttgcagtgagctgagattgtgccactgcactccagcctgggcgacagagtgtgactcagtctccaaaaaggaaaaagaaaaaagaagatagattcagatactgcaataatttggaagctttatacagcaattactaaccagagtttttcttttgtaagtgagtttaggtgaaactttccctttctacattgtaagttgctttattgtttgtagattttataacgaataggtaatatttttggaattcccaaaaaatattgaatttcccatgtaagataatattttctacagatcatatcattcagatcttgtttcttctaagtaatgaaattctgatgcatttcatactgcctgctgcaagtaaggatgtctgaaatggacaataataaactaaagatagaaagaatcccttctgagtcttacactggatggacttcctgccctccagccatctttaaatatcatgccaggtatgaagaattaacatccctgatttttcttttagaaagaatattggtatctgcctagaaagaagatggttattaaaaagaataaaagcagacctgctttttcctgcccagttaatctttaccgggacaggacaaaccaatcactgcggaatgttttgtgggtgtcctgaggctgctgtaactgagtatcacagactggacgacttagaacatcagaaatgtcttcgcctagttctggaggttgcatgtctgaaatcaaagtgtgggcaggcttggttccttctgcaggatctgaggaagtagcctctttccttactcctagtgatttgccccacagtctttggtgttcctcggcttatgggtctatcactccagtctctggctttatcttcgtgtggcattttccatctgtctctgacttcacatggccattttatttatgaggacatcagtcatattgacctagggactcaccctactccagggttacctcatcttaactaatcacttctattaataaagtgactctgtgtttgaaaatgtttgcatttggaggtatccggggttaggacttcaccgtatctttttgttgctaacagacactttaaaaatatagatgactgcatcccaattaccagtcgaattgttttgggcattatttattaagagaaataaccattgtgatgcataagatgatctgtgagccctgtgctgcagacgagggccatgtggatggtatcgtgaaaacagttgcacctttgcttaaggcaaactcattgtataaaatacagtttgcaaaacagttattttgtgggtggcctatttttccctctagaaatggcattttttactctataaaggaatgaaaacttcttatacagagaacttcccagtggatttagactagaatctcattcactggtgctaataattccaaaatacattcgtatttaagatcctcatgccagtaattctagtactttgggaggccaaggcgggtggatcacctgaggtcaggagttggagaccagcctggccaacatgccaaaaccccgtctctactaaaaatacaaaaattagctgggtgtgctggtgggtgcctgtaatcccaactacttgggaggctgaggcagaagaattgcttgaacccaaggggcagaggttgcagtgagccaagatcgcaccacatctctccatcctgggagaaagagcgaatctccatctaaaaaaaaaaaaaaatcctctgtcccaataaatatggccacaggaaaattcctcatttcctcaaaataaagaacttctttcacatgaaatgtccatgtgctttccatcagcctttccctctccaggagaacatcaatgcaaacacttgtatttccctcctttgaaagtctctctatatagcttccgtcttttctcatgcacgtgagaagtcagctctgccattaacagcagatggatggagacacagccgcatttcccttctcacaggcactgtctgcttggcacgtggaactgcgtttccttgctcgcgaatcctcatgtgatacgcatctccccatccctcataacctccctcggtgcagaaactatctgtgaacagtggtaccggtcccttgacgttgtagcttgacttgctgaactctgattctgaatccatatatagacgcagggacactgcccagttttgcgtttaggaaagtcagactgtcatcggtgtggagggctgtgcagcagatgaggacagggccccaatcccaaactgaagaatcttttataggaagtgtcaggcctttttgcaggagcaaatttttcatcattgtatgtgtatttaacttttctgttctttggtaactggataaacagtgaataataaatgaatgtctgtgctcatattctcctgtcctttaaaaattatattaacttatttttaatcagtttattagttatatgctatattacatgctataatctgtagagaaatccacccccaaccgtgcccagtgatagtgactcaaatacagtaaaaatgtttggtttttttttttttggccaggcgtgatggctcacgcctgtaatcccaacacttcaggaggccgaggcgggtggatcacgaggtcaggagatcgagaccatcctggctaacaaggtgaaaccccgactctactaaaaatacaaaaaattagccaggcatggtggcgggcgtctgtagtcccaggtactcaggaggctgaggcaggagaatagcatgaacctggaggcggagcttgcagtgagccgagatcgtgccactgcactccagcctgggcgacagagcaagactcaggtgatctacctgcctctgcctcccaaagttctgggattgcaggcatgagccaccatgcccggcaataagttttcttaattcattgcaaaaggcagggcttttctgacaagagtgagctacagccattattctgattaatgctgccataatctaacatcacggaatggcaaactagagactatgggccacctctagcctctgtctgtttatgtaaattaagttttattggaacacagtcatgctcatttgtttacatattgtctctggttggcttcctgccacgacagcagagttttgcaacagagaccttatgtcctggctttgaagatacatactatctgcttctttgtaggaaaagtttgttgattaccggtatacagtgttgatctttgagcagggtacttaagaacgtagaggtgctttggcccaccacgaagagttttggaagacgtaagacttaagtggtacaaggagaggtcctccatccctgactataagcacttgtccaccttgatctcatctgtatagggttcagtgaaacttctgcttggaaaaatacatgtttgaaatcaattacatgaagcaaatattgtctagagtgtgaaggaaagggaacctgatcttcctgcttggaggtctacaaagcctcaaaaacagataggcagttgcccttaacctatacagcagagacattgtgtatctaaaggcatggatgtccagctaggaattatgacactcatgcagagggacatgaggagggggtagtttgggtctgactctccagttcacttctcatggatgtaattgatttcaaacttgtatttttcctagcagaagtttcactggaccctatagagatgagatcaagatggccatgtggttatagacagggctggaggacctttcctcctaccacttacatgtgggggttccaaagatttactaaatgctttgcatgtgttccaggtgtcagagcccatcacaggcagggttttgactctcagggagcctgcagtcttgtggagggaaggtgggcaataaggaagaagagacagcatagatattttgtgcaatttcagccagaggaaatatggcaagacagtagacagtgggggataaagtacagcaattttcttttatttaggaagattagagaattcctccttgaggaagtgatgtgagtttcaataaggatggaaagtaccatggaggtctagaagtgtctgggggcaggggtaacagcaaaaacaaaacttttcaaacatggaggtggtgttggtgcatgctggtgtcttgcaagtgctttcagaaggctacccttatcttttcctatccacctggcaaatacctcctcatatgcatgcaagactttgctcaaatgcagcaatccttgtgtttgtttctgctgctctaggcgggaatcccatcccctttcttccaccttatcctaaccgtcagtgctcccagtgttacagggacatgaggaggggttagtttgggtctgactctccagttcacctcccagcaccctgcctagtggtctacccatcactgatacttaacagttattgaatatgattatgtgtataccctagaaaaataagcaacaaaaccgttcattgtaatagatgacattgactgaacacttacttaaaacgcagtttcaagcccttagcatatataaagccattcagtatgccaaataaccataaaaggtagggactgtcattatttatagaagaagacactgaaacacaggaagactagtgtgtcagaagtcctacattctgataatagtagcacacacttcctgatgttcattatacatttaccactaggcgtttaatgtggattttgcttataatcctcataaaagtctctggaacaaatgctgacatgatactcgtttcgaggaggagagaatcagaatacagaaaggtaaaatcacttctccaaggttacgtggctagtgcgtgagagaactggctttcaaattcacatcactttaatgtgatgtgttggtattagaaagggaaagcatttcaaaagccctcaccacagtgtcataaagctggctgctcatggtaaacattccaaagaatccaccaacacagtgtccttggagtccgtctgcgtgcctgtgcaactgcaccttgcttctcttggtgaaaaattcacctctttggaccctgtgttcactcttgttgttgtcctccccttagatgaggaaggagcagggccatccgtaaaaacagagtcatagggtgaaaacacatcacagagaatgcaaaagggttatttatagtccagagtgggaagctgaaaagacactgtgagaggaacttaatcgtttcccaggggatcagggagaagagtggacagtggtgatgccacgctgcagagggtcaaggttgcataccaattaaaatgacttccagacacttaacacacacatggtacttcgctacagaccgctgacatgttccagccaggaaggagaaaaaaaaaaacaacttctgatgtctcatgcctctgtcccccccttaaacagtgaggcagctgggctaacactgttgttgccaaacaactctaataatttcaggttccatgataatgagttggtggccttataactctcgtttgcatatcttggtacaagggaaaacattcagtccagtatgactctttaaatagccatctatgccaagccccacataaaaggtgggagggcttgttgatgttccctttttctgcaaactcatttgtgaaactacatcaattacagttcaatcagttctcccattcttttttcttctcattaaacttatgcctttctgcttagttaggagaggactgtaaactcagcttaagcaaaaataagaaaaataagaaggacttattcattctcatgaaacctatgcgtctaagggtaggagactgcctttttggtgtgcgtaaacctgtgcccctgagaaactctctgcttctcaaaactgctttcatctttgttggtttcctttttttttttttttttttttaataactttcattttaaactcaaggttacaaatgtactgtttttacataggtaaacctgtgtcatggggacttgttgtacagatgatttcatcatccagatggtaatcctagtacccattagttatttttcctgattgtctccctcctcccaccctccaccctacaataggccgcagtttgtgttgttcccctctgtgtgtccacgtgttctcatggtttaagtcccagttttaagtgagaacaaggaatatttgattttctgttcctgcgttagtttgctaagtgtaatggcctccacttccatccatgttcctgcaaaggacataatcttattctttcttatggctgcatagcattccatggtgcatatggaccacattttctttatccagtctatcattggtaggcatttaggttaaactgaaatcataacaaacagtctcttgcaccacagcataactaaattcaaaatcagtcagaattcactcaaaaccatacagttacatggaaattgaataacctgttcctagatgacttctgggtcaataatgaaattaaggcagaaatcaagaagttctttgaaactaatgagaacaaagataaaatataccagaatctctgagacgcagctaaggcagtgttaagagggaaatgtatagcactaaatgcccacatccaaaagttagaaagatctcaaggtaacaagttaacaacacaattaaaagaactggagaaacaagagcaaacaaatcccaaagctagcagaagacaggaaataaccaaaatcggagctgaactgaaagagatagacacgaaaaaccattcaaaagatcaatgaatccgggagctatttttttttaaacaacaacaataacaacaacaaaacaaacgattagctagatgaataaagaagaaaaggtagaagattcaagtaaacataatcagaaatgacaagggggaatattacccctgggcccacagaaatacaaacaaccatcacaagattatgaaaccctctctgcacataaactagaaactctgaaagaaatggataaattcctggacgcatagatcctccccagactgatttacaggaagaaatttgttttactttcaagcacgttctcatattgtcaccaaagctccacacttaaaatcccttgtattagtttgataggactgccttaacaaattaccacaaactggtggcttaaaacaacaaaattttattctctcacaatttgagaaggcagaagtctgaaatcaggatgtcagcagggttgattcctactagaggcttggaaggagaatctgatccttgcatctcttttagctccaggggactgccagcaatccttggcttatagccacatcatttcaatctctgcctctgttgtcacatggctgtattgtctgggtgtctctgtattttaaatctccctctcctttctcttataaaaacactagtcaggccgggcgcggtggctcacgcctgtattcccagcacattgggaggcctaggccggcggatcacaaggtcaggagatggagagtatcttggctaacacggtgaaaccccgtctgtactaaaaatacaaaaaaaaattagccaggtgtggtggcaggcgcctgtagtcccagctactcgggaggctgaggcaggagaatggcgtgaacccgggaggcggagcttgcagtgaaccaagattgcgccactgcgctccagcctgggtgacagagccagactctgtctcaaaacaaacaaacaacaacaacaacaacaaaacagtagtcattagtgtcaggctgtaccctaaatcaaaaatctcaagaggcttaattacatcggcaaagccccttttttccaaataaggtcacattctcaggtaccagggactaggaagtgggcatatcttttcgggggcacattgtaattgactacacatattactgtatcaaccccattgcaaacagagcaaaccccagaaatactgggctaatgctcgttagctctgatcacctggcctgactcacagatcaacctttaggctaatcactgcagctagaaggacatgtggcaaccccagataaagaacataccatttaaagaccacacacatcacacaaaacctattgagagacgcttgacgaacaaggtttgtgctcagtgtgttaagtggatgacatgatttaaaaaaaaagtaactgaagagctaagagagagttatggtggaagaagtcgttacacaaaggtgctacataattgctgctaggttcgtgttagccaaaggggcttacaccattttcaagcctttacaagacctgagagtgatgtgttggtttgagttggtgtttatgtggaaagggaatatgtatggaatattattaaatagttttactgaattattggcatattgtaggcattccttaagtactttattgaatgatagcacaaaatattgctgaatatttttgctacattcttggcaggttgtaggcatctcttaagtatagttctgcaccacataatgacgtttcagtcaacagcagactacatatatgactgtggtcctataagattataatggaattgccctatacagatgtataattttttatcttttatatttttatcgtaccttttctatgtatagatagatttagatacgtagtacttaccttttaatgacagttgcctacagtattcagtacagtaacaagctgtacaggcttgtagtctaggagcaataggctagaccatatagagtgtgtgtgtgtagtaggctacaccatctaggtttgtataactgcaccgtgtgatgttgtcacaaggatgaaatcacctaacgatgcatttcttagaatgtatcctgactcttaaagcaacatttgtggtttattgactgaagggataaaaaataaataaatgaatatatgaatacaaaacaatttttagaagataaatgaatgagtgagcaatttgtccttctctttcctcctgagattttctatttttaaaagtgtgcttgtatttttgtctttatatttaaataatgatttaaatgatttatttaatactgaagccactgatgagctgagaactcataacacattgctaggcacagagcaaatgtgaaatttagtttttgttgtttttatccacatgttgttctgccaagttgggcaacataatgccccctcagaatgctagttaatgcacttaattctctcagggtcttcttactttagactctttgacatccttgggcaattaaagattagctattttaatgaacacaccacatcttttacaaagcctctttggcaaaagacctttgtcagtccgccatcgacatatattgcaaattacctgctgtgtcccttgaagtattatggaaacgggaaacatatgggtggactggcacaggctctgcataccccattccagaagcttacattgtagtaaggcaatatcaaaacatgcatgcaaatgaattaggttagtcaatttgagattatctgggagggggctgcttttgtgcacaagacagagctaacctggaatttgaaaggtgcagttgggcttagctgtttcagtgacagtggggagcagagatgctgagaagggcctgagaaggacagtgaaacccaaatgacagctcaagtgttctgattgtcactttcatgcaacccctggtactgagtccatgctgcatattgttaggtgaaaattctttttttttttttattatactttaagttttagggtacatgtgcacaatgtgcaggttagttacatatgcatacgtttgccatgttggtgtgctgcactcattaactcgtcatttaacattaggtatatctcctaatgctatccctccccctgccccacaccccacaacaggccccggtgtctaatgttccccttcctgtgtccatgtgttctcatcgttcagttctcacctatgagtgagaacatgcggtgtttggttttttgtccttgcgatagtttgctgagaatgatggtttccagcttcatccatgtccctacaaaggatatgaactcatccttttttatggctgcatagtattctatggtgtatatgtgccacattttcttaatccagtctatcattgttggacatttgggttggttccaagtctttgctattgtgaatagtgccgcaataaacatgtgtgcatgtgtctttatagcagcatgatttataatcctttgggtatatacccagtagtgggattgctgggtcaaatggtatttctagttctagatccctgaggagtcgccacactgacttccacaatggttgaactagtttacagtccctgttaggtgaaaattctatggtccatttcacaactacgtaccacagaaaagggagatacggacaacactggaaaaacaaaatataagtatgcaaaggaacacagacttggatatgaggaaggggcataaatgctatatttaagcacatggttactgcctttcctaaggagtaagccaggaaaagaaactttgggtcagttaaatatctcgttgcttcctttgcaaaagtaccttttaatagtctgtttttagagttgtttaaaaagaaaaaactgtcccttgcctactttaaattcttgacatttttttctggttttggtgagatcagggtttttgcagggcagtatccttcattatatatgtcagaaggctgagaaatgagtggggatggtgaatcaaccacagcccttctgaatttctcacaaggtaatctacctaacagaacataccagtttccacccacctttgttttggttagagtgatattttgtcccttggcagtgaggacgtctttccttcacatgatttttgtaagactgtaccctaaaagtagccacagtgcagctgtgttttatatgaaaacaaatggggttttgttgggtacattttgtggcatttcttgaggtcaccagaaactcctagacgtcgttgtaaaacaaagaaagaagaagaaaaaggctggaaactcactcctcctgctgttcttatgtcaagtcagtgaaggcaattctttaattttttcattttttcagtgaatacttagcacataccatgtataaccccccatgtaagaccagccctttgtcttctaagaaatgacattctgggctggacgcggttgctcacgcctgtaatcccagcactttggtcgaggtcgaggcaggtggatcacttgaggtcaggagtttgagaccagcctggccaacatggtgaaaccccatctctactaaaaatacaaaaattagctgggtgtggtgtcgcaggcttataatcccagctgtttgggaggctgaggctagagaatctctttaacctgggaggcaaaagttgcagtgagtcaagatcgtgccattgcactccatcctcggccaccaaccctatctaaaaaaaaaaaaaaaaaaaaaaaaaaaaggtattctggtggatagtgggggagtggcacacccccaaaacaatttcacaaacaattatttaattgcagttgagttaagtgctaaagtgagaaggacacagaatagagtcgatttaaattagaaagaactaaaaaatgtagctaatttcttcattcctgtaactctgggtttgagacaacaacaatttgagtgaatcagtgaatgactgcatagatggcatgtataggtgtcaagtaaaaatcgtcttgtagctaaatcctcagttgtgaaatgggatacaaagtccaagctcctttccttttctaggtatttctgatgggattcactcagttcgttaaaactttaagaaagccctctctgtctgttatttttctctctgcctactcagatggttcctccattctaactatggtagaggccaaccttgtcatgattttcagaactatgtagttccccaccgcccccgccccaagaaatgcagagcaatctgccttatcagtatctcttccaattaatgtaatcttgtttctgttatttccaccatatttttcaatccagtgagcctcattacatttgcaagtgcattaaattagagcctctatagaaggagaatgatgattatcagctaatttaattatgtttctacatttgcagcatttaatgatgtctgccattgttgttggggattcttacattggctccaggtagaaattagctctgatcccatgtaaagtttacgttatcagataatacttgagagctcattgaggtacatgttcagtaatttttgaatctaatcaaaattgatttatgtgcaatcaaattataggaataaagaaacagcttcacctaatttagttgccgattatagtgttgcctgcctctgaagtcacaccaatatgcgtctcttagttttgtaccaacattgcatcaaggcctaaaattctgcaggtttttttttttttttttcccaaattgcatagttggttctgtatttctgaccttctgctgtccatcagattgaacatttatgccctctgattttgtgtcctgttcaacaaatgttgcccgggtgtcctttaagtgttggccatgtgactcttgcactagaggcccaggtcacccatgaacctagaagagaagatccatggtgtggaggagtgggtgttgcaggacctgggagctgaggctcgggagggctgattcatcattcttcctcctttgctgtggattctcaaccaaggcaaaaatagatacacacactcaacagggattaaggtacagaattcacgctgggcatggtggcttatgcctgtaatcccagcactttgggaggccgaggcaggcggatcacctgggatcaggagttcgagaccagcctggccaacatggtgaaaccctgtctctactaaaaatacagaaattagctaggtatggtggtgcgcacctgtaatcgcaggtactcaggaggctgaggcaggagaattgcttgaacccgggagacagaggttgcagtgagccaagattgcaccacagcaccccagcctggatgacagagtgagactccatcttaataaataaataaaataaaataaaatagaaataaaataaagtatagaattcagtttatcaccagtgaggctgtgttgtaaacatgcttttatgtttaacaagcactttagtcatagttattttgtgccagacacaaattggaaggaccttatacacaaaggccctttgaattgttatgatagcctaaatacaaactattattatcctccatgcacagtttatagacgaagaaactgaggcacagaaggctgggctatgttgccgaaggctacccatctgccttctgaaagaaccagggttctagtcctggcggtctggctctaaaatccatggccgctgaacacaaagtcctattgtgcctcccaaagctgaaattagcattctgtcatccaacccgcattactcctacaaccatatctagatcttgggatgggcagagtagtttggaggatattggtccagcacaggggaatgagatggggctttgaagctggcctctagaaggcggggccctgaaacgtccctacttaggtgtgcttacctgttctaggtataccttacctactctaggtgagcttaggacatacggatcaaaagcaaaacatgcactgcttggaggaagtgagacagagaaagagagatggagagaaagaaaaacttttccattttgaaaagttacccatcagaaaagtctctatgatgttgattgggtgaggaagaatattggaaacttgctccctgaaacagtcataacacagtggaggatttgagtaagtctctaggtctcaaaggaggaagcaggaaggatgagaagataagaactatgaacgctagactgagaatatactattaacgcctatacttaagaatataagatgttcttgagacatgtgataaagtaactttccagaaaaatgagcagcacactgtgaaaacaaagacgcaaaagtgaggtgtcagtcatcccccctctgaggccggagggagggtggagatttggtgcaggtcgaaactgaagccaattgataaaatgctgtgtgtgccctacaaggaagagagaaggtttgaataaaataaagtgtgtctcagtacaaaaggagaagtttcacaaagcatttagacatcttataaaatggagttgcttcatcactccctaaaggggccatcctcaactgtctcctgttcaaggcccactctcagcctcgctggatgtcaacagccataaccatgtgattgttactgcagcagagcaatgtctccaagtgtgcaaaggacatctctgggtcactgagcgtgaatgtccatgagcccagccaggctcccttctctgttcaggaggcaaagtttttccacttcgcagtccccaagatgtctctgtgatactggtatggcgttaccttctgcctcttcctgcttacgggtaccttggtcatctcaccagtctccctgggggttagcatcttaggaatgtgtactcaatgacagccaacgtaaattttgcaccttgctcaaaatttgactgctttcccgttaacggttcattaattgaaaactaccggtatcttcctaaacctagagtatgtcccaacagcaggatgtgattttatgttttgtggtacatggacatgcattttgttgtaattgcagatgtatatgtatgaggctggttttcaaatatagaaaatatgaaagaatcataatatactatatacccagcattaagatgttacaattcacatttttatcatatttgttttatctcttatatatccatcacttcatctaccaatccacctcattttgtttttttatgcatttcaaagtgacttgcatcagtatctttcacccttcagcagggtgtaaatctttaatgagagctcatggtttgtttgtggtcttttatttttctgaggtaaaatttattgatactgaaatatacaaaccttgaagggaccgtttgatgaggtttgacagctgagtacacttttgtaacacgaagctctgtgaagatatagaactgtcattcttccaaagtttaggtatgatctgtatgtttattagaaaaagaatcacagcctgaccagtatggtgaaaccccgtgtctactgaaaatacaaaaaattagccaggtgtggtggcatgcgtctgtagtcccagctactagggaggctgagacaggagaattgcttgaacccaggctgcggaggttacagtgagccgagattgcaccactgcactgcagcctgggtgacagagtaagactccatctcaaaaaagaaaaagaatcagcatacatactaaacctatgattccatgaacagtttaaatgaaagagtacatacttttgtgtgtgtatatgtgtacctggttacatatatgtgtgtataatttacattgataagaataatgcagtatgcagatgtagcagaatttgtaattgtgatggaagttcttctgtatttggcaattacaggcctagggaaaaggtaacctcatcccattagcattgtcttcaaaaagaacacgagcatataaaatgtgcgaggctacactgatgtaacgtccaagataaatggaaagaaacacagtgttgctcgtttaattgaggatgtttaacgacttttggccctgagagtaccaacagctacaatttttcaaagtcagccttgatttatgttttattttttaagtactcattaatgtcacaaatagttaagttgggatcagctgtcttcatttacaaaaaatgggttatactttcatcttttgaccctgaaacgtgtagataaaaatcaacattaattggcaggatgaatgagggtggttagggtgggtgtctggctgcaagattcttagagtattgggagagatgctcagagccccttaactggagatgacaacgagattttaattaacagcaggtgagtcttgtggtcagccatttgacatataggtggatcacaaaatagcctttcctttctaaccacatttatttctagcttaattagtccttctgagatagcttcgctattagccacagcctctccatttaagatccttttaatcagacgttttatttttttattttttattcttctcattttagcactagcttaatgttatgaaggacctggactaactcattttaatgacctctgctacataaatgctaattttacatttggccttatttcggtaggttttttttttttttaaaaaaaaaaaagaccattgctttcagaaggagaaaaatggaaagattaaaccccttagtgtcatctgcctgaaaaatcctgtggtttcttctgacaggaagagggttttcaaatccctccttggtctaagcttctgtgcttgacatctcattattttactcagctacttcagcatcaccttcacccagttaattaagtaactcattgaatgtattattcagttttgattcccctgtctgtgacagagagggatggaagatgcttcttcatccttcttctcctgcctttttctcttctgcccacacccaaggaatggaaaagagaaaggagaggagagaagacattaatttcaaaatccatccatccatccatgcatccatccatttctgcagcagattgtttgatgtttttaatgatactcaaaagaaagtgaagttgatgatggtaaggttaatggtcataggtcttaatggtgatataacatcagtttgcaccaggcactgttaaaatttccttctaacatggtcttatttcgtacttaaaacagcctgatgaggtaagcactattcataaggccactttacaggttaagaaagctaagatctagtcaactaatttgttcaagtctccttgctagtaggaatcagaaacccaatttgggcccagaactagctgattggtaatacttatattccctacagcatttctgttaagtatctccatgtttgtagtcaagtttaaattcctaaaatttaagctggaatttatgatgaaaataccatgagaaggaggttgaaattgtagttgacctatgttacccgacctgctcgttacaggagttaagaaagaaacttgacttcctctagggcagtagtcctcaaaccccaaggaccaggacatttggccaaacagctatgataaatgctgctttatttgagtacattagacttcaattaaaaaaatgttttaaagtaccttattgaatgcatttagatttgggggagggaaggaggctatacttggacctaactccttggttgtcaacccagctggaaataagcaagacatgatgtttaatatgaatgaaagtagagagagagggcatttggaggggggttggtgcagagggaagcagaaagaattactaacatgaaaaggcagatagaaaatttagaaggtcaaaggcagagtaattgaaatagagcctcggaaattgtgaatctgagaaagaactggaggttaagtgataggtaagaaggaagataaggacaagtaaagggatggaataaaaccaaaaatggggggtgagtgtgtgtgtgtgtacgagagacagagatgcattttaatgcatatttaagaaaaaggaaagtagaaccttataaagaagatgaagtagaaatattttttagaaaacactttttattatgaaacatatttttttttttgtaagggaaagttcccagtgacagagtgagctgtgtagcaacgtgtgtaaaaagcagacatcacattcttaaagttactccattcgctcctgaacaaatattaagtggaggttttgttctgggtgtcagaatacagcatggaaaaaagacaaaggaaagtctctgctttcatggagctaagaagctagttgatgtggagatagaaaaataaacaaggaaatcaaggttatcaatgcaaataatggtacgtgcaataaagaaaacagaacagagaggataaagcattgctggctgggggaagagctcactgatgagctggtgtctgaactgaccttggggtagggaggaggagcagccaccgggaggctcagagcagcagctctgcagggggcgggggtagagcgggtgcatgcaaacaccccaaggtggccacaaacttaatgcatttgagaagctgtaagaaggtcattgtagccaaagaggagtgagcaggaaaaggtaggagaggtcagtagcgaaatgggcaaagagctatgttgggagctgggtttattctcaatggaaggagaggccattagggtttcaaatagagaaatcacactctatttggataatgtttggataatgtttggacaatgtttagtaaggatgtgctggaaggaggtgctgggtttggtttctgagtctgtcccttgttaattgtgtgtcctggacacagttactgcatctctgtgatccttcacttcctcctccttgaagacacttaactgcatcgggtttctttagaaggaaagctggaagaactttagagtctgttttccctgcatgctagctacaaactgaaaccatcgcaaacaacaaggtcaaaacatctgtgaaaccttgcaccagttgtaataaagatagccagggagaaagaaaaaaaaaaaaggtctgaacttgttggagaaacaaaaggacctcataaacagtatggagaccagttgtgtgttgtcatcagtgacttacctgagaatgatattcctgtggttatgaggatagtgttacagtatttccttggctaagtgtctgtggctgttatccatgtgcagaataaaagtccacttgaggaggagacagaggctcctgtcttttaccaatgttgatggatttcagtggaacaaaaatgagtctcttgaggttagaaggcaggcctggccatgggtgttttgcttgagctattccactcatgacactgggcctgactgatatccggcgaaggccttctttggctgaagtgcttgccaggcctaaccaacctggaatttattgataaagcttaagcagccgcaaggcctatgacctcaaagagtgacttaggctgactttatcagccttggctcttcttttcattatatttgctattactggagctgctctcttttcttaaaacctgttaaccttatacaaggggatgggaccatttgagctctcagacaggatgctgatgggaaattgtaagccttcgaaataggttgagagcttcctgttgtttgggttctggcagaggttacaaaaataaataaataaatataaaaaggagagggatggggagacattgaaaaataaatacttgatgtgttttcctggagttgagctggcttcttcctgggacatgcttttttccagcccttggaagaaagttgcagcgattgtgcccacttcacagatgcagctgacgtgcacccctgtgctgcgtggggatcttagcagggcaggtcagatgtccagaactacttacatcctcacatcagtggcttatagaccaagaaacagtcctctccaataggtgcacagaaagtgttcttgagtctttatttttattttattttttttgagacagagtgtcactcttgtcgcccaggctggaatgcagcggcacgatcttggctcactgcaacctcctcctcccaggttcaagtgattcttgtgcctcagcctcccaagtagctgggactacaggcatgcactaccacacctggctgatttttgcatttattattattattttttttagtagagatgggttttcaccatgttgagccggctgatcttgaatacctggcctcaagtgatccccccacctgggcctcccaatgtgctgggattacaggcctgagacactgcgcctggccacatgttctggagtctttaaatcaacagactgtttaacttggctaaaggaagtcaagtagttacttggtttccagccagttactgatggctgtaattagccacatgttttagtgactttggaatcgaggctctagccaggcgctgtagctcatgcctgtaatccttaggctttgggaggctgaggcaggaagatcacttgagttgaggagtttgagactagcctgggcaacacggaaagatgtatctctataaaaaaataaaaataaattagccatgcatggtggtgcatgcctgtagtcctagcgactcaggaggctgaggtaggtgggaggattgcttgaggccagggggtggaggctaccataagcgatgaccgcactactgctgtccagactggacaacatgagtaagaccccatctcaaagaaatccaggctttgtgtaaaccgatgcatttcttattgaataaacctacacacacacatacacacacacatacacatacacatacacacagactatatctatattctactataccagttattgtgagtaattcatggaggttcagaatgggtagaaaagtcaataaacagtaaagttgccttctgttgtgtgctcattcactcttccattaaaaaatatttctgttactcctttaagaaaatgattagtgcaacaggaaagcagattggctgagtccctcagatcacccgcttctgagtcaaaccaataaggttcatgtcccagatccaacaactgtcagctctgtgaccttgggcaaaaaaccaaacctccgtgagtatgtttactctaaaatagggataatcactgtggctgcctcccgggcttagtgaagttgcatatatatttaatataatagatgatacatacttatataatattatatccatttaatagaatatatgatatatacttttatattttttaatttaaatataaaagtatattacatatttaaagtattcaaatatataatattaatctatgtaatatatgattaaagtattatataaatggaaattacattatataatacaaatatatgtatatatgtaaatatgtacatatataatacaaagatacatatttgtattaaatatataatacaaagatatatttgtattaaatatacaaagatatacatatatttgtactaaatatataatacaaagatatacatatatttgtattatatataatacaaagatatacatatatttgtattatatataatactttaaatttaaattcaaaatatatattataaattaaaaatacacatgtatatattttaatttatataatataatataatttaaattagtaatttagtttataattattacatatattatacatgttttaatttatatataatgtaatataatactttattatgttacacaaattatatatgacatgcatattttaatagtttaaatatatgttatatattttaatttatatatcatatatattatatataaagtattatatgtaagtatacattatgtattatattaaatgtatatgatatgagtataatatattacgaaagttttaatatatattacataatatgtacatatttttaatttaaaatatataatactttcaatttatatattcatcactaaaaatgattttttggaacattagttcttgttgttaaccttgtctctgagtagctgataacttcatgaaaaagtcagatattgtataaaatgccctgtaaatataagtacaagtgaaatcatttccaccatagcccatgatccttatccatgcaggaccaaagacttggtgccacaaggaacagtcaaatctggatggggaggtagaggaggaagtgataacaggtttggtaaacagataattgggcgaacagagggaaagtgattcagcaggaggagacagtgagccaagtttctggaaaataaaaagaggtatcaataaaaaggttgacagggagcatagggtctgggaggaacatactagaatatgagtctaggaaggaaggtggcataggcacagaagtaatttcagtaaatccaatgagtcttacggttttgtgaattcaaaattatttttggaaaatcatgctgcctaagagagatcaatttatttttatttattttacccaacataaactattttgatgcacttgaccagtcagtcttagggtttaggtcactatcatattcacctgaataagtatagtctgactattccttttattcaaaatgttcgagaccagaggtattttggatttcagatttctttttcagattttggaatattgacacatacataatgaggtatcttggggatgggacccaagttgagaaccgtcattgccttatgctttatatgcacatcatacacataacctgaaagtacttgtgtacatgtttaataatttatgcttgaaacagttttgagtgtattttgactgcagtccatcatatggaggtcgggtattgaattttccacttgtggcatcacctcgcatctcagcagtcagacagttttggatttgggggcacttggatttgggattttttcttttttgagatggagtctcgctctgtcgcccaggctggagtgcagaggcacgatctcggctcactgcaagctctgcctcccgggttcatgccattctcctgcctcagcctcccgagtagctgggactagaggcgcctgccaccacacacggctaattttttgtattttcagtagagatggggtttcatggtgttagccaggatggtctcgatctcctgacttcgtgatcagcccggctcggcctcccaaagtgctgggattacaggcgtgagccaccgcacccggctggattttggatttttagattgggagtgctcaacctttaataacaatattaaaaaattattaaacctctaattactgtagcacatatcagaagatttctcttttatttggtttaagttattttggagaaataaaaattgtattttttgtgtgcatgatcttttgaaatgtgtaaacattgcgaaatgcctcaaccgagctacatcacataaacatttatattctatttgattgtgtgaatctcaccaatctggaagtcataaaataagccaattatatataatatagtttatatatataatatataatatatataatatataatatatgttatatataatatataatatataatatatgttatatataatatataatatatataatatataatatatattatatgtttaatatatttatatgtttaaatatatgtataaacatatatgtataaattatgtataaatatacataaaatatacataaaatatgtatattatgtatatttatgtatatgtatcattatgtataaaatatgtataaatatgtgtataaacatttatatggataaattatgtataaacatatttatatgtataaatatgtttaatatatataatacatattaaatatatatattatataatatataaatttatattatatattaaatatataatatacaatatatattatatattatatatattatataatatacaatatatattatatattatatatattatataatatacaatatatattatatattatatatattatataatatacaaatatatattatatattatatataatatataatatacaaatatatattatatattatatatattatataatatacaaatatatattatatattaaatatatataatatataatatacaaatatatattatatattaaatatatatattatataatatataaatatattatataaatatatgtaaatgtatataatatgtattatatattatatataatatcctatatattatatataatattctatatagtatatataatattctgtatagtatatacaatctgcatagtatatataatattctatatagtatatatataatagtctatatatatattagaatgtgcatttaacttgaaaaggttgaaactctaaagtactccccagataactggtggtgaattgggagccagatgatgaagtggcagcagaaagtacagctgaccatgagtacagggtctagaagaatattgtaatacatctacatctcttcaagaacacaacaagttggcgttatttagcaggagggcaggatattccatggtctccaaatcttggaggtcctttctgcactggattacaattctgaaactcatcatccatatttagaaaagtggagacagtgaattacattttacagggattttacccaaaaatggttaaaatgacaaagtctctgtgcttcagtatattagccttcataattttcaacacccaacatttagttttttatctcattcccaggatgacatgtttgactgaagtatctaagacacctttaggggtagactaaacttctgccactctctcccaacaaaatatctgtgtcatatgaatgttgtaggcctgccattgtaaaagagaaagtaatcaagactttaatgggattatttttaattgtcttcttgcatataaaaatgaaatgacaggttctgaaaggaaacttggcatttgggaaagagggtggaaaaaccagacaaatgtaattatcctaaactgttttaaggtacatttttcctatgctcatgtaagaattaaaattagtgttttaaagaataagttactggtaaatcgcatggcaaaagaacatacatgttcattttttcttccttatttcaattttctgagaaaatttaagtagttatttctcaggtgagttttaaaattcatccttagagattggaaactcaagggccacgcattgagacttacacatttattataataaaatatgcttctggcatattaacttttactaccatgttgtcaaacttagaaatattgcagtggaagcaaaaccaagaaaatggctatcggtatgttctttgatgaatgaaggtgtgtacacatagattgaacaaattttttacactaatttatataatgtttagccctttaatgccaaatattacacatttaatgttgtcttattacgagcactcattccggagtacaaaaaattgagaggaaaaacaaaagagacttctcttcgctattgtaactccatgctggtttggttggtgcaggtgtttgggtgatggccaccattttggtcttgtcagttacttaaggctgtagacaataaaggttgcattcctgaaataaagagttggttctctaatcttgtggaaagaaccagtattcattttctaccaggaagcaaaatgccaaggtcacagggacagaaaatattgcttcccaagaaactgtggttgacaagatggctcgagttcaagtgaatcctgaaagtatcagtttccaaggagacctgtggccccacccagccacctacaaagcttagccatcgtttcactcagagcagcagccatttcttgcaaactggcagctcatttctggatactcaataggatgcataagaatgataaatttttttcaaatcatgtgcgctagctctgttgaccttcagctgtgctgcgccttctttaattggcataaatcttggactgcccattggatgtctttctggaatctgatgtctttctgtctatctgattcctaagaggaagtgaaatattcaattaaatagtttcgttgagtccttgtagtgctaggatctttacaagagcggtttagtaggtgttgagatagactatctatcagcttcccttcccaggagaacgtgtcctgttagaaattgcatcttttgtggccagtaggggtctgtttaattgactgaaatagtaatgacccggaggaattaagacagtttttagaaacatcttatattgagaaggaagaacaataactatgataaaattatacaaatacacaataataataaatacacataatttaaagattacaattgtgggccgggcacggtggctcacgcctgtaatcccagcactttgggaggccgaggcgggcggatcacgacgtcaggagattgagaccatcctggctaacatgatgaaaccctgtctctactaaaaatacaaaaccaaattagttggtcaaggtgttgggcgcctgtagtcccagctactcgggaggctgaggcaggagaatggtgtgaacctgggaggcagagcttgcagtgagctgagatcacgccactgcactccagcctgagcaacagagtgagactgtgtctcaaaaacaaaaaacaaaaaacaaaaccaaaaaaacaagattacagttatgacaggtattttgacccctaactatgtgtcagcactctgtatagcttatctcagtactaacactaacacccatatgatgataccagagcttttaaccccattttctgaaatacagaaactaaagaacagataagttgctgcgaaaagccatataaatattaagtggtagagtcaggattttaaacagggtacactggtttctttcttaatgtattttgatccacatctacaggtgaaattcaaatgcagcttattgaattttctctcaaatattatggtgaattattttattatcttagtgtttcagatacgccttttgccacatttcctcaagaagttgatatactattaagaactaggctatatttttaattttttgttaatttaaatccttcatagaggccgggcatagtggctcacatctgtaatcccagaacttggggaggccgaggtgggcggatcactggaggccaggagtgtgagaccagcctggccaacatggtcaaaccccatgtctgctaaaaatgcagaaattagccaggcatagagcaggcacctgtaatcccaggtacttgggaggctgaggcaggagaatagcgtgaacccgggaagcggagattgcagtgagctgtgatcatgccactgcactccagcctcagcgacagagtaagactccattgccaaataaataaataaataaataaataaatactactttatagagccagtgtgggaagtaggtacattggggtatatcacatataggaaacactgggcaaatacttgtgaccctctagaaaggaataaaaaaactccttctgaaggatacaagttccagttctggtttttccttcagttggccttgaaccagaatacgttctctgggcctctctgactagtccctgtcatgttctagccccatcttaggattaaggccaagacccaaaacaagcaacatgaacatcagaacagcaccagaaaccccaggtaggcttcgcagatgaaaataatgactgtggcagccatgctactcaaatggaaggcctgctttctttttagaaggaacctaattggcaagtaagttgctatctgacttgatgggcgtaaactcaccgttctgcatcccactttcccgatcttcacttcagttgcttaaatggagtgcactaaacctcaatttgataattgcatcctcaaaacctttaatgaaggtgcctatcaaagtgtaaataattaccccgtaatcttgtatttgcaaactgcatcttggctgtttacgcttcaccgaggttcaaatcagaggttcagggcttccccagccctcacattcctgttgacgtcagaggaatttcaaggacctagaggacagcattgtaacacggttcaaccaaggcgttcaccttcactccctcccaacgctgacatctgtcattttctggtgctatttataaatccaagggagcattgctgttttgttttggtgctggtgatgcagacactcatcctcattagaatttttgccctgacgccgggcacggtggcccacacctgtaatcccagcactttgggaggccgaggcgggcagatcgcttgagcccaggagtttaagacaagaccaggcaacaaagtgaaaccccgtctctactagaaatacaaaagttagctgggtgtgatggtgggtgcctgtaatcccagctactcaagaggctgagacgggagaatcacttgaacctgggaggcggaggttgcagtgagctgagatggcaccaccgcaattcagcctgggtgacagagcaggactccgtctcaaaaaaaaaaaaaaaaaaaaaaaaaaaaaaaaaaaaaaaaaaaataggttctgccctgagcctttcaggcctggccttgttgctctgggacttgctccctcctcgctaacgtgtttccttctttggagattacccactttagctcacctggggaacacacacaccactgacccagttagggcttcttccagcctcttctcttttttccattcttttgactgcgttaattattcacaggaacccgtcaatgaaagcaccagggattatccaggaggctgaccaccaaattagaacaagaaaatacttgaaacagtttgcatgctgtctgagggtgcagctacggagagggtatgttttaggtgctggggtctgagagaaatgaaaagagacgccaagccaggtgactgacagaaggcaggcgacaaacccaggcttcccaggctcgtactttctcttcggtgctgtatttttcagcacacaaacttgctgagagtttgcagctgacatctcgagaagtattcttcttaaaagctgagcgaaaattattcacctcatgtgaaaacaagtgcgatttacatctaatgtgggtaattacttttacagttaattaaaagcgctctcattaaactcccgctgtgatgccaatgcatagctcttatttgcaaacagacctttggtttgagctcacctggtgacaggagactcctacctgaaacagggatgccgttctcggtactatgtttaattgtgctgagccagcaaccctcgagttacccggccttttaccccacgccagctctgcttgtctgcatggctagattttgagatatggaagcctcttgtcctctcataaccacactccaaaaaaaaagtaaggtgaagaaaacaaaataactcacaggaggtagggatgccaaagaaaggtaggggactcaaagaaagaagtcaagatgaaaagcctgctgtctttatttgcataatagtttggttggggatcgttttgtagttgttctggctttacagctttttcctgcctaagaagatatttactgtcagagaaaatatccccttaggccccctgaagattcctccaaatgtttataaagtcagcagctctgccctgcaacctacccaactaaggtaaactttactcccttggttgaagtgatttgtgttgagattttacttagtttacatgcgttgtttgctgtttgtatgatttcaggtgaaatagctcttacatcgtgagtcatcttcatatttaggttgaaaccatagacttttcggaatattctttgccctgaagcatctctgccacgctgaaccttcttaaacacatattaatgaaatgtctcctcaaatgatcacattcctagtaagtaattagggcttagtaattaaaacatgcagtcatttgagacttaaattttgaaggcacagaaagattgagaaatttaaaaagtttacggacctgatgaattggatactcttgcataggacttggtgctttcggtattttttgcaaagttatttgctcccatctgctggccatttgtgatattgcaggtgctgagctaatttgtgaatggaaaaggaagtgaataaaatctatcactgcaaacattttatactattcttcatgtattcaagtaaactgatttgaatcttggtttttgtttgtttgttagttttgttttgttttgttttgtttttgcggttggaggattaagtgaacacagactctgaagaattctgctgaaaggcaagcatgatttgaaatttttaccaacatcagagttactcaagttttgaaagccagaacaccctcgttatctttaataaagcaattaactttagaacattggtttaaatattcaaattcaagcacagtatattgtgtaagggagagtataaaatacatagctcgtagaccagatggatttcaatctcccttatgcttttaatcatcggagtggtaggaagccaattccctacactctaaaactcagttttttcacctgtaaaatggaaacactgggcaaaagggtccctaaggcttgaacttattctcaaaatctgagtctttgtgaaggttaaaaaatcatataaggctgagcacgctgggtcatgcctgtaatcccagcactttcggaggccaaggtaggtggatcacctgaggtcaggagtttgagaccagcctggccaacatggggaaaccccatctgtactaaaaataaaaaaaatagccagacgtggtagcatgcacctgtaatcccagctactaggtaggctgaggcaggagaatcgtttgaacccgggaggcagagtttgcagtgagccaagatcaccctactgcactccaacctgggcaacagagcgagactccatctcaataataatagtgtaggttgcataaaatcaccagtatgctcttagtcttagcatctaaactcatattcagtgacttgtcttaaattagaagccgttgttattttcacaacaataggcaatgtaagcatgcatccaaactatcagaaagcttgcctttgcaaaggagaccatctgtaatgttgagtcaagatttaaaatgcaccttgaatgctttttggagtgtgatgtcaaaaatgtatcttgtgttaatattataaaccgttctgctataacatttatttgctgtttaagaaggaagagcaaaaccttcttcctcagcagtaatcaatttctcagttgatcataagccgatttgggcttgtcagatgaacctttgactgtgtctcctcacactcctgagaggtggcttaagctgtcctgtatttcctatgaaaagctctctgggactttgtatttgagtccaggagaacaatgctgtgcccaggatatgtgatccttacttagcttctcatgacaagtctaagcatcctggtcttttctttccattgctcttccagagtgaatgactgcaataatcaatttagaggttttcaggggctgtattgtggaaacacctgggccctggagcacagcagcctgtgattgccctgggattccttttaaggaatttttcttgtcccctagagcttagactaagcggaggtggcctctggaccacagttatcttttttcagtattaagtagccaagcatcctgcaagagagatcagcacaaagagctccttgatcctctgtatttattttctatgacttccgtagcaaatcatcacaatctaggtgcttaaaacaactgaaatatattctctgacagctctggaggctctacgtccaagttgaaagtgtgagcaggacggctctcccagcaaaggttctggggaagattcatctttgcctcttccagtgtctggtagcttagtgtcacatgacttgtagcagcatctctctaatccccacctgtcttcacatggctttctcttctgtctcttaaaaggatacttgttactggatttagaacccacccagataatacagaattttctcatttcaagacccttaattatgtctgcacagactccatttgcaaacaaggtcacattcacaggcactagggactagtcggcttgagcatatcttttggggggctgctgttgaaccccgtgctggctactcacttctaaatcctctgaggtctcgggagcttcgttgtccggtgtttctctccacattttctcgggaatctttaagtgccagatacttcagagctgggaatgctgctggtaagggatccgggatgctggcatccttgcattgtgggcatgaataaccctgacctacaaaaattatcaaaaacaaccaacacaccaagtgtagaagaaaagaagtctctctcgggagagagaactgcttctgaaaagaacggacacatgagtgctttgatgtctaaaatctcaaagaacctagaggccttggaagagaaaactttaaaaatagacatgtttttaagttctcaatgcttcaatcagaaccaggtttcacaaagcctgttggaagatgtcatcaaggacagctgacatttactgataacttgccatatgctaagaccctggcgtgtattggatatgcctagccacaaacgaggcaaccatgattgttaatatgcttctcttacaaatagggaaagtgaggctaagcaaactcggcctccttgtgcagagttccaaaactggtgtggttgagtccggtaggataaaccctagcagtgtgattctgctatctgtgtggaatcccatctgtcgccagcaagtgagcctccgctgttcagggtttcccggctacaaaaagtagaagggctgccttctgtcgggaaattgattgcttggtgatgagtccacagctcaaaattcatacttaacacttttaagtagttgagctgttttccaagcgaagtggtcgagtggggctgaagtacttacttgacgagtctggttcagaaaaggtcaggtcggaacccacccagagacaccggctctaggcagcgtgatccgaacaataatttgttctcgccaaagtgacatttttccaatttgagtccagcattgttcagaagcaaatgcagtcccctggggcgcctcccgcatagatctgcagcagatgacaaactaacaatatcatctaaataaaaaatccagcatgggtttagtaaattaatcctgacaagaataaattgaataatcttagggaaatggcgagagctctgattctgccagatcgctcttttctgtcgcttgcgtgggtcctcggtggcagattaagagcaaaaatctgcctttggtttattgatttcgttagttcgttgattaacacctgccacttctgtgtgggtaaatcataatcggatatggactcttcctggcaaacttaacatattttcactcaaggagagaaaggaaatgcttatttcacctggtcagaacgggcaaaagcagacagagagctgcttttcctcacctcgtttctcagtggtattttctaggtttaaaagtaatctgtgattttcatcactcccatattgagttaatctcccgtttctgtttaggttgcttagcagacaaattcaaggagagtttttagtaagagtgaggggtgtttttcctgactcagtgtccgaagtcaagcagagacttcagccattaatttaggagacagggtgagaaaaggaagataccgcgtgtacacatgatcccacgtcctaggactgggccttacaggtcgtctgggaaccttgtcttagtcagcctgggctaccctaacaaactgccatagactggatagcttctgaacagaacatttactttgtcatagttcttgtgtctggatattcaagatcaaggtgccagcagtgtcaggttctgatgagcaccctcttcctggcttgtagtcagtcattctcactgggtcctcatttggacattcctgggcttacgctaccagagagagagagagagagaaaatgagtgagctctctggtgtctcttcttaaaaggatactaattctttctttattttattttatttttgagatggaatcttggtctgttgcccaggctctagtgcagtgacgtgatctcagggctcgctgcaacttccgcctcctgggttgaaatgattctcctgcctcagcctccaagtagctgggattatagatgcccaccaccatgcctggctaatttttctattatattgaaatccaatggggtttcaccttgttggccacgttggtcttgagcccctgccctcaagtgatatacctgccttagactcccaaagtgatgggattataggcgtgagccaccacacccagccaagggcagtcattcttaggacctcatttaaccttaatcacttccttagagttcccatctccaaatacagccacactgagggttagagctatgacatatgaattttaggggggacacatacattcagtccatcatactacgtgttaaaaatgttgattctgattcgatgtatctgggatgaggtgtgatgtgttgcatttttttttaaagatgggatcttgctctgtcactaggttggaatgcagtggtacaatcttagctcactgtagccttgactgcctagggataagtgatccccttctctttgttttgaaacagagtcttgttctttgttgcccagtctggagtgtagtggtgcaatctcggcttactgcaacatcagtctacagggtttaagtgattctcgtgcgtcagcctctctagtagctggaattacacgtgtgtgccaccatgcccagctaatttttgtatttttagtagagacaggggtttcattttcttgcccagacaggtctcaaactcctggcctcaagtgatccacctgccttggcctcccaaagtgctgggattacaggcatgagccactgcacccggcttcaagtgatccttccatttcagcttcccaagaagctgggaccacaggtgcataccaccccacctagctaatttttttcttctttattattattttttttgtagagacactgtctccctaaggtttccaggctggtcttcaactcctggactcaaacgatcctctggactcggcctcccaaagtgctgggattataggcatgatgcattttaactggctcccaggggcatcgtacttgctggggttgcagactccacgttgactaggaagttcctcatactccccttatgtgcggatgagggaaatttgctgaaggaccgcatggttattaaatagtaacaccctgctttaagagtctagtgccgtgagtctaatgccaggagtctaatgccagaactggaattacccgcagccctgtcctcccacccttcagccttcagtccactgccacatcccctggagggcttggtagcatgcatcgacgggccctcaccctttgaattttggattcagtaactgagggctcttccgtgcaaacctcatatttttcacttcaggagagaaaggaaatgcatcacctggtcagaacaggcagaagcagacagagagctgctttttctcacctcatttctcaatggcattttctacagaaaatacagcctgagaatctgggtatttttctttgcttatttatgtaaactgacaaaagttatatatatttatcatgtacaacatgatgtttggaatgtgtgtacattgtggaatggctaaatagagccaatatcatatacattacctcacaacgtcatttttttgtggttagaacacataacatctactttcttagcaattttcaagattacaacatgttgtgaactgtagtcaccatgttgtataatattttaacttattcctcctgtctcactgaaattttatgtctttaggcccagatctccccagcaaaccccctggtagtgagggtagtccctgccagcccttggtaaccaccattgtactttttagtatattttttgtatttgtttcatgcagtatttgtctttctgtaactagctcattcaacttaacacagtgttctccaggttcatccatgtcatcacagtgacaggctttccttctttattaaggctgaaatggtattctgttgtgtatatataccacatttgctttatgtggttcttccttgatggacacttagttttttgctttttgttttatttcagtaggtttctggggaacaggtggtgtttgattacatgaacaagttcttcagtggtggtttctgagattttaatgcacccatcacccaagcagtgtacaccgtacccaacgtgtaatcttttatccctcaccactccccgacactttcccctgagtccgcaaagtccactgtaccattcttatgcctttgcttcctcatcgcttagctcccacttatgaatgagaacatgcaatgtttcgttttccattcgtgacttgtttcacttagaataatggtctccagttccatccaggttgctgtgaatgccattatttcattcatttttatggctcagtagtattccattatatatgttggggaagtattttattacatatgtatatataagatgtagtattccattttatatatgtaagtatatgcatgtatattgggtaagttttctgttatatatgtatagtatattatatattgtattcatctatgtatagtattccaatataccacactttcttttatctacttgtggattggtgggcctttgggctggttccatatttttgccactgtgaattgtgctgctataaaagtggggtattcagtttgattccctatcttggctattgtgaataatgctgcagtgaagaaggaagtgcagagatctctttgacatacggatttcatttcctttgagtgaatatgcagtagtcggattgctggatcatacagtagatctgtttttaattttttgagaagcctccacaccgttttttgtaataactgtaagaatatgcctttttaacagcagctgatgctgctggttggagagtctcactttgagaagcacatgtaccttgcttctccaggtttttttgtttggttgcttggttttatttttatttatttttttctttttttgctgtgaataaccccttcttcccatagcaaggaaaagaatgaaacctgtggataaattatgtggactgaccaaaccaccttgaggaaaataaaattacctggaggaaagggaaagcacctgatgagggatcacttctggttacagatttaagctccctcattgtgtgattcagtatgagttacctaatggctaatcacaattatcatgccacagagtaactaaggaatacccactttgtcgaatgttggtaatttagagacagtacgaaaaacaccaagcacagttcctggcacgaaagaggtatttaatcattgctcaccggttcagtcccacttgactgataggaaaacagtctgttctacataaaacaagatatttgctatacgagtcttcaccttatgatattgtctctttttgttccactctggattcaaagggacctagaatttgctgtgtttactaataaatcaccagcttctcatattaacctttcctaatgatgcatccgcagagaaaaccccactgcctcttggtgagaaaatcaacatttctgtagacttaaccacaatggagtccctaatgttttttggttgtttaattgattggttggttgttttttggaaacagagtctcacttcgttgcccaggctgaagtgcaatggcatgatcccggcttactgcatcctccgccttcccggttcaagtgattctcttgtctcagcctcctgagtagctgggattacaggcgtgcaccaacaagcccagctaattctgtatgtttagtggagatggagtttcaccatattagccaggctgatctcaaacacctgacctcaggtgatccacccgcctcagtctcccagagtgctgggattgcaggcgtgagccaccacacccggcctggaacccctaatgtttgtaactccctacacaaccctgcacatccatgccctccctgcctccatggagagcatggccaggctacagaccgtgcaacggccccaggtcgccatctttctctcccaagctgtatcctttctttaaagacgtcccattgattttatctggcctctgactacttctctccccttcccctgctacacccttatccatccaccatcatgtcacacctggactcctgtggtagcccccaaatttttctccctacttaaatttgtaacccctgactgccggttctgttaaaatagaagtcagatcatgcctgtcctctcttcattatgcctgagtgaaacccacaagtgcccatgaggatgtggacagattggaacacttgtgcactgttagtggggatgtaaaatggtgcacctgctgtggaaaacggtagggtggttcctcaaaaaatgaaacattgaattaccatagggtttggcaatctcacttctgggcatacgcacaaaagacttgaaagcagggagttgaatagatacgtacacacccgtgttcatagcagcatcattcacaatagccgaaaggtggaaacagcccaaatatctatccacagatggcgcttatgaatggataaaccaaatgtggtctctccatacaatgcaatgttattcatccttaataagaatgaaattctaacacatgctaccacatggatgaaccttgaagacattatgctaagtgaaataagccaggcacagaaggacaaatgttgtatgattccacttaagcaagtgttaagtcctcaattgtataactgtaaaattcatatactgaagtcgtaacttccaatgtgattgtgttttggagattagtcctttagggaggtaattcaggttaagtgatgtcataagggtggggtcttaatccaataggattggtggccttaaaagaaagatggccacaccttacggtggctcacacctgtaatcccagcactttgggagggcgaggcgggcagatcactaggtcaagagatcgagagcatcctggccaatatggtgaaatcccatctctactaaaaatacaaaattagttgggggttgtggtgcatgtcggtagtcccagctactcgggaggctgaggcagaagaatcacttgaacctgggaggtggaggttgcagtgagccaagatctcgccactgcactccagtctggcgacagagctagactccatctcaggaaagaaaaaaaaaagccatgggtctgtctccctttctctctctctcagaaagtatagagcagcagctatgtgaggcaccatgagaaggaggcatctacaagccaggaagagggacctcaccaggaaccctgagagagccttgaccttgaacttccacctgtagaactctaagaaaataaacttcagtcgttgaagtcacctagtctgtaatattttttatggcattcctagccgactcatacaatgagaggagtctagagtagcaaaatccacagagacagaaagcagaaggtggttttcaggggctctgggaggggaagtgaagagttattgtttaatgggtacaggtggaaaaatgaaaaaattctggagatggagggtggtgatggttgcacaacagtttgtatgggtaatgccccagaactgtgcacctaccatggtaaaattgttaatgatattgtattttatcacaataaggtaataaaactctgagtggtttctcactgatctcaaaataaagtaaacatctccctgtgatctcattcccctttattttcctctcttacttccctctaaccacagtggcctccttcctcttgcttggctctttccagtgcatttcccccttggggctttgaacttgctcttcgtttgcctgggatgttctcttccccagtgggctacttggctcatccccctaacttccttcaagccttttctcaattgccactttttcaaaaaaatcaacatcaacatcgtattcccctaccctcagcatttcccacccccttctccttggtttatttttcttcatagtacatattctttctggaataccattaagtgatatgcatggtttaatgcttgtcttgtccagaagaatgtaagcatcaccagggcgggcctgccatgtgtcttctacattgttgagtcctccatgcctagtgcaaggtctagcagccaagagttgctaaagaaatatcttccatttgaataagttaatgccactattgcttgtgggactgtgtctgtcattttgtctaattaatgagttccctgagggtaggaattatgtttgtttcaccttttcgtaccaggacaacaagaaaatagcagaaaatcataggtgtgcaataaatatgaatgagtggatgagtggaatggtagatggatgggtggatggatggatgaatggatggatggatgaatgggtgggtggagggatgaatggagggtagatgaaggaaggaaagatggatgaatagatgagtggatagaggatggatagatggatggatgggtgggtagatgaatgggtggatggatggataggtgggtggatggatggatgagtagacggatgaatgggagaaggatgcaggatagatggatgattggatagatggggatggctgggtggatagctggatggatgaatggataaaaagatgaatttgggtggatgggcgagtgtgtagatgattgatggatagagggtggatgaaggatggatggttggacggatggatggatggatggatggatggatggatggatagaggaagggtgggtgggtcaatgaatggatagatgggtggatggataggggaaggatgcaggatgaatggatgattagatcaatgggcatggctgtttgggtggatggatggatgggtagaggaccaatgaatgaatggagaggagatgaatggatggatggttggatggttggaaggataaaaaatagatcctgataatttgtgttgaagtgagacatatctgactatcctaaattttgaatgggagagatattaaaggcagtctctgctgatgtgaacaattgtatggagggcagattattttatgagctatcagttcctctttgctgtgacctctgatccatagcctttgcctacattccacatctgcatgtaataaaacttacttatgagatacatatgtctctaatgcaaacaccgcagtatgtacctttaaaaagcactataaagagcaatgactcgagaaagaactattaggagcatgagctctttattattttaaagggcatttcaacaacaccactgaatgttctctgaccataagtctgactcctgttctttctctcactttcctttcttttcttctcttctcaggatatcaaagcagactgcaatacctgcgtggaaatagaagacagaaaggtgagtcaatatttttcatttttagggttgcaaacaaaacaagaactctgtgaattgaacccaggtgtttaaggcatgcccctctcgatgatggtttttaggtgattcacggtctatgacatatttaaagacaatcagacttaaaaatgcttgtcattttactcctttacaatctgtgttacttctgatggcttcatgaggagtgcatattgtaattttttacaaaaaatgtggtgctgatttctgtttcagtcatacccttcttttcaggaaaatactttaacacttgtcacattgaacttgaatattgatgttgacgttcattgtgtgtatcatatgtataattaattatattattacttacattatagaatatataatattaggcttcccagggtgtgtccctatatatctgactcatacacttgaaaaagagctcacggccaggtgtggtggctcatgcctataatcccaacactttgggaggcagaggtgggtggatcatctgaggtcaggagttagagaccaacctggccaacatggggaaaccccgtatctactaaaaatagaaaaattagccgggtgtggtggcacatgcctgtaatcccagctacttgggaggctgaggcaggagaatcacttgatccttggaggtggagactgcagtgagccaaaattgcaccagcgcactccagcctgagtgacaaaataagcctccgtttcaaaaaaaaaaaaaaaaaaaaaaaaaaaaaagagctcgcgctcaatttccatcacaacacatcaacacattcatatgagcaacagcgtcctatctgagattaagggggtagggggcaatgccattttctacatatttagagtcccctcacccatttatcttctttgctacacttaatgtgaatcccctcaggaaaagcaaccgttagacaattgtttgttaatattttcacagtctctttttattgacaagagttcacagacatttctgcagcaaagcacatccaagaagatcagattttaccctgtgtatgccttggatccaaagaggtcaaataagcaagttaagagtacatacctcctggctacttttgacatcgttccacaagtttgaaagatgtttctcctttcaagtgtaccattattgtcaaatgggttattatttcaagcagaggttttcagctctgattgtatcatgactggggcatgtctgctgattaataaggtggtggaggacttctcaaaacaaaaatttgcttttaaataaaaagcagttgccacacattattttagggagtgttaatctcctcacattgggaagaataatgatacagtaagttcaattcaatctgcgtgatcccagcttgcagttttgtgttgctctagtttgctggcaaaggaatttcaattcatgtttgcattcaccatgtgtttgcatgctggtatatgcatgtgtgcatttagtgagttggacagatggaattgctgcttaggtgaagcgtgtgtccaaagtcttctaccaatgttctgcccagccgaatcattccgctcatgtcagagtgtttagaaagcatgttccccaacctgcttccaaaggtcattggcatttctcttggacttttatggaattcatcaacatgttttgtccggtatcttttttaaaaatttaattgccaatagtgcttgaaagataacataggaactgatgctgttagaacaacctgagctccatcacgcacaaggtaaataagcaggcagggtaagctctgggcaaggagagtcacccaagctccactccacctatgtgaactgcctttggttaagacatcatgatgatggcaactgccctggtttctggctactctgtgatgcatcttggtgggaaaaagtcattaatggtcatactgtgcatatgtgatttcagctcttctcaagaaaggggaaaatagacacacacacacacacacacacacacacacacttctagttttttcataaattgttggattgagtcaataatgtcaaatgaagccttgtttctgatgagttttcccatttttttctaaacttgacctcatatgactgatagataaatttctaaacaatttgttgcagttaattggtgatgcatcttagtgataagaaaaaataatgcccagttaaaattctcagtgtcttactctctaaggactttttttaaaaaagagtcttttaaacaaggtaactcctctcctctcctctcctcccctcaactctcctctcctcccctctcctctcctcccctctcctcccctttcctctcctcccctttcctctcctctcctcccctttcctctcctctcctcccctttcctctcctctcctcccctttcctctcctgtcctcccctttcctctcctctcctcccctttcctctcctctcctcccctttcctctcctcccctttactctcctctcctcccctctcctctcctctcctctcctcttctctcctcttctctcctcttttcctccttccctttttctctcctcctttccttcccactttctcgtcttccttcctccctccttccttccttctttttccttccttcaaattcccagtaatacagtgaatcttatactcacgctatagtttctctgtttctaacaattgttaagaagagattgggagtgaggttttaggagcttgctttatatatgggagacatttctcttaattgaacagtcaagaagcaaacgctaatgatccctgagggacggcgtgcccctcaccccagcagaacagctccatccccctccctctctgcttggtgatatggtgtgaggccacacagggagccattggctgtggcagccagagtgattgccgtcaggttctgggagtgcactctggtgcctctgccacactgatgggttgtttaggaaatttcaccactggagtgatgacagttgctcacgcacgtgtgtgtgtgcatgtccctctccatttaacccaaatgcttctggcaaaatcagtaatttgataaagtggaattgaagtgacaagagatggcagaggtgccaaaataataagtaaacctgtctctgaagcggcagcctcttggcctatgtggatttttacgactgttgagagctctgaaagagaactggtggtgctttctttaaagctctttttattttattttattttattttactttagttaagggagcttcacagaacccctataggatgtgatggcttctcaagaatcactttattttttattattttttatttttctttcacctcccctggctttctgtctacttcgtttccagatattccacatatatggatatatttgtgtacctcgatttatagctatgtatattgttgaatatcttcttgatagaagaattttagaaaagacaaaaccttaggttttccatggagtcctacggggcctctccaaattgtgcctcattcccattctcttcctttcaatggggccgattatcttgagatgaatgattttcccactgaatcttagaccacatatcatgatagaagataaactgtgaatttcaacagtggaagagagccttcatttttttttttttttaacagtctccctctgtctcaaatctggattgcagtggtgtgatcgtgatctcagctcattgcaacctccgcctcccgggttcaagcgattctcctgcctcagcctcctgcctggctaatttttgtattcttagtagaggtggggttttaccatgttggccaggatgatcttgaactcctgacctcgtgatccgcctgcttcagcctcccaaagtgctgggattacaggcatgagccaccacacccggccgagagccctcatcttgttgtagagcaataaaatcattcttctttatctgcgcacagtctgggctcgatctgagactcttcatagaataaaagaatttttatcctctcctgtttttctatttttctttatcccagaagcctattttctctcaggctgacaggaaactaattgccatttggaaaaccttgcctggctgtttatggggaaattcataatgtgtattggagtgtggctttatgtttttctttcgcttccaagcccgccaattagcagagcccctatgaatgtacctgcttggatggttcctggccattgcttaaactctctcagagggtgtcctagggagatcctaagggatggtggagtttttcaccctttaataggaagcaggagcacaggttttttgtttttttgttttttggtttttttgttttttttgtttttttttttcctcctgcaggtgaacgttgtggagctaatgcagatttagcaaaggtgacgggaggtaacccatcacttggagtggctgtatggcctcacaaaacccgatgcgtttgacatttacagtacctgtgtttctgctggggcactgaagcatttaaattcatttttatttgtggtgtaaaatccacctgaatttcaatactattataaagactgagattcaggtgatgagaggagaggctgatggatcagtcagggggagaatctgtcaagaggagacgagagcccattttataaacacagacagggcttcctcttctcacttatcgcctggcctggtgcagctaaacagtttcagatctgctataaaattgcatgaaaggagtttgagtggttttccaagttatggcgactttcagattgggtccaattgaaggtgcgattgggagatagctttcgtgctgtggttaacactgagagttctgaactcatctttttacaatacttcttccagatcaggtatcttaagtaccgccgaatacttaaaacagttgtggtgtggaagtaccatcattttccctgttttacaggtaaaataaaggaagctcaggcacatttaagtgacttgcctgagatcactcaagcatgagaccaggatttaagctcagagattcttactccagagtctgtcctcttagtttcaatactaccctgcttgcggttttcaatatggggcaggctttcagctcccacattgcagctctagctggttcacagtgaggattcttcacagtgtttacaagcctgcccttccgggaagtagttggcacccaacagtggggtggtcagatgtcttctggctttgagggtgagggacagtagcactggaactggagtgctgacctcagtttccaaagacctgattcggttcctaggtttggcaatttcagcagagtagatacacgggttagaaattattgcttaaagagtattagggaggctgggcactgtggctcatgcctgtaatcccagcacttttggagggtgaggcggcctccaagatcaggagttcgagaccaccatggccaacatagtgaaacatcatctctaccacaaatacaaaaatttcctgggtgtggtggcacacgcctgtagtcacagctacttgggaagctgaggtggagaattgcttgaacctgggaggcagaggttgcagtgagctgagatctcgccattgcccttcagcctgggcaataagagtgagacttcatcttaaaaaaaaaaaaaaaaagcaagaaattcttgcttaaagagtattacggaaaatagctaatgcatgctgggcttaataccttggtgatggattgataggtgcagccaaccactatgacacacgattacttatataacaaacctgcacatcccgcacatgtaccccagaactaaaaataaacataaaaaagtaattcttgcataggtaatggttagtagctcagacaaattaagtcacttgcccaggattattcaggacgtatcatgaggccacgatttgagctcagagattcttactccagagtctgtacatagcctttggagcttgaaatgtctgggtttcaatcccagccctcccaaatagcaactctgtgaccttgagaagctttcttaccctgtatatatcttcatctgcttatctttaaattgggagtgatacaatctgcttgaaatattggcttgagaaattcataatactgcaaatcattttatataatacctggcacaaaataagaactggattaactgtagctgcggttatttttatttttgctggtatccacacctacaggcctaccatgtcatttataattacatttattttatcaaatgaggccctggaaagtgttaggggatctcaggggagtatgcaaccaatgggacctagtaggccttggaaatatttcacaaaggaagaggatccttggtgtaggtcaggaaatacaaatgcacctgcctgccaagtccaggtaggaaataatgaattaatgaagaggcagaggagtgattgtctttaacgtgaagtcctatgtactgcagcgacctggaaggtgataccttcatatcttgggagctgttattcagctaaatgtggccatgtggaatatagattcagtattgctgttttctaagccaatctgaattttcctgtaataccactgattttttacttactatgagcaatccaaatgaagcacacatgcagaaaagtttcaagagacttacaagacttgagtgttgaaagctaactctcagtgggttagaaagagctcccatgtgcctaattccaggctctgtcggtctatgaaaggccctcctggcagagggaacagaatggcgaggacaagacggtgtagagaacatggtatgtttatggcgaatgcaagtccagtgtgtgtgtctgagattggctaaaggagagactacagcagtgagtaggtagcaggttatggagggaatagtttatcaggccaatgcattagggttctgtgtcaatcctctgtccccacagaaggcaaatctttactgtatggggccagagttacacagcaccaagaaggtacttaaactagtatgaagaacccagccaaagtgaaagtcagcaggggaataagaactggggttggagcccagagaaagacccagagactggccctgggtgaatgcaggaagctgaacactttgattcgagcaagacgaagtcagccaggaccctgagaaatcacagggctgggttgccccttccttgtgatgtgtgacagaatgaacatgggaatgcaactgtctctttgaaatgttgatttagcggcgggatgcctggattatttggtagttcaacttctaattttttgaaggacctctatactgttgtgcataatggctataaggatatatgagaatatccattttaacatcatgggagttctacaatggaatattatttagccattgaaacgaagggaaatcctgccatgtgcaacaagatagatgaacctagaggacattaggtgaagtgaagtaagccacacacagaaaggcaaatactacatgagctcacttttacctggaatctaagaaagtgaaactcaaagaagcagagagtaggatggtggttgccgagggctgggggcggggtgaaaaaaaagggaggatcttggtcaaaggatacaaaccctcatcatcagattaagttatagataactaatgtacagcacagtgatgagagtttaattaatgtgttttagacttgaaatgcggtaagagagtagatctcaactgttctcacacacacacaagtctgtgagatgatggatatgttaattagcttggtagtagtaatcatttcatgatatacacatgtatcaaaaggtcacattgtatctgttaaatatatgcaatttttgtttttcagttttatctcaatacagttagggagaaaaagagagatgtggaatagaagaggaacacattttcctgcaggccggtattgtacaagtgttgaaacacttagattagatttcaggtggcaaatgaggtaccttcaggcagttcatggatatggtatcaaatcacgtagtagggaagttatttccttgtcaactatttctcagaccttgagactacatcaaagacataatttggtggttggttaaaaaaaaaagaaaaaaaacctaaaagactcaaacatttgatcatctacctttttgaccaagagacccagagcccctgacaggcaattctggcatctggctataaccgaatgacagtgttttacttttgcattagagttactttctacatatgacaaaaaaaatactgttctttctgctctttctgtttacttcaacgagctatttcttttctttaaaacaaatactcccatagactcgtaaaacatttattgagaacagaaacaatttaaagaaaagcacatggatgtgtaaaaattgtgagtatggatcgcacataactgaagtgtaggaaacactgttttctactggtgggtttgcattcaggggagagtttcttgtttgcattttgtaagtttcaaactctccttgtgtgcaggagggaaccagaagtgggcagggatggatacaggagtacagggtggaaggcagactggaggatgggtctgaactagagccatgtaggagatggggaggaggaaggtttgcattttcaagagactggataagtcctatccacatgacttactgacaatggatgggtgtcatgaatgtctccacccaggaacttgtcacagacggctcagcttaagtatttgtatatagtttgctgccgtgaggaagaagaaaggagttgatcaacactgacaatggattgatctcctggtttagggcttatatgccagtgaggttgcatatgagcatgacatagccagcaggatttgtttctattagtgccagtctcttgcccctgggagtaggagtggactagatctgtgcacttctgatagcagaacaaagacatgggagaaggttcactccttcctggaagggcctctttctagaatggggagtattcatgaaggagtttcccttcaaagaccaaagcgaagatacttaaggcacataagggcagaggctgctgtgagcgcccatctggatgagactcacagagtcccctggggattggatttcttttctgtttccaatgtcctttgtttaaggccgttaggcatatacattaaaatggaagaagctccaaaattcctggaatctttggaaatgaaaattagagcatccctgagaaagggtatttaagtttgagtctgaagggagatggggtggagagcatcctgggccaggtgcagaggagggagtctggaggttgagcatggcatgactaaggaactgaatacacgtcagtgtagctggggctcaggcagcagtgggaaaagtggctagagataaagctcaaagcaggcaaaggctaatccacctgaaaccttttgaccaggaagagtattatgtcctttaatatagaatgaaatctgtgtcacatggactgtgatatcaccatgagaaatggtcaggtgtgtaaagacagtttctttgtcttatagagtctacttgctcatagatcatgtttatgtatgacctttcagacttctgtcagttcccttctggtccagccatctctagccaaggaatgggacaaagagatctaacaccagcaaagctttttgctgtgtcgcttggcttttctgttcattctgcattttacatcctatgcaaattccctaaaactgtcaatcatcttcagattagtaaccctcattcctcttgggcatggctctcattccaaactaatgcatagccactagccagcctgttgtttagggcaacacctcacccctggtcctactatctctggtcaaagaaatgtgcgcggtcatctagcgtcagcaaatcatcttgtatctacagatctgcctcagctcctttgctcagtaagaacttgtggatgggatcttggtaggatgtgatacatataccacaagtagatctcattgtgtcctttttctctgctgagaagcagggctgtgcgagagacagctgcgcatgtagcccaccaccagtgagattcgacatcatttttactgagactggggaccaggcaatagcagagattatgaatccagtgtctgaaattgcgtgttcagaacccacagataggcagggatggaagtcagttctggagatactcagttggtggagatgggttgctgccaagaaatcctcagcagttttgttcactcctcctaatttatttcaaaaggcaaggtagtacagttttgcagtcaaacggatctggagttgaatcccggttctgccccttcaccagctggcagaccttggaaaagtcacattcctgtctgtccacagctgcatcgtctataaaacagggacagacatcgtttgtaaatcatgcatcccatgcactgttcttgtgtgccgcattagtcagggcattttcaattgtcatagaaaatgaagtcagactagcttaaggagaaaaataagtgacagttatgagtaaagtgggactgtcttcagcatagctggatgctggtactttaatttcaccagatgctaaggacggcaaccaccagctgtattaactcccacctgtggagaaaaggcgcttctttttcagtggcttagtaaagttcctggatgtggcttaagaggtgtcacttagctataaagggcgatgtccctcttgtttgtcttccctcagccaccccagcagtgggatggggtccagctaaatgacttaaatggactaaaaaatgagggagggggctgggcacggtggctcacgcctataatgccagccctttgggaggcccaggtgggtggattacctgaggtcaagagttggagaccagccaggacaacatggtgaaaccccatcgctgctaaaaataaaaaatataaaaaaatattagccaggcatagtgacaggcacctgtaatcgcagctacttgggaggctgaggtaggagaatcacttaaacctgggaggcggtgattgcagtgagctgagattgtgccatcacattccagtctgggtaacaagagtgaaactccatctccaaaaaaaaaaaaagaagaaggagggagtgtcacctaatgaaaccttgactgatattttttttccagaaaggaaaataaataataataataatagcaactaccttgcattgaggatttactacatgccatagaccattttttagtactttatgcatattctattattgaatccttagaaagatcctttaagacagatacaatatttatccccatgttacagatgagaaaaatgagggaaagaggtgatatggtttgaccacgtccccacccaaatctcatcttgaattggagctcccataattcccacatgttgtgagagggacctggtaggaggtaattgaatcatgggtatggtttcccccaccctgttctcatggtagtgaataagtctcccgagatctgatggttttataagaggaaacccctttcgcttgtttttcattctttctctgccaccatataaaacgtgccttttgcctcccatcatggttatgagacctgccagccacatggaactgtgagtctattaaacctttctttctttataaattatccagtctcaggtacatctgtatcagcagcgtgaaaacagactaatacaggaggagttgaagaatgtgactgaggccgggcacagtggctcatgcctataatcccagcactttgggaggcttaggcgggcggatcacctgaggtcaggagtttgaaaccagcctggccaacatgatgaaacccttgtctctaccacaagtacaaaatgtatccaggtgtggtggtgggcacctataatcctagccatgctattcgggaagctgagttaggagaatcacttgaacctggaaggcagaggttacagtcagctgagatcacaccactgcactccagcctgggtgacagagtaagactctgtctccaaaaaaaaaaaaaaaaaacaaatcatgtcactgaggtcacccaggtggtaactgtggaggtgggattcaaacccaggaagtctttgtttgactcttaacctctaggctgtactgcctcttccaagcatgcttcacaggaagaagaaaatacgtcccttctgtgctcctcatgctcagggcctgacacacaggtaaacggtgacttacgagagttattgcaacaaaaccctccacataacaggaaaaaccttggccactgctaaatgtcatcctgtgatatatctctgcattgaatttcctcccaattactcagcctaaggtattatctcggggtcctcaatgagtctgctccacagaaccatcaaaatgctcacggttccaagcagtgcctcacttgccagcacagctgacagttatttttgtaggcaagggcttctgactctaggatgggtctctgcacctgccttttatatttgattcacaggttaactcttttactaaacgttgaaaatgagatgttagtcgtactttcctctttcatttatttttgggaaatttgagggtggtggtgggttgggggagagggaggcaggtaaaaagacgcagagcttctaaaatgaatgtggtgttgagttaaattagcctctgatgggccggaaacctaaacgacagatgatgagaagctgctgggcaccctcagcagtgccatggacacagtggtaacccagagagtgtaatgaaaagcactgaggtagatcgggctattggtctcatacaccttcagtcacccttgaagctggctttgggaagctcatctaaagaatgccaggtgtaatcgtgtggctaagagcttcagcttaggattctaaaaggcctggctttgaaccccagcttagtggcttcctggttatttaacctctcagatgctcaagctcttatataaaagggagaggaggagagaatattttctggggtcactatgggactcaatgagctcttacactgagggtacttatcatcttggctaggcacaggatgcaccttgaataactgcaagctggctgggcacggtggctcatgcctggaatcctagcgctttttggacacaagtgggaggattacttgagctcgggagtttgagatgagcctaggcaacatataccctatttctgcaaaactgaagaaaaaaatatagccacatagttaggcatgatggtgcgtgcctgtagtcccagctactcaaatggcttaaggagaaggatctctggagcccaggagttcgaggctgcagtgacctatagtcgtaccaccacactccagcctgggtgacagagcaagaccctatctttaaaaaactaaagaaaaaaaaaataagtacaagctgcctgattattacacttaaatctgctttcgtcctactcttttttaaatctttgactctgtttcttagattcctagtgagatcagagagtatacatctaggacaagttaagataatagcaaagtaaattacaaagcttaaactggataccaaaccctcaattacctgtctagagttttgtgtatcctgtagctacttctcaatctgactgaaagagtatagagttgagagcataagtaaaggtgcagaccagggattggaaacagattgaatctctggtgtcaagtcatattgattgtggcggcacagaacaccttgttgatgaggagtctgagattgtggcatgtgggttctcccagaaagagtgcatgattgattagtgatgcctgccaagggtggaggagtgagagccacagggcacctgccaggtatagtttagttgtttctgtcacagaatctggcatctgaggagtaatacaaagccacgtgttgtgtgtttcagcccaaagatgcttctgttcttaggggcatgcctgttttccttatgttttggatttgcagcttaacaaggcactggtattttcatggatagtgcatggcttaaagataatttagcaaataagagctttatatcaggcatgggtagctagcctttcctaggtgctcgagaagccttctctgttgattacattatggtagcaattcacatgatgtcatcctcatataactagggttatgttttgatgccttaattttaaaagtgtgatttgtctatgatgatatttgtcatctctttgaaattttgtattaattggggctgaaatgcttacattttaatatcattatttatagctattattttcatgtgccacttattttacttaaaagaagcaagtctattttgtgtaatttttagcaaacttctttctttaaactctgaattaaaatgcatttaggaaatgcttaatcaagcacagagctatttttcaaagattgttctgtcatctcttctaaaaagatggcagtggcttttttgtgatgagtggagtgaacgttaattaatttttctttctcttcagttggtgggttttattatcccacttcttgatgtgtgattgggtgacttcacactttagatagaaagcatgccctatccaaatgtgatttatgttttcccagcacttttgcatggttcagctgaaattttcttcgtgttgatcaaggtcagaaaacccagggattatgccatccatctcagcaagtaggttgctggaaaaatttgtgatggaacgtgatgcaataacaacagaattcaagggtggggtgggaaaccatgcccgtgtgtgtgcgtttgtctatcacatgaacacactcacccaattcacttcttatattgtgcttctttttatcaagttacaaggctttttgggcaattctgggttaggatttatttttgcataaagccataaaaactgtgtgatctttttactgtggccatcttaaactaacagctatcagaatttgcagatcaaccagaggtttttcatattttctttgtttttttccagagtgattgcagtatgattgacaagtaaaaattatatgtttaagatatacagcttgacgttttgattttcatatacattatgaaaaagtcgttagaatcaagtgaattaacacatctatcacctcatatattgctattttttcttttgtttcttttcttttgcgtgtgtgtttgagtgtggtgagaacacttaagatctaccctcttagcaaattttgtatttccttttcaactgaaaggttttctgggtgctttggaggacagaaccttcagaatagaaaaggtcctaagcttaaggacttctagcttttggttaagggagcacagtagaaaagcaaatgctcaccatgagccaggcaggcagatctgatggagccagggaggtagacggcacttatcatcctaagtaaccgacccatggtatatggagaatccagtcaaaggagtaacttacaaacttcaagtccacctgtcaaaatagcaccctaacttacagtaaggaaaatctatctctgtctgtctatctatctatctgtctatctctatatattgagacagggccttgctctagtgtccacgttggagtgcagtggtatgatcatggctcactgcaacctcaccctcctgggcacaagtagttatatagtaccaagtgggcatgttgtacttactcagtgtgatcctcctacatcagcttcccaagtagctggaaccacaggagtgcaccgttatgcctggctatgtttttttttttaatttttgtagagacggggttttccctatgttgtccaggctggcttccaagtccggagctcaagcagtccttccatcttggtctcccaaaatgctgggattacaggggtgagccactgctcccagacaaacatatgtatttttaatttgatctattcagattgagttttcatgttgattgaattcaccaattcataagttgacaaatcttaattttgccccatgactggaatgttttcataaagaaatcataaaattagaagagctaaggatataacagaaaacatacccccaaagaaagcataagtagacttaaacacccggtaatacctttccttgatagtggtatgaaaatgcaaattaaaaccatataatataccaatctctatctactaaaattagccaggttaacatgaaataagaatactaccttttcccatattggtgatgttgctataaaactggtttccttatggccgggcacggtggttcacgcctgtaatcccagcactctgggaggccgagctgggtggatcacaaggtcaggagatcgagaccatcctagctaacacggtgaaaccctgtctctactaaaaatgcaaaaaaaaattagccgggcatggtggcgggagcctgtagtcccagctacttgggaggctgaggcaggagagaggcgtgaacccaggaggcggagcttgcagcgagccgagatcgtgccactgcactccagcctgggtgacagagcgagactccatctcaaaaaaacaaaaaactggtttccttatttacttggtatgttgcaatttggtagaaatcatttaaaaaccagagtactcatacgtatgaacaaccagataattatttcttttgacccaatcttactcattatttcttattattccagtcgaatggaaacaaaaggacacctggactgagccaccattgttattttacttgcaatgtcaaaatattggcaacaacctaaatgcttaatcttaaggtaatggcttcttatgctcagcacagaacatgatagagtattatgcggctattaaaaatgatgaatacacttgtgtcagaggtccatggaatagtaattgatataatgtttaataaaaacacatcttataagatattttgaccatgtctaaaatttgcatggaaaagagaaatattcatgttcatattcaaacatcattttattaatttgatatttgaacattagaaagtaagacataatagaagaatagggaagtctgttgggatgcatctaggaaggaatttaggactgagtttgggcaagttccttagtctttctgcatctcagattcctcttctgaacccaatttgtagttttctatccctcacctgctccccaccctttccgcctgagtccccaaagtccgttctatcattcttacgcctttgcatcctcatagcttagctcccacttaggagtgaggacatacgatgtttggttttccatttctgagttacttcaattagaataacagtttccagtcccatccaggttgctgtgaatgccattaattcattcctttttatgacggagtagtattccatcgaatcagcgtatcccagtaattataagagttcatgaaatttttgtgtgccattttacattcacactgccttttcacacgccaagttgcctttaaaaactgttgcgactactaagtagataggatgataatgcgaaataacaatatcgaacagctgattttaaatggcttggtcatatgttaacttatgcactgtaccaaatgtttctgacattatttggaataggtgaacccatccgatagttgttaatcacattcggtttcaaagaccgtaggtccatctcacctaattatactggtattggaggctaaggtaacattagctagaaatagatacttatcttttatttagtttctatttatgagcttttggaaatacaaaggtcattgaaatataatcatttcttataatccaccaccataacgcttagagtccattggagaaatatacatccaatataaatatacatccaatataaaataaccatacaaatattgtggtggggaagggtggcagggagggaggagagtgagagagagaagagggagaaagagagagagaaggagagagagaaaaggaaggacggatggatggaaggaaggaaaaagaaaagaaagagaaaagaaaggaaaggaaggaaagaaggaaagaaaaaagaaaaagggagggaggaagaaaggaaggaagatgggagaaaaaagaaaagaaagaacaggagaaagaaaagaaaagaaaagaaagagaagaaattctgtttatgtgacagaatcttaaacaagcatataagactactgacttcaggtacacatggatccaggtcctgaaatgattccataggaaacctccacccaccatgattccgcttctgcttttctgcttttcttgggtttggcttgccttgtgaagcagtgaggcagacatcagcagtgttagtcataccttctaccaattcacagttctggtagaaagatcgtttctcttcccaagtaatcctaacttaagcccatttcttaggtggacctatctctgatgttatgggtcacttgccccctttcccaagagacccattgactaaactgaatccccctagaccccaggcaagggcgtgtgggatgttgatcaacctggtctgaattgtaccccagtccctgaagtgctgatatgaagccagtgcaatgctaacaatatggaaccacaacaggggaaagacagctccctgaagaaaaaccacagtgcttcttaccagagttggaatagagattggtcacgtaaatgcaacacttgcttatagcagacagaggtgcaatttccaggtgatcagtgatgtctacacttcccaggctcatcattttatggtctccatgctccttccagagtagtcttcatcccatctgtgtcttctctatccactctctgatcccaaaggtccctcatatccctgtacgaagttgcaagtaccagtcattcaaaaatgtattgaggccaggcgtggtggctcatgcctgtaatcccagcactttgggaggcctaggtgggtggatcacctgaggtcaggagtttgagaccagcctggtcaacatggcaaaaccgcatctctactaaaaatacaaaaattagtcgggcctggtggtgcatgcctgtaatcccagctactggggaagttgaggtaggagaatcacctgaacccaggaggtggaggttgcagtgagtggaggttgtagtgagcctacattgcgccactgcactcaagcctgggagacagagcgagactccatgtcaaaaaaatatatagatatgtattgaacacaaagtaatgaaatatggggctgacttgccggggtggaggaccagcttcatgatgggttctgtgacccatgtgcctggcagagagaagaggctatggacaaaggcaaggacagaaatgtatcatctgtcatggagataagtcgcatattcctactcacaaaaaggcaggtgtacatttctggacagagaatgatagccaagacagtgctagagagaaaagtagttacagatattaagagaagaagcaaacacttgttggaggaagtgccatattgggaggatcctgaaagactggccaggtggaatggatctgcacacctccagaacaaaggaaggagactctaggaagggagaaacagtgagggaggaattacttcttttagagacatgttaagagaatcctattttaggattaccctaggaaataagtaggagattcagcactctcttggttctaatagaaacaccattcaaattggcttaagctaagattggtattaagtccttgttgtgggttgaatagagtcctccagaaaagatatgttgaagtcctagcttttcccacccccatacctgtgaatgtaaatttatttagagatagggtctttgcagatgttatcaagttaaaatgacgtcatcctggattggagcagtcgtaaaaccaatgactgggttctttatttttatttttttttcttttctttttttgagtcagagtctcactctgttgcccaggctggagtgcaatggtgcgatctcagctcacctcaacctccgcctcctgggttaaattgattctcctgccccagtctcctgagtagctgggattataggcacctgtcaccatgcccggctaatttttgtatttttagtagagacggggtttcgtcatgttgatcaggatggtgtcgaactcctgacctcaagtgatccacccacctcagcctcccaaagtgttggaattacaggcgtgagccaccgtgcccagcccgaatgggctcttataagatggagacctggagatgtacgaatgtagactcacggggaagaaaccatgtgttgatggaggcagagactggagagatgcacatacaagccaaggagcacgaggggtgctggccaccagcagaagctacaagaggcaaggaaggattctttcctagagtccccagagaaaacaagaccctattaggactttgatttcagacttctagcttccagaactgggagagaataaattactgttgtgttttttgtttgtttggtggttttttttgtttgtcttttgttttttgacacagtctcactgtgtcacccaggctggagtgcagtggcatgatcttggctcactgcaacctctgcctcccaggttcaagccattctcgtgcctcagcctcctcattagctgggactacaggtatgtgccaccacacccactaatttttgtatttttttgtagagatggggtttcaccatgttggccaggatggtctcgatctcttgacctcgtgatccgcccacctcggcctcccaaagtgctgggtttacaggcataagccactgcgcccggcccatttctgttgttttaagcaacccaggttgtggtgatttgttgcaccatccctagggaactaacatatttccatgtctgaaaatcgagggatatctggctttaggtatgcctaaatgtaggtgctcttgcaaatgtcatcagaagtgtatctgtcccaatttctcattttttttttcttggagttgactgcaattcaggtgggctcttcccaagcagagcaaactggcccagaagattatttcaagacttgcatttgacaaatttagtgacaaagccctgggcttggtcaggcttgcatcctgtgttcattgctgaaccaggccctgccacagtaggcatggtgtgttagtctgttttcacactgctgataaagatgtacctgagactgggtaatttgtaaagaaaaagagctttaatagactcacagttccatgtgactggggatgcctcacaatcatggcagaaggaaagcatgtgttacatggcggcaggcaagagagaatgagaaaacaagcgaaagggctttccctttatgaaaccatcagatcttgtgagatttactcactaccacaagaacagtatgggaaaaccactgctacgaatcaattatctcccaccaggcccctcccacaacaaatgggaataatgggagctacagttcacgatgagatttgggtgaggacccagtgaaaccatatcacatgggatgtggtatttgtccaggcctgagacccttgtgaatctctggaactttggacaagcgtcagctttacgtggacaccaagggcgatgggagaggagaggttctcaaaaggaaaagaggtcctcaaaaggtttaaaggaaaactgaagggaagtcaacataggggtttggggttgggggtgttattatcagaagtaggtagaaggatgctgcctaggggacacacacacacgcgcacacacacacacacacacacacacacacacacacacacttccctaggtcaactaggatcagataggtaggctggagaatagtagaggtgagtgttgtagttacggggagttcggaggaaggccttccatgatcagaaaggtgtgtggagaaagtggatagggaatagagtactatcctgccttccagtcaattttggggagtcatgagctgtttcgtttttacaatggcagcgcctgccccagttgggtcctagcccaaggtcaactctcaatagtaaataaaggtgccaggaaggcagtatagcaaccaagagaggaggcagaaaggtcctgaatggggagggccttgggaatgaaaactttgacttgatcattacacattctatgcatataatccacaaacatttacccctatcaatatgtaagctatttcgtattgataggaccagctcggaaaaaaggataccaggagcctttacagatgttattctcaacttactttctttttttttctttttgtttttcttttctttttttttttttttttttgagacaaagtctcactcttgtcccccaggctggagtgccatggtgcgatcaagggtcactgcaacctttgcctcccaggttgaagcatttctcctgcctcagcctccctagtagctgggattacaggcacccgccaccactcccagctaatttttgtatttttagtagagacggggtttcaccatgttggccatgctggttttgaacccttgacctcaggtgatctgcccacctcggcctcccaaagtgctgggattacaggcatgagccaccatgcccagccgttaactcaactttctatgcacagatccaaaagaccaaaagacttgaaaaagaataaaaggcacttttaagtactaaatgctttctacttgcaagactaactgctttacaagcatgattcatttaatctgcctatttaaaaaagtagatagatactttttttcagatgatgaaatagaattccaaaatattcaatgaaagtaccaagttcacataatgagtaagtggcaggactacaactagaatacaggttttccgtgctctagagaccatagataatttagctcctgttagaaggcacagaattaagggtggtcaacacatctgtcattccttaaggcccttttgtaacactgaactgatatatctccatagatacaaacacacatcaagatgtaaatatatgtgatatgtttctatggagactggaggcctattttattagtctaagatccatggacttattgcccctaaaaggctacctacatcaaaagatcctaaaaagaaagttttaaacatccagcctaaattaagaattccatatcaaaaacatcagggagctaggattaaataaaaattaagcccggaagcagagtaatgactcagcagttcattagagccttacattttcaatcaaagataaaatctcattaaaagtatatttttgattagggaacaagtttgggctgttccaaagttggacggctgtatccatagacatgtgagccatgaaatccttttttcctcttttgtaactttaaagatagtgagcgatttatcttctgacatcactatacaagttattaatatagaggaagactgaacaatggtggcagagctttttatgtatctaccagtgacttttaccccataaaattaaaaggcctattaatataggctcttccaattttaggagcaatttttgtttattactaaagtgattaatcagtaaggaaccataaagaacatctaacctagtaccgcctaatagaaatataatgtcaaacatatatgtaatgttacattttctagtagcaacattaaaaaagctgagaagaaacagctgaaattaattttcctcatataatctattcatcctatatagccaaagtattctcatcatctacttaaattaaaagttttgttttgttttgttgtgttgtgtttgagacggagtctcgctctgtcgcccaggctggagtgcagtggcacaatctcggttcactgcagcctctgcctccttgagttcaagcatttatccaacttcatcctctcaggtagctgggactgcaggcgtgtaccaccacacatggctaatttttgtgtttttagtagagatggggtttcatcatgttggccaggctggtttgaactcctgacctcaagtcatctacccaactcagcctcctaaagtgctgggattacaggcatgagccgctgcacctggccaaaagttatttatgatatataatatgtttaggtgtgtgtatctgtgtgcgtgtatgggtcctaaaccttcaaaatctagtgtgcattttacacttacaaaataaagagagtgaaaccaaagatttgagatttctctttagaggttttgtgataacacaagtgtttctattttgacagcggattgcatactagatttttcctttttgctttaccatatgtgggaaatgacacttctaagacacaagatacacagaacaaatgtagggaatcctttaagctctgtgtatctcagagtagatgctctgactgattaattggaagaagtgctaagataccactgacttgaagctttgaaagttaatcacttgccatgaatagctgataaggcttgtaacacggttcatccaggaggctgagtgaggctgggtagatgggtggtttatcgcattgtttccaagtgtagcatgaattccacccttcttacatgaagccatttggggtggcacatggatgtggcattcagtataattgaatcatacagtgagactctaatttctttctcaaatccatttcattctttcagatgtcaaagagatcgactctgcgtgttgctattatatctctaacacctctctaacccttgctaatctttttgaacagagagagagggcaagcaagctttcaacagacaaaatatgcagccagaatttcacaactgaggaacattgcagtgttccacccattcagtctgagtctccatctatttatggcatatcagactggttttcagttttgacgatgacatgaaatcgcgttttaaagtttactgacacgtaaaaaagtgagcttaaagaaaaataataagctaatcatggtaaaggtgactcaaggagaagataacaatgacgagcttgatatgtggatgttctgatgtttgggaaatgcttgtcttgctatattggtgatggaaaggggagacttctccatgcttgctgcagacatcattgcagtgcctcgtttcttggtctcactttcctttctttgacctgggaagtttccacaaatgatgcttcatggtcgcattctggatcacatcttacagagcaatggggaaacatgtacagtcatacccctctcttctaggaggtagcctcattatctttttatgctaagaacaaatagattggaaagggtctaacatttttttgagcatctcctttgctcaaaactttaaaacacctgtataaagcatagtctaaactaaccaccacaccatacaagagtacttgagtgagttctttgaggaggaaatggatgaggatgtggtatttgtgcatgtaacttcccttcctttctgttttcaagttcagtttgtccagtattaattcatcagagatgcagagaaaggctaaacaaacactgggaccttctacataaagccatagtttctacttgtttttttttttttttttttttttttttcatacttttctgagctttgcctaatggtctcatggagttctttaaagtagtgtttttatataatctgcctgacaggcaagacaggatggttgaaatttatactcccaaatatgacagagttcaacccagttctgctgtttcataacagtgtggtcttgaggaaatctgaagagattggcaacttggaacttcagttttctcatctgtaaaatggggtcatagaaggactaccacatagggttgtgtttgggaatgagaagagatagaatagcaatttcgtatggagctgcgcatatattcagtaagtggtcgaagtacaatttttactatgagtatgattcctgtctttgctttgcttttctctctctcttttttttttttttttttttatttgtcgcccaggctggagtgcagtggcgccatctcagctcactgcaagctccgcctcccgggttcacgccattctcctgcctcagcctcccgagtagctgggactacaggcacctgccaccacacctggctaatttttttgtatttttagtagagacgaggtttcaccatgttagccacgatggtctcgatctcctgacctcatgatccgcctgcctcggcctcccaaagtgctgggattacaggcgtaagccaccgcgtccggccctctttgctttttcttagacctcctagcagatgatttgacttgagttttattctaaaataacaataaagtttcaattttatactcttattttagttttccactatcaaagtttaccgcttagaggtaatatttaatgagactttaatcagacttctgcggttctgatttacatgtttgtgttttatctttgtaaggcggaaagatgctagatgggcacctaactttgcaaaccattttttaaataaatgttgcaatattaaaagcttcttggttaaaacatgaatgaagtacctttcactgtttcagctaccatggtgagcatagaattgaatcaatatttatacaaagattacaatataaatgcaaattgagctgcatgataattgggcctgagtaacttttaacatagttcgtagaaaacttcaaatttctgtactggtctcaaagtaagtagaaatctgtttaggctgggcatgatggctcacacccataatgccagtcctttgcaaggctgaggtgggtggatcatttgaggtcaggagttcgagaccatcctgggaaacatggtgagacccccatctctactaaaaatacaaaaattagccaggcatgatggcacgtgcctgtagtcccagttacttgggaggttgaggcaggagcatcacttaagcctggaaggcagaggcagaagttgcagtgagccaggatcacaccactgcactccagtttaggtgacagagcaagagcctgtctggaaaaaaaacaaaaaaatatattttgatcgcatcttggttaagtctttgctaccttggttaaaaagtttggtatcttggtagcaaatttttatcaattggtaatatttgcctggcaagctgtgtgaagaagagttcagaagtataaccagatttagcagaagtagttctgtgatcaattagtgatgttgtccttgtctccagaagaggtgtttttcatctccaaactttagtcagttgagaaaataaagtaacaatttgttgttaatttggcccgttagttaaagccgtaaacaaagaaataagcaataacatataatcacaattgcccccctccacaatggtcatttaaccagaaaaaaaaaaaaaaaatctttctccaatgagtaaaatgttcaaacttatctgacgatattgataataatataattaatagacataaccactctctgtaattcagttctcacgtctgtaatgtggagataatagctaccctttcttttcagccgggatactctaaagacaaagtgagctattttgagtgtcaatccagtaaatctttagtctcttctgctattctccaggaatatgcttgtgaaaagtcaagtatgtcccttaaagtaagttttgatattaatatctttcttttctgaacctttatttcttcttccaaatcttgaagttatctcagaaggatacacccttactcctgactgagaactctttgctcatatctactggatccagtttgttttgcccaatagaacaaaatgtcacgattcttttaaagttcttcctgggcaatagtgaagtgcctgtgccttgaatgtgtattgtttgcctgtaaatttcatcatttgtgcccaaggattagggcaattaaaacaacaacagcaacgaacaacgcaacagagtcagcgctttcagctcccactctcagataggaagcacacagccctgcctcctctggagggattgagctctcaggcgtcgatttcccagctgaccactagaggcgccccttgtgcttgtaccgcagttgctgccatcaggcttcgaagccgattgccccttcttggggaaattgtgaagactaaaaaaaaagtgtttcattttatggaaaaggaaagttagacatttgttaaatattaatgacattgaatgtgcttaatggttttgtggtgatgtagaaaagggtttctcaatcttggcattattggcaaactggaccggtgcatgctttgctgcggagagtgtcctgtgcattgtgggtgctgagcagcagttctggcctccaaccgccagatgtcgagagagcttttccttctcccattgagacaaccaaaaatgactctagatgccgccatgtgtcccccggcgcgcaaaattgccccctgtttgacgatcatggtgtgagacgatgttatcattaccagtagattcatactaaaatatttcagggtgaaattttcacagtttattttcagatagcttaatcagaattgaaaacaggataaaggcaaaaagagaacatttttgaaaaaagaaaagaattaaaaaaaaaaaaaaaaggaaatggaaggataagaaaaaaaactatgagagccaaaattcacaggccaggcaagtcacatcaggcctcataggggttgacaagctgcagtgttgagtgctttacacagctgggcaaggagtgaggacagcttctccatccatatgaccctgcttttaggagaggaatgcgtgtgatacaacatgtagaatactggagactcgagtttaaccacagggttatttatttaatgatgaaagagctaactagcagatgcgtattttccttgggcattacacagaggacttacattaaattgtcacataaaaaaataaaaagggtgagagaactgttctaaatttaaaaagacaaaaaggacatagttccagtgcagaggtcaaattttttcaagcctgttaatgacccttgagacctttaaatacggtcctgggcattagatttaattttgaatcaaagttaatattcttaggtgtgattcatggaattgtggttatgtaggagactgtctttattaggagatgcatgctaatgtatttggggaggatatatctatgtctttcaaatggtttaggagaaaaaaatacctgtaatatatacatgcatccaaaactatatataaacaaaactatatatatatgtatatagcttttgttttgttttcgttacaaatatatacgtttgcatacacgtgtatacatgtgtgtgtgtatgtatatatctgtgtttgtgtttgcatatccaaactgcatagaccaaatggctcataccaggtttaaggcgaaagcaagccctcagatctgcacaccctagtctaagtacagcagggtgtgtgagatggtgagacgcagttcaggtagtgcccatcagagatggagctttgcggtcagacatacctggattgcaatcctccttccaccagttaacaggaagttgactcttcatgggttttgtaactttgaagcctcagcaaagtggaaataacactttattttacacgaaatggttgtaagagtagagggagatcgcatatgtgaaaacatgtgtcacgcagtgggtgcctgctaatacctcttcccttcttttctccatgttaccccgacatgttacaaggtggggaagatagtgaatggtccacagtgtgaacagcaacctgtgggcatcctcaaatttgtttgcatctcatttgtgtgtacacggtatgttcaagcagagaaaatagcagaatttcctgatggttttcaatggtatcagcatgcttttatggttcgactttaggatctgatgttaaacgcaaggatgtacgcaaatgtttattagtttcttatgcatggaactggtgggttgctggtgttagaggctaatgtggccagaagatggcagtgcacgataaagaaaagctcccaggcgccagccactgttttaattagctaaaaggaagacaggtatgcttttatatagtttttgattttgtaattttcctgagcagccattgagggcagatgttttcatcttttcccccagtttaagtatcataggagagggaatatcaagatgcaatcaattgctggccacggcaaacctcctgaacttaagtcttgcaaacatcatcagcttgtgccatcttagaaattgctgcagtggaaacaggcatggagctatcaattacttctagggctgcaatcccctctgtccttgaaaaggaagccagctgattctgtgagtgagatgaggggacagccactggaatgggaggtggcttctttatcagtgtcttagaagttgatctggagccctagaggaagaaattaaagatcaccttaaattgtgcatgagggcctagccccctgtcgtgaatgaccgttaactggtcagcaaagtaattgaaacaggaaagtttggaggaaaagaaaaattccttaaagcatttcttttttctcttctagttgttacctttgtctttagagtgagtaatccttcatgcaaaaggagctagcatgttctctatacatacgaagtcctaggcatactttatacattttctggctttacttagggtgatcttcaattaatctctttggcaggttgtattagtaacattttacaaaatgggaaaatgggggctcaggaatagtgaggaacttgcctaaggctgcaggatgactgaaaatttacaggtgaaattcaaacctccatccctcatcatttccctatttcctgtccagaaaggaatgctaaataaatacgagctgtcaccttttatattccattccttttctttattcctgctgtacttactaaccaaaaataaagacaggaggtgttgttaatcattacactggcaataaatgacttcacgtaagtgtactaagagagggagagtttttcttttttttttttttttttttgagatggagtctcaccctgttgcccaggccggagtgcagtggctggatctcggctcactgcaacctccgcctcccaggttcaagcaattctcttgcctcagccacctgagtagctgagattacaggcatgtgccactatacccagctaatttttttttttttttttctatttttagtagagacaggattttgccgtgttcgccaggctgctgtcgaactcctcacctccggtgatccgcgttcctcactctcccaaagtgctgggattacaggcatgagccactgtgtctggccaagagtttcattttttggtcacacttaaaccaagtccagacatcatttgctagttacacaaaagtcatccatacttattgtagaacatttaaaaatataaaaaaggagaaaaacaagatggcctcatcactcaagaataccaattttaacaatttggtgtctgcccctatcctttttccctccaagcacctgaaattttaacaaacagccttcactcaatgttgttttcattatgtcatgaaagtgtttcctacaataataaatatttctgtcttaaagccaccattattaatgacttcatgtcctcttccatcatatggacattttctagtatttaaaaagcttttatttttgtacacttaggttgattccaacgtgacaaaaccaagcaggttctgtctagcttttgcaagacagaaaaaatactgcatattgacaaaaatgttatttgaaaatgtcccatatgtttggctgggcccagcgctgtgctcagcactgcattatttcatttcaaccgtgcagcagcagcagtggggactatcatttcttctacatattaagcagagagaatgtgaaggaacaaatcccttcgatgtaatcagacaggtttccacggttcagatgttcttatcactcaggtagaggtctcaaattagatgagacagtggtcagggccattcatagcaatcgaaggcgtctttcttcatgggaacttcacagatttgtgtgggcttagtctgagccctcgcccctcctcctttgctttattgatgcttcaggaagcctgtgggccattcagtttcatgtcgatgacagtacacctaagaactgctatgcgcaggcctccgttgtactcacaacgcagcttgtttttgcataatttaagcactacgtggttgtgtcgtttaagttctgtgaaattggtgttcttccatccatgaaattatatacatcttgggaacatttctcagttgctaaaggggtgaacacattcttcaataggggtgagacagcagtggagttgatagagcttcccccgaaagcacaggtatctctccttgtccttttgagacacaaaggtaagcattttcttctttaatgctaagggaacgcaattgtgagactaaccttcccattatgtttcaggccataactctttccttttctcccaacctcccccattacacacacccaacccagttaacacatcaagaaacccacagattgcacgtcctttttaaacattctctgcattgctgctactgtgttgtattttgagtgcttaagacaatgataatcttccaagaaatgcttttgattaatttgtgtacctgatttgtgtgtgtatatagattctgctcgtaatgatatgatgtgaaaatactcattatatataacaaaccaataatatgtcgtcatggaaaagcatggttaaactcatttcagaaatctttgcagtgttaaaaacaggaacagcaggtatctagttcctgaaagaatcacacttacagatgaagggcttttgttgttattgttattacttggggcatccatagaaatacagattatgagtatcctttgaattcttggttttaacatcaggtagtaaataccgtatgttctgacttagaagtaggagctaagctatgactctgcagaggcacacagagtgatataatcgactttggatactcagaagggggaggttgggaggagaatgtgggggtaataaactgcatattaggtacaatgtacactacttgcgtgacaggtttaccaatatttcagaattcaccactatataattcacccatgtaaccaaaaaccacttgtattacccaaaggctactgaaattaaaaatatgtaaagttaagttaaataattaaacttaaaagtggtgatctctgctagtcaggataagctagtctgtgcttcagtaacaaacatgtcctgatatcttggtgttttatcacttgcaagcttatttcttgccacataaaattaacttcaggtctaatagttctataagaaggttctcttccaaggggaagtgccaggattcaggctgctcctgtttcatctagctgtatttatgtcctgtatggtttttcaaagttgcagcggccggggaggacagaggatggaaggctcacagctactctgttataggtcagcccagagtggtcacatgacactcctcttactccctattggctagaacaagtcacatgggcccaacctaactccaaaggagtctgggaaatgtgtgctcaggaagcacaaaatgaatgatgacacagtgaatgcatgttatttctctccaccgtattttcaaaacaatcatcttgagtgagagcttcagaaatgaaagatgacacatgctaacaaaaccactcttggaaacatcttctatgccaagcactgtgctatgcacctcacctgttgtattagtccattcttgcactgccatagacaaatatttgagactgggtaatttacaaagaaaagagatttcattggctccgggttcagcaggctgtacaggaagcaccacggcttctggggaggtttcagaagactttcagtcatggtggaaaaaaaaaaagagaagcaggcgtgtcttaggtggctagagcaggaggaagagagagatggcaggaggtgctacacaattgtaaacaaccacatctcatgagaactcagtatcatgagacagcactagggagatggtgctaaaccattagaaaccacccccatgattcaatcacctctcatcaggccccaccttcaacagtgaggattacaattgggcatgtgatttgagcagggacacagatgcaaaccgtattacctgcattcttttatttagaccccttggcaacagcagtggggattttcattttctccatataagaagtgaggagagagaggttgagcaaagtaacttcccaagcaccgtagtggggacaataggagtcaaactgaagactaccagaggtgaagcctgtatcactgtccaaccagccatttgacctgcagattggtattctttattttattattattatactttaagttctgggatacatgtgcagcatgtgcaggtttgttacataggtatacacatgccatggtggtttgctgcacacatcaacccatcatctacattaggtatttctcctaatgccatccttccctagcccaccacctcccgacaggccctggtgtgtgatgttctcctccctgtgtccatgtgttctcattgttcaactcccacttatgagggagaacatgcagtacttggttttctgttcctgtgtcagtttcctgagaatgatggtttccagcttcgtccatgtccctgcgaaggatatgaactcatccttttttatggctgcatagtattccatggtttatatgtgctgcattttctttatccagtctattattgatgggcatttgggttggttgcaagtctttgctattatgaacagtgctgcaataaacatacatgtgcatatgtctttatagcagaatgatttataatcctatgggtatatacccagtaatgggattgctgggtcaaatgttatttcttgttagagagcttatcctctaaggctgattatgtctggagtttttgtaggaagtggttgcaggatcctgaggttgaattgtttcttgttttcatatgtgtttataattcacatgaagtgatagaatagactttgaaatataaggaaggtatttctcttaagtcttcacctccacatatattatatatgaaaatctagatttatttgatgtgggcaatagataatacttttttcctaaaaatattatttttatatggtaatttcttctcatgtgttttaaatactcatcttctaaggctgagtaagtgtatttaatgcacaaattttttttatgtttatgcaagagatgtttacacaggacttatctttcctgtaaggtgcctcagcctgtctatgacaatgtctactataaacaatatcaaagggtttctgtattttatatcttcctgaatgtagacatattccttggggacagttgtcatgaaaatcctctggaagtactttggtgacatgtccgtcattcatgttctgtttggttcttccctgaaactcccacaacatggaaataaacagagagcccagctgttttgtttctccgtcttcctacggggagagactcaatgcacagacttcttgagcgagggcagtaagctttgtctcctgcaaagacatttgtctctgaatgtggtttccttttgtttcatgcttgtgagtgtgtgcttgtgtttgtcaattgagaatcagcaacgaagaggtgtaagagttgactgttccccagagtataagggcaagctgatagaaaatcagctttgggtattgatgataaacaagttaatcttctttgggtaatcttttgaaaagaatccttgctttatttatttatttttgctttttttcctgttgggaattatccgtgagtgaaataaaaatgcttagaagatggtcttagatttcagcctctagcttataaggattgaataaatgttttattactcatgagttaaaacataggctaattcaaaaagagtttactttaaagagcatgactctctaagaagatatttgattttatcttattggaatactaggatgtggagaaacaatgataatatgtgtgtttttaagtgtgcttagagtgataacatcacctatgcaatatacgtttctagaaaagataattcacagatccattcgtgacaaaaattcatataaagggccatcacacttttaaaaaaatggagggactatttgaaatgcaaaatgattttgcctactatagtttaacattaaagaaaaaaataaaattaacctatttgtttaaaaaaatagtatataagtaaaaggcaaacaaaacctcaaagatcatcgtttcaaaactatactgagatgcaggatgatcttatgtatcattatttagtaagaccaagcagggattggttgattcgttggctgcttaggaatcataaacctctgcttttagtcgattatagtacagtaggaagtgggttgaatcaaaaacaatatttctaactccaggatatttcaagttcggtttggtttcttttctttctttctttttttttttttttaactttagaagtaccatgagccaagaaaggtagtgtccccaggccatcattttccttcctctaaattcacattactgaatttttccccccttggactctgaaacataatcaggggaattggcaggtttgggttttcattttcacctccggctaaatctgtcaacctgtgatgaggttggctgggcatcatcaggaagcgaactgttttcctatttgtagagtggaaacaagtaccagcgcttgcagcttccagtcattttgttattcatgttacatcatgttccttctgattgttaacatgacgatgtcactgtgtcttgagagatgttgggaaaagtaaaagggaattacagagtcctggaaagaaatctcccaaccatgtcttttgtatcaaaaagtgtctgctattagctgtgggggagctagatgtcactcccatcagaggatggttttctgtccctataaaattattcccgtgtctatacagagcatctcgatgtgtgcgtgctgcagaggtagggggtggcagagctttaagcccgtaataaacataactgtttcttaagaaagcttattttgccatcattcttcactcttctctgtccatttccaccttcccaatccaaacttgtcactttcaacacctattaattctccttcctcagtacctttaccatctattcctttttctttattttttttgtggatgccactcaagtttgggaagtaaaatcattctgagtaaatgcgtttcgcaggtttcccgttatcacattacacgcgttatatgtatcatttgatatcatctttacatcaatcccaggaagaaagaatgtgtgcctccactgtttaagatgaccttggcttacaaacgtaaaatgaccatggcaggtaggataatggtcctccaaactgtccacgtcctaatccccaggaaccatggatatgtcaccgcacatggccaaggaattttgcagatatgattaagttgaggaccttggattgaggaaaattaattatccagataggctcgatgtcatcccaagggtccttgaaagctgagcacttttccttgctctggtcagaggagagaagtgacagtggaagaatggtcagaaagatgctacttttctggttttgaatatggaggaaggggccatgggccatggactgttggtggccttttgaagctggaaaagttagggacatggatttttcccctacagctttcagaggaaacacagccctgcctgttgacaccatcatttcagtccagtaaaagacaagtcagacttttaatatacagaactgcaagataataaacgagtagttattttaagtaagtttaattaagtaagttagtggtaacatattctcctattttacagatgacaaaaccaaggtaactataaagattactttgttacaagtttagcatcaataggaaactaactcagtgacctccctgtaagatcacccagggagtaaacgtgtgtctgagctgtggtttggattcatacctctctaacattaaagagcagatgtcgttttcactaagtgtttcatcttctttatttcttacctagatccttgaagtcatttgatacctggtatctctccctagagttcctctcatttaaatccatcctactcatcactggtacattattcttcctagaacattgaaatgtttaactactttccgtgaccctgtggcctaacaaagaaacaaacagcatgtgtcggcctcctggttcctctctgaattacttccacttaagttgttgattcacctacactctagcaaagctggaaaatttttgttgtcctccttccaccatgcacttttccatccaaacacatttttttttttttactgtttcttccacctgaatgtgtttccctttaaccaacacctagttgaaatgcctactatatactccaagtcagagtaatgtctttatcttctgatctgtttcaacccacctctggtatcaacatcatcatcatgatcattgtcactatcagtactatcactaccatcatcatcaacattatcttcatccactaccatcaccaccatcatcatcaccatcctcatccattactatcaccaccatcattatcagcatcatcttcatagtactaccatcaccaccattattatcaacatcatccccatccactaccatcaccggcatcattatcaccatcgttctcctccactaccatcacaaccatcatcatcaacatcatccccatccactaccatcaccaccatcattatcaccatcatcctcctctactaccatcacaaccatcatcatcatcctcatcctcccccaccatcaccatcatcatcaccatcatcctcctccactagcatcaccaccatcatcatcaccatcatccgcatccgctaccatcaccaccatcatcatcaccgtcatcctcctccactaccatcaccaccatcatcatcatcctcatccactaacatcaccaccgtcattagcaacatcatcttcctccactaccaacaccaccatcatcaccatcatccgtctccactagcatcaccgccatcatcatcaacatcatcctactccactagaatcaccatccccatccactaccatcaccactatcattatcaacatcctccttcactaccatcaccaccatcatcatcaccatcatcctcctccactaccatcaccaccatcatcatcatcctcatccactaacatcaccaccatcattagcaacatcatcttcctccactgccatcaccaccatcatcatcgtcatcatcctccactaccatcaccaccatcatcatcaacacatttttattcactaccatcaccaccacaatcatcatcatcatcctcatctgctaccatcaccaccatcatcatcaccatcatcctcctccactaccatcaccaccatcatcctcatcctcatccactaacatcaccaccatcattagcaacatcatcttcctccgctgccatcaccaccaccatcatcatcatcattctccactaccatcaccaccatcatccttattcagcaattctttagtgttcacagagtgccatatacaatgttggatcctttatgagaatcatctaattgactgtttacccatatgaagtagacactattatttctcctattttacagatgacaaaaccaaggtaactataaagattactttgttacaagtttagttttctattgtaatataggcatgtgtttgtcatatgtcactactcagatgctgaaatgtttgaaacaaatttcaataattcaacacccaggtttggagaagagtttcatcttttgtttaacctcatcatgactctgccaactgttggagttttccttgttcctgctaaataatccctttagggcaacttctattgcatattgtcagtattccacccattgtgcgattctccaattttgttaaattagagaggaggttggtgtgtgagtcaatttttctgtcttatttatcttgacaaacaatttaagagattatctggcatttggagttggcggagattaattatgtagattatatccacagttctcatccaaattccactataaacacaagaagaaaaaactggttggtcttaccatgtgaacatttcattttggatataaagagggaaatgaaaatgttgatgatccaaacctgcctgacccaaggaaattcctaagtgttttagttacatgtccttgaagttgtttctttacacattttgttcactgagggcctctttactggcttgggtgcaggaactcagtctcatgtttgccatcccaaagttctgccttacactgtgttggtcttatcatggccattgtttttccacatggtagcaagatggccaccaggagccaccagctctatcatatcctcccagcaactccattggtaataggtataaaaatgaattccagcattgcctctcatttaactaattcagggcaagggcttttccgtgcatcagtcactgtgacggaacacagtgattggacagacctggtctagagtccagccccggagccctgggaaccacacggcaacacacagaagacagcatgcgtggtaaacaggactaacacttgtcagatctcgggggaaaggatgttgcatagttcagtaccacaggtgtcactgtaggtgaagggaaaaaaatgacacatagacattctaaaagctgcatttcatattaaatcagccaggctttgatgcatatggagaagaacttttagatgaatgctatttcagaaagcccttgtcccagtgaatattactgtgtgtaaaaaggaaaaaaaacaatggccgggcgcagtagctcatgcctgaaatcccagcactttgggaggccaaggcggttgggtcgcctgatgtcaggagtttgagaccagcttggccaacagggtgaaactccgtctctactgaaaataaaaaattagctgggcgtggtggtgagtgcctgtaataggtactcaggaggctgaggcaggagaatcgcttgaacccaacaggtagaggttgcaattacctgagattgcgccgcttcactccagcctgagagtaagagagaaactctgtcaaaaaaaaaaaaaaaaaaaaaaaaggaaaggaagggaaaggaaaggaaaagaaaatgacataattaaatgtatctggtcactgttggattaaacaagtttctttaagatttcttggagcccttaagtggccgacgcgcctattatgaatgtttcaagtatgagatatagaatgatgagcactctcaatatattttcacttggaatcttctttagggagaatatattgtaaaagacgatcatagtgtccggcctattgttagtactccatagatatttgtcaagaaagtgaatgactgtcacttattttggaaaatatagttcaagaatcatgaatcctctctgtacttcttgtagcaaaagtaaataacagttctttgatatcttcattgtcatgtcctgttttgtttgttggttttgttttccctgctggaaatccaggtggctcaggatgaacatctccatatggccgtgaatctatgggaggaaattgcatatggtgaaaatagtggacaactgactgttccttttataaccacattgcaataagcttttaaagagatgtacagacatacacacactgatctgatttctacagcgtatccacttaaactggcaaagacgtttaccttgcttgaggcaattgttgtatctagaaaactgtgaaaattgaattaaattacaggtagaatacactggggagctcattactaaatggatcctatactgcgtgtttttgtagaatgaggaattatttcataaaaggaataatactctctagttgatataataaatatgcttaaattgaggtatacaatatctgtttgtaccactattacaggcacataattgtcatttatttaaacttatctccaaactaagtgaaatatctctgactttttcttagaagttttctttggaaaaaaaaatttagactagcactttctttataatatgcagtgagtcttgttttatattgaaacctcaattcattttcttcctagtgaaaaatgctttttcatcccctctgaaataaatataatctttgaaattggagtcgatgtaaatccagaggtaatgagattcagtttttcattgtagccgaattagatggagaacttcaaatatttatttgaggtttaattcgagtaatttaggaaaacattgagctttctcattcataaatgataattacgtctcttcatcaaatattatactatattcccttctgctatctgtacagtctccttcagatatgaacagttttatatctcaaaggagattttttttttccatgtaacttccttggcttgtttaacttacaaaacctttcgaaatgcagtttgctgtgcctgtgtttggagtgtttagttttgtagaaaaaaagaggtgagaagtagaataacatttacattgattttcttcaaggttgtgctctactgagaaatagtattttgtcttactaaagcacatgtttaagaaatggagattgctgtcttgcaaaacccccaatataaactccagcaggctaaaatgcctgtagcctctagttgattataattctgtaccaaatcaaaagtgactgcatttaaaaacttccataaagaaaagcttagacatttcaaactaatgcttggccaatgcaaaattatttattccttccccttcagaatttcttctggggaaagccaaagaaaaatcatatgaattgcttgaagatattcagggattgactagagaaatagggcctctaccttggtggtgatgatgttatatattataatatgtatatatggtatagtggtcactgtagtggtagctgcagtagtggaccaggtttttaaattttctgcatcttaagtccttttccacccactgtagtcatggtacttgactttggtcactaagcttgccagaggaagtcatattaagtattccaccagccagggatcctttgggtgcaagcaacagaaacccaattcaaactaccttcaacataaaagggaaatatactggctcataggaaacagcccacggtgagactgacttcaggaattaaggaatccaaaaactaaatgatgtacagaatctaatatctccttataaatctgctttccattgtgtgatcacatggtccattctcactggagcagcttgagtcaaaggcttatcctggaactggtttctgtgttggtggatggaatgatgatgtgggagcaccaagccaaggttatttgctcacctctggattaaaaggggaagaaaaccccatggcgaacaaatgaagtttgggatgatccttccccaaagaaacaggctgttgtccaaaaaaggaaggaaaacagatactgagcaaaccagatcaacagaagacccaaccttggtattggaagtccatatctctacatggcccacctttagccttctccagggacaccagatctgcccagacagtagaagaacaattgtaatcaagggtaggatgtggccagaagaccaaaagtctctttttttaaaacatctgttctattaaggaaccaaccagagagttgattggtctatggtatgtacttatgtcttaactgatcaaacttattatcctcctcagtaattaaactaactagaattgtctcttgtcccactgcacactgtctgtgaatttggagttatttcaactgtttggaaatcataaaatatgcattttgttactcatgaattaagagctagaaaccagaaatccacttatatttcttccacctcccttaaaattttactttccctcgtgctccaatttgacaattagatcatgtaaatatcattatgtaaaataatacagcattaagatgtccacagaagatatggggggtaatctatttgtacatctaaaccagtccatttttctaagatatatgaggatgtgggaaagtctgcattgatcttcaagtgcaaatttttaagagaacacaatggatggtttagctacaaaaactagagattcttaagtaagaccattcttgtgaagttctcctgtggccgccataacgcaaatcaatcctgtcattatctcttcctgggctgggccctgtctttccccatgagcgcttaactctttcttttgtctcttcaaatttttgtttgctcttctgaagtcatcatcgtcaattagtatttgccagagccccacagggtctaacatgccacttctccatctgttattcaccgaggcagacgtggtgggaccaccccttttaggttagaatcacattattctatgctattttcagcatctcccacctgctgtcctccaagccgttctcaaatcccacatctttgttctgccctgttttcctcccccacggtttgactttctaagcattatgcaatggtgagaaatgtgaatcccttatagtgatatggaattccatgtcccccaccttctagttaatatgaccttggagggtttttggattctttgtgatattttcccccttattcataaaagaggcatattgaatgtgtccatagcgtacgaagactctagaacaaggggtgatgattgtgaaaatgagcttaaagctagagaatgtggcgttgttcttggtacacattaggtactaaaaatgggtgtttctgttattaccttagggattcaagtaggcaggcaagtgacaatcataaccagcatgcagccatcatcagtataagaaacagcgtcttcaacccatttgaagtgccacccaggcacccctgtcatgtcagtttttaaaccatttttatcagtatgcaaggcagcatatggactactgttctgggaccaccttagccttgaactctcttcacgttcactgttgtgaggctttgccttcatagttatcctccctatgttacttttttttttttttttaaagtgactttcaggatcagtgactaaaataaggttctctgtaacagtcataataagcaggtattttttatgcaaaagtggtgtctttcagagtccagaccatgctgcgtgtctttgaaggagaagcctgcatttaaaagccaagccattttgacaatattaattcagttaatttcagcacattatataatgtgtccagtgacctatcaacgctgactggttgggcactccagtaacaaacaccaaagcgagtgatatgtcataacagacaaatgggctctttaaactgtacgacgggaagagtgtttttgttggcatgaatactcatctgtcaaccagcccctgccctgttctgatgatggacaaggcattgggttaacacagaaggacataaaatgaatgatcaggcatggccgttgccttgaaggagtttatgatcaaggtgggataatgaggcataaggacatgaacacatgcaggcacggtgaagaaaaactcatgatggttgtatgtagataagtgtcaaatgaggggtctgggcactaaggatagctattctgccacaagtccttcaatttgggcccaaaggtaatgttaaatttgtggacaggtacacattgttttgagttattgcatcaaaacataatttgccctggtatgtggatgagctagctgacatacatgttttcagggtatcttttccttctcttacgattggcaagaaaaagcttaaaacctctctctcatcaaatactctcccccactcaccgtagcatccctgaataaaccaggtgggtacctggaaattgtagaggcattcccctaaggtgatgtatttgatcatcagagccagagtcgggggacttactcaatttttcacccagagaggaacgtgagaagtgtaccatgcactgtcctttcctgatctcagggcttcctctcaatagctgaacccaaggcttgttgaaatgaaatgaaaaataacagtataacatgcttacataaatttttaaaacatcagcaccataggcaaggttaaaacaaaaaaaaaaagaattttgaccaggtgtcatgtctcacatctgtaatctcagcactttgggaggccgaagcaggcggatcacctgaggtcaggagttggagaccagcctagccaacatggtgaaaccctgtctctactaaaatacaaaaaatcagctgggtgaggtggtgggtgcctgtaatctcagctattcaggaggctgaggcaagagaattgcttgaacccgggaggcagaggttgcagtgagctgagatcgcaccactgcactccagcctgggcaacaaaaacgaaacttcatctcaaaaaataataataataataattttttaaaaattaccataagtagattcgtgaaaccgagtcacctggtaagacagactttcttgaaactcaaaatttcattactacatttaccatgttatctatggcatatcccagcaagtaattaaaagtagtggttcatgacatatagaatttatctagtaatgaaaacttgcactaggagtgtttttaatgctccaaatatcctctttacccaatttgctagtcacgtcctcggactacttaaccattgttcgaggttgggttcacagataatcagaaggcattgggggtaccagatgcttatgagggatccataccagtaaaagaaaggagtagagagcagagttgggcagaggggggggtgagtcagactatgatgtgagcctggaaagcctcagctgacccattggggagctccagaggtgaagagtttatcagtgtctctgtgtgtgtatgtgtgtgtgtgtgtgtgtgtgtttgtcttgggctgaaatggctgggactttacctcctacctctctcagtcattggatgcaagttgccccaggaagggtgtgatccttgagcaaggaggctctctgcagctgacgcaggccctgaaggggctgacagctgtggctgcctgctgacgtcaccccctgcagctgggtacgggtatttgtgagatgcatctccctgtttaccatcatcttactgactccacaaagtgggaagacatctgcattagtctgttttacattgctgtaaaggaatacctgagattgcataatttttaaagaagaaaggtttatttgactcttagttatgtaggttgtacaagcatggcaccagcatttgctcagcttctggtgaggcctcaggaagcttctatttctggtggaaggtgaagggggagcaggagtgtcacatggtgagagaggaggaggtgccaggctctttataaaaatcacataaaggcgtacgtacacctgtgttcattacccagcactattcataatagcaaagacatggaatcaacctgaatgcccatcagcagtagactggattttaaaaatgtggcacatgtacaccatggaatattatgcagccagaaaaagaatgaaatcgtgtcctttgcagcaacatggatggaactggagtccagtattctaagcaaactaacataggaacagaaaagcaaatactgtgttctcacttataaatgcgatctaaacactgagtacacacggacacaaagggacaacagacaccggggcctgcttgaggatggagggtgggaggagggtgaggctcaaaaactacctgttgggtactatgcttattacctgggtgacaaaataatctgtacaccatacccttgcaacatacaatttacctgtataacaaacctgcacatgtacccctgaatctaaaataaaagtttaaaaaattagacctcgtggtaaatcactcattacagcagggacggaaccaagccgttcataagggatctgctctaccatgatccagacacctcccagtagacccacctccaacactggagatcacatttcaacatgagatatggatgggacaaatatccaaattatcggccagccgtggtggctcatgcctgtaaacccagtactttggaaggccgaggcaggcagattacctgaggtaaggagttcaagaccagactggccaacatggtgaaactccatctctactaaaaatacaaaaatctgcctggcgtgctggcatatgcctgtaatcccagctacttgggaggctgaggcaggagaattgcttgagcccgggaggcagaggctacagtgagccaagattgtgccattgcactccagtctgggtgacagagcgagagtccatctcaaaaaaaaaaaacaaaaatccaaattatatcaacattctattccttcccaaaaagttctgctgaagactaaatgaggtcatacttctaagatacccagcccagtgactggtgagaataattgctcaataaaatcctgtacggcagatactgttctctctctggtttttgttttagtctttagattttttaaattatttttttgttatggtaaaatagacataacataaaatgtaccaccttagccattttaaatgtagagttcagtggcattaaatacattcacattgttgtgcgaccatcaccaccatctgtctccagaactttatcttccaaatggaaactttgtacctatgagacattaactccccattctcatgtcctcccagcctctggccaccagcattctgctttctgtccctatggattcgatgttctaggtacgttatctaagtggaatcatatggcccttgtcctttggtatctggcctatctcacttgcctcaaggtttatgttgtagtgtgttattcttatttccttcgtttttaaggctgaataatatttcattgtgagaatatatcatgttttgttttgttatatcatgttttgttcatttctctgttgatagacatttgggttgtttccacctgttggctactgtaaataatgcttctattaattacttattattatttattattattacagagctgttaatttcatttcatagataagaaagtggctgggagtggtagcttacacctgtgatccagcacttagggaggctgaggcaggaggtttgcttgagcccaggggtttgaggccagcctaggcaacatagtgagaccccatctctacagaaaatataaaaaatattagccaggtatcgtggtacatgcctgtagtcctagatgctggggaggctgagatgggaggattgcttgagctcagcagttcaaggcagcctaggcaacatactgtgaccctgcctctaaaataaaaataaaaaaagcctggtgtggtgttgcacacctgtagttctgacttgggaggctgaggtgggaggatcacttgagcctgagaagttgaggctgcagtgagccatagctgagccactgcactccagcctggatgacacagttagacccagtttcaaaagaaaaaaaagaaaagaaaaaagaaagtggctctgagagttcaaggacaagaccagcaactgaatccacatctgtccaacccagattccaagctgctgactgccatctgggtggcttcccctctctgacaaggatagccagcaactctgaaaagcaacttactctgttacacctgaggctacagcagactcctcctatctcatagaaaagaggcctcagcttcccagcctccagcaaagggaattttctaggtcccagtccccctgctttgattttaaccctctctgtgtctctctcctctgacttctacttccttgctctccatctaattccccctcctcctcgagctctttgaagttgagggagtctatactgccaggcactatccttgctcttctaatttcttaattcatttcaccttcctcctagccccatggggcaggcattgttattatcatccccatgttgtgtgtaaggaaatgggtcatgcaggagttaaaaacctgcctaactttcacgcagctagtaagtggcagaactgcaaattgaacagccagtccctgctccacagagatatgcaatgctacctcttgagctaaaacagaaattcagaccccactttgtagacacaatggctcagatttaggagacgaccctgcagccaaacctagacaaacatgaggtggttctgctgtcctgagcttgctgctcaccgtctctgcccacatggctctagctgggctcaggactttcctcttcacagcaggctgaacagcaaacccagaggccattgcagctgcctcggtattctacaccccccttgggtctggaagttgttggaggcaggcataccagactgtttataatatggatgctttctccttcacctagctggagccaagaggggtgggggaagactgagagagacagagacagggagagagagagagcctgcctaactgcctatttatcccaaatccatatattattttggaacattcagtattgcagaaatacatggagggataaatcatttcttctgccatctggtctcggagaaccttcccaagaactgtagcttcgtttaattttgctgcgttcctttcccaccctctttgtgctttccatcatcttttcttggctgtatttttgggtttgttttgcttcagtttcttgctcttttagctgtttctggatttcaatttttaaaaagaaataacggatcgcacttatccaagtcgtgccagattctttatttgggataatgctacctcatggctattttttaactttaatccggaaccttggagtgacgtgtggatttttttttaatgccccaaccagatgcactaagcagcttgatggtcagtaatgaggcagcaccaggaccctgtggtcctagagtttcttggcagtgccttcatggcaaatgtttcagtgagatgagcgtggcagacccagcccagccattgctctatggttccaaagtccttttaaatgaacaaatgggttggcattcatctagtgggactgcaactccagtgaggttactcaaaacatactgggcaaaggtttctcactgtttgagtgggaggttacaagggaagaagtctagagcgatccatggcatgatggatgggggttggcatcagaatgaatcatgtttagcttaattgggacacagatggttaagtatagaaatacctacagacatacatacatccctgggttactgtacacatagatcttcttgttccgtcagtttagaggtcctggaagccacaaccccccagcagcaatgagcatgcctactacccagatctcagtttctaataccattctccaaaaagggaagaagggctccttggagaagcggctgcttttaggactcagctatgaaatatacaagatgagcctgatagcaaatattttacagtgcaagaaagcgctcacaacaacaacaaagccactgtgatagagtatgtcttataaatgagaaataaagagggataaaattataaattagggcctggcatggtggcttaagcctgtaatcccagcaatttgggagcccgaggcaggcagatcacttgagctcaggagtccaagaccatcctggctaacatggcaaaaccctgtctttactaaaaatacaaacattagctgggcatggtggtgcatgtctctagtcccaactactcaggaggctggtgtgggaggagcacttgagcctgggaggtggaggctacagtgagttaagatggtgccactgaactccagcctgggtgaaagagcaagactctgtcttaaaatatatacatatatagatagatataggttagatggacagaattgtggaccacctttcacgcctattaaaacccggatgcttagccccagtggctggctttgtacaggcattgtaatctttgttgtgtcagggtttgtgttgaaaactttttactgctcccgtgaataggtaagccctaaattcctctccttaggttcacaacagcagtggctttcctggtcgcccatgtcccagttttgatgatagggcaacttgaaactaaaagagtgaaaaataaatcacatttacgaggagaaaatggagtcattgcaactcaattattaatgtgcaaaactgttatgcaatgtagcagcccaattaataggtgtctcttggggaataatcaaggcttaatttggcatgataattagtagcctccccttccagctttggatggggggcccctgtaggacagcctgatggctggtaatgaggcaggatcacttactttgcagccgtgttaattgtatctttctgtgcatggggacaaaacagatttacctgtttctggatgctgggatgtgccattgctctaatagagttgtacttgtttcctggtcttgccaacactggcctttctgaagggcaacactgttacacttttgagacgtctttaattggctgagttgttctaatggctacagctgcagtcttttttttttttttttaatagagtgtgtggcagagttccaatcttacaagacatacggccagagctgacatattcttaggaataacagaaaattgtcctgtttagggtatctgtaataataggtgaccagaagtcatctggtgtaggtatctatctcctctatgtgtctcagagaactcctgttttttgcaatattgctagttgtttgtacaagctgtatagtcacttaaaagaaaaccatgaaaaattacaaacgtgtggtatttttactgacaaatgtggaacagcacagagaagaaaatagtatatcatctctaatgatccatcagccgagggataaccactgtcatcattttggtataatctctttccagacttccatgcacacacacatttctccccatatatatttaatccagatgtgatttctatttgcaaaaaggaaattgtaaggtgcatactattttgttaacatgtcgtttgatcataggaacagattttgaaccagatcaataccagcatttcctaaacggtcctcctccaatatttgggagctgctgatctgtgttctgaaagtgaggctgagacagacgcatttcctctcctcctctaggtaacacacaatgaacattcatatttcaaagtctttgtttacatgttaaaaacatcattttagggaaatcatacgttaacagctcctacaattgtcttccttaaactacatgtgggaaaatgctagtgaatatttagatggcttcccatttttgttttttttttttttttgctgttgtaaacatcactgcagtgaacatccttgtacatgcatcttggggcatttctaagatttccttagaatcaaccccaagaaggattgacagtcaatggacatactgaattgaagatgctggatctccttggatgaactgccgtctccagaaaggaagggcatgtacatttacaagcccaggagagtgataggagagtgcccttcctcccagtttctgctccatagcacatttttaattccagattctgcaactttagtagccgtgtaggagaccaaaagagaaagtttattaaattcttatttatgtgttcaatttgcatccgccttctccttccccaagctcaaagcgccacaaagaaaacattaagcttgtaactcttggatgtgctcctctgtgagagagggacttaggggaagattcagggaatggagttgaggaaatagtgcagaggtagaagcaggatgcattgtaaaagaaaacctagacatcaggtagtgctgtggagggtttcaaaaccttagtttcagaagaaaggcccttttccatcgtctttcccctggcttcccttttgaatggtagtagaagaagccacagtgaacagttggcatcttttgtttactacccacagacacctggcttggggagcgggggatgttgggggttatgacttttccccttgtttcttattaagccccctcctttgttgttgagtcctccctaaatggtcactcttatttattatgttgaaagtcattgtgtgggctaggatagtcccaaagcatttttgaacacacacacacacacactcacactcattcacaaaaatcactgtcttcccaactaccttgagaccatcttctgttttcttactttccatcattttttcctaaatcagacaggagttaagttctaaaattataggattttgtacctgtcatttttgtgaaaagtgttcctttctccacatgctgcccaatgagggtcctttaagatattttcatcacgttcctcttgctcttgtgttggacaatttcgcacaaatatgttttttgcccaatgatttaagatgctcttaattgcttttactgaagggaaatagaacaccttttaagccaacagctgagcgatttgctatgacaaatctgccactatgcattcacttaatttccaattaatcaaacattcaataaatcattagtataattacacctgttcccttcttgccctagcccattagctcaactcaggcgtcccttcgactggctgtggggaaggtgttcatttgtctgccctggctgggtgcacattcttactccctgtgagcttgagaaatgatgagtaagaaattgtaattatttcaggcaccagaagtttgcttggttttcctcttctctgcttcccactccattgcgtccccaacagcttaagccaacatcatagtggcctagtagcggtggctggttaatttcagcaagcttttcttttttttttaatcatttttattccctgactgtgcctctttgctaattacaccatctccccaggtgagcaataattccctcatcaccatatatctcaagcacagattattaaaataatacagcttatgtcatataaatgtaacagaaagtatcttaaagatgctttattgaaagctggtaaattggttcaacagatgaatgttttaaggcctgtttttaaaaggttgcacaagtataaacccactgaattactgctgcagtttcacacgagcggatgcaattattttaagcatctaactgtgcagaagacagatctgaaaggcaaggagctaaattctccgagattaattaaagggtttcattttgctcttgatttaaaaataaatttcaagcatgcatcacttgttattctgtggaagaatttgcattatggggtttaaaaaaatactgagaacgttaagtttcatgagttcttcatacaatatagctgacagctcttaaaaagaggggttgacctactgttgcagcagcattttctcctacatacttctttctacttttacatttgtgaagggtattaatcttcaaactcatttccaatgtaagattgtgcatttacatgaatctcccataagattgctcctgattcgatctatgcttattgatttaatttcttttacctctcagagccagtggtgctgaagggtttattgtaattacagtgttgcgggtttcggtggaacagttccctggtaacttaagtgtgggtttgattccctctaaactcgctcagcccaggagatactgcggcaagtatcttggaggcagagagctttcaggccagatcagaacgctggctggtacacaaccggaaggtatggggaggctggagagggaacggccgggggctactggccagatggatcgctgttctaacggggcccttttgaggtgaatcacttggcaattttgtgagttggcagacggcacagccacctgtgctcaatgtgaaatgagatacaggtaacctactgatctgaaatatgctgctcaccctttgagagatgggacagtgttgcaagaggtgatttgccctatttgtggggtattggggagggaaccacagcaaaaataccatgagttttgggactgaggggagtccaaatccaagccgtgtgtctctagaactgtagtttctaatttggtttaacttctcaaaactgaaatgtttgtcacttattttccttaacttctcaaagccaaattgttcctctgtaatagcattgtctagaagaacatgattaaagctgcatatgtacttttagttttttaatgactgcattttttaacagtaaaaataaacaggtgaaattaatgcattttatttaacccaaatatccaaagcatgatcatttcagcgtgtgatcaatataaaagatattttacattctttttttcatcctaattttttggaatttattgtgcgtttcatgctgacagtgcacctccatttaaactagccacattccaagtactcagaacctcaaaaggtgatggttactttatctaaaggtgcaggtctggctgatccgttaccggaatagtaccatttgcaactgaaagaagcctaattcaaatgagctacagcaagggaagaaaaattgtctcaagtatggctgaatccagaaacacacctgctgcagtttggaaattccccacatcaaggccctgcttgccctcgggtggcccattagatggcaggaaaatggcccttggcaaccccaagccttaggtggcccttaagtttgtgacctcaggaaatgagagatcctcttcccctgtaactgtagcaaaaacaaatttggtgaggaaaaggaggaaagggacaggcttcatttgtgccaagtgtctgagaagactccttctagaagacagggaggggatgatgggcaaatccatgaaggctacatgtaacgggagtgcaattccccaaagaagctctactgagcggaaaaatggcacatacccattgcaagtgaaatgatacaatctgccttaaaggttgtggtaaggattgcttaggccaaaactctggagtctttcttgacacttctgtttctcaaatatcatgcgtctaatccctgctgcaggaaatcatgttggctttagaatttatccagaattgtattgactgccaccatggggaccatcatcctgagcaggttctgtcttttcttgcctggattatcgcatcctcctcctaactctgctttcactgttttgtctccacacgcccctccccccatggcttctgtctcactgagaataaaagaaaaagtccttgaaatttttcacaaggtccccacattctggtccctaccaactttgtcatctggtatcttgtcctatctctcctgatatggtttgactctgtgtccccactcaaatctcatcttgaatggtaatccccacgtgtcaagggagggacctggtaggaggtgactgggtcatgctgttcttgtggtagagagtgagttctcacaacatatgatggtttaaaagtgtttggcagttctgccctcactctctgtctctcctgacaccatgtaagacatgccttacttccccttcgccttccaccatgattgtaagtttctcgaggcttccccatccgtgtggaactgtgaatcagttaaacttactttattaagtctcaggtatgtctctgtagcagtatgagaatggaccgatacactcctcactgagcccatcctgtctcaccactctcattctagacttcgttttctttcaagatctttgcattgtctatttcctctacctggagaaaccttccccaggtacccctaggtcttattcctacccaatttgaggtctttactcaaaaaccactgtttcagtgaggtattttatattgaaaattgccttctcctacatttcttgtctcccattcttcctttgtagctgtagcattttgtatagtatacgttttagtgattttgttatctcgctctctttctctgtctcacatatactatatggtaaagtccatcaggaaagatatttctgtgtggtgttacattcctctacctagaacagacttattagagaggcttaacaaatatttattgaatgaatgaatgatggaatgtagaggtgctcaatgaacagtagccatcatcattatttactatcagaggctgtttcagctatggtcagcaaggttaaaactcaaaatggaactctgctatgaacccttaagtgtcaatgccatcagtctacaaggtgttgcaaccttctgtcatctgggtctgccaaatacccatttgcgcatgtgtgcccgagaccacgttgttgaaatgttacgtctgtcctgggcgtgaactagataatctgcctaatgactgggccacagtaataggattttcagagttttactgtgtaccatcctaacctttcctctcatctcccgaggactattttctcccagttttttccatctcagtggatggtattatcatctttccagtgacacagggcatcatcttctgaaactcaacacccaagcttcagtccaatgtcatccatggcaagataatataatttaatcattcctttattcagaaaatgtttattaggtcctatcatggcgtaggcactctgataggcatggcagccaaaatgtctcctaagtatctctgaaaacatacccacttctccccacctcccctcctatcacctggcagctggactataaaatattccacttaccagttgatatggtttggctgtgtccccacccaaatttcatcttgaattgtagctctcatcaccctcatgtgtcatgggagggacccagtgggaggtaattgaatcatgggggtgtttttttttttttttttttttttttcctgtgctgttctcatgatagtgaataactctcatgggatctgatggttttataaagagcagttcccctgcacatgctctcttgcctgccgccatgtaagacctgcctttgctcctcctttgctttccaccatgattgtgaggcctccccagccatgtgaaaccatgagtctattaaacctcctttcctttataaattacccagtctcaggtatttcttacagcagtgtgtgagaatggactaatatgccaatcttttgttccctcccagtcttgcgtatcttccatccatcttctgcctagagccaggataatcttttccttctcacatgcaactctgaccatatcatacctgggtttttgtttgtttgtgtaataataacagtcccccattgctcacaggatagtctcaaagtctcacgggagtcttgatgaccaagttaatgccaacctccacatccccatctctcaccaaattctgtttaagctctaatctccagtctaagatttctcaaccttggtattgggacatttagagctgaataatgctgtgctgtaggggtctgtcctgtgcattgtaggatgttgaggagcatccctggcctctacccactagatgcaagtaaaaccccctccccagttgagacaaccacaaatctctccagatattttcaagtgtccctttgtgggcaaaaataaaaatccttcctttctccattgggaacaacagcttcaaacaaaattgaagttacagttgcccaaacatcccctgtcctcccttgtttttagacatttgcagaacctctcttcctctctctttccacatctacctccttagttatggctggcaactcctgctcacccttcatgtttcagttttgacaccaccttctggaaaagcttttttagacttctcccaggtagtagggtgatggcaagatccttggtaagacttggggactgatagcatgtggagaatttggacaggaagatatcatccttttctcagctgggttctgccagaagcagacctgaggcaataattcacatgaaagtagttgatacggttaggctttgtgtacccacgtaaatctcatcttgaattgtaatacccatgtgtggaggaagagaagtcattggattgtgggggtggtttcccccatgccattcttgtgatagtaagtgaattttcacaagatctaatggttttatgaatggtagtttttcctgcactctcacgctctctctctcacctgccaccatgtaagccatgcctgcctcaacttctgccaagattgtaggtttcctgaggcctctccagccatgcagaactgtgagtcaattaaacctctttcccatataaatgacccagtctcaggcatttcattatagtattgtgaaatcggaccaaaacagtggtttatttgggaggaaacactagtgttcatggtggtggtggtagaaaatggtgcaggggagaaaaggccacctgcagaatttattttgtgaagccactgaccactatatggaagtgaagctttatcccactacgggatccttggaaccaacgtacacacatagcttagtattatcctacccaagggcagggggcctggggtacttatactgcaagtctcattagtcattggtagaggggttctgcttttcctgctgcacaggtaggaaatgtgatttcagcatcaagaagaaatgcaggtattgaagatgaacatattacagccaggtccatgtgcactgatatcataaaggtgtaggtaaattggtggggccctggagtgcctcacgtggtggcttcaaggtgttgcatctacacagctgggacatgggcagtaccgttttctaaacagtgcaatttgttaggaggagaaactggcttatttctttgaaccacctgtgctacatccataagaggctgcgtttgaggttctgtttgggaggcagaaaaaagtctctagaaggcacctggaaataaggaagctaaaagtggagacagattggagctgaagacttaagttgtagaggcaccttgaaggaattgtggttaagcctcgaagatgggtaaggtggtcacaggagttggaggtctaggaaggaggggtaactgcagagaaatccatatttgggattagttttgttccttctcctaaagtctgtgtgcggcagcagggagtggtgaatacagtcaagatttgccacttgggactaagccacagtgtttccaaataaagactttaagaaaccctcctcactcataatgaatttaagggctaaaccttatcagtcacacacacagaacaatgaatctttccctgaggcaatgcaggataaagttttaaagttttttttttttctttttttaaccctgttctgttgaattatcttcaaaactgccttagattctgggaccagggtgcggagggacagatggggtgagtgattttgaatgctgcagctttatcttgctgcattataaatatgtgatgccatttaacatagcaagccatcaggttagtaaacaaatgattgccaagtttataattggcaaggaaggaggttataatctataaggagctttgtgtcccaaccaatttattctctaacggaactttattgcctccatcgctgaaaactcccgaagagtcttaagagctaagaatccagattggctgagctagttttctcttgtggtctcctttctggcctcatctcctatccggataaagatacttggaaaacccatttcttgaagatgaagcagcccacctggcccagaaatgcctggtttgttgtttatgggtggtttttatccagtgaattggcaagaagtgaattatgtggaagaatccattttaaaccctttcagctacacaaaattggaaaataaaatattgtgtttcttgagatcatgaaccaatactgtctgggtttcttagggtatgaagcccctttggggtcaaggctcagcctgctactattacagcctcataccctgcttctctcttcctagtatgatgattaagtcaaggatacgacgcaattgaccaggtgtgcagtgcccaactctgtggggccattaacttcacagcctacataaagaagccacttacggttttgtgagctcacactgctcagttgtacatgatggccctggtgacaatatgtgtttttggaattagattggcctgaggcaaattctacagaaaaatagagggaacttagataggttgctttatttgtaaaatagagggttataatacctttctaataatgttgtttacaaaaatgatgcaagaaattgcttctcttagtatgtatttcccctttgcctggattacttaccacaaagccatcgttgcttttcataaacaacttccgatcccttctgtggggtattttccatgaccttccctcttgctccctcatctttgctgtctctgaatataggtatctaactggaaggctggaagtgccatttcaaagcggtggaatttttttttcttcatttgttgttttattttgctttattgcattttccatatttttggctaaatctgttattacctgcccatttcagcaactaaaatctgtttgctttcttgtttacctgcatagaacttactcttccatcttcttggaatggaacttgtctcagaatctttcaggcgattgcctgagtccttcttacagacaggactaacactccccttggaccccaggtatctgcccatgactcagtcttgttcattcagcattttccattcctctggccttgatgtttggttcaccagtgggcatgtaacccaattctatccagttatacttgtgttgggaagggattttttttttccctggggttgtgaaagtaacaggatataagtttgggacagctgatggccgtgttgacattatgtgagtgtaataaactgaatgtttgtatccttccaaaatccatacatggaaatcctaactcccaatgtgatggtattaggaggtggggtctttggaaggccattatatcactagagtggagccctcacaaatgggattagtgcccttataagaagagacagaagagcttgctttctctcttttctctcaaccatgtgaggatacagtgagaaggctgccatgtgcaaaccaagagttcccttcccacacaccaatctgtcagtggattgatcctgggattcctagactctagaaccgtgagaaataaatgtgtgtttaagatgcacggtctatggtattgtgttacagcaactcgactaaaatggtggggaaagccagtgtgaatgcaaagcaaactgttaaaaaaaaaagatacccatttctgacattatttgagtgtcagacttgcatctaattgagccgcaagccttgaacttatcagctttgtgataaatctccccttttttgtgtataaggtagttcaagatgtattactcaactgtgcatcttcctacagagtcttttctactacagcataagaaacttgagagcagaatggtggatctgcatgacacgttttggcacttgttacgttaaactcaaaaactccaaacttggaggtttagaagcagagatttaacaaccaaaaattgtgcatagtcaacctgatgaattaagatagcctgtgagcctgagatgctgaagtcttttttttttttttacccagaaatacggtgattttttacatgtcacatcctggatcgactctctgtcagctcagcaagtgtcttcagagctgacaagtgataaaccagttgaaagtgccagtcacattgtttggttattgataatgctgctgtaccagggatgtgtcattagtatgtgtttacgggctgcaattctcaacatggacccagcagaaaatattgggtacttcaggcattcttgttatttacccagatggtgtttcgtgggataccccctgcctagagcagatctggatatgtgtctacactggttccaaggatcctatactgggataaagcttcagttccacatagtggtcagtggcttcacaaaataaattctgtaggtggccttctctcccctgcaccattttctaccaccaccaccgtcatcaccaccatcatcactggtgtttcatcccaaataaacaggtgcatttctttgtctaattttagagccagtggctacttcttacccatctggtgggtattttttacagaagacctgatcactgagttccttgcaaagatgtccccatcttttgcttccattgtctcatcagtagaaactcacaacatgaaataataacagcaattaatgtttatatattggtcttttccatatggtaggtatgttggcactattccacgtgctggggttggagtggtgaatggaacagacgtgcccttgtctttagtaaatacactacaacttgtatattttagtgggagagatagatgataaggaagtaactctagctgaaaaatataattacaagttttgaaaagtggtgtaaggaagtccacaaggtaatgcgagtaagagtaattgatgatggtgataggtgttcacggttggacagagtcttgagaacaattagttccaaagtgaaaccacctttaaggaggcagcattttcgtggagacctgacatggtttggatttgtgtccccgcccaaatctcatgttaagttgtaatccccaatattggaggaggagcctggtgggaggcaattcgatcatgggaacggacttcccccttgctgtttttgtgatagtgagtgaggtctcacaagatctggttgttgaaaagtgtgtaccactcactgaaggtaaccatagtaacagcaaaatcccaaatgagttaaactcacaactaggttgactccagtctccgcataaacacactggcagaagagatgtgcatgtttctttctttttttcttatctttttttttgttgttgttgcttgttttttgagacagagtcttgtactgttgcctaggctggagtgcagtggcatgatctcagcttgctgcagcttcaacctccggggctcaaacaatcctcccacctcagcttcccaagtagcttctgggactacaggtgtatttcaacgtgcctggctaaatttttatattttttgtacagatgagactttgccatgttgcccaggctggtcttgaactcctgggctcaagggatttacttgccttgatctcccaaagtggtgggattataggcatgagccatagtgcctggctgagatgtgtacatatttctatgcaaaaatgctattgacttcagtcttcactactttccttcatagtattcaatattaaatagtatttaaatagaaatactaggattcaatattcaacagaaaaaaagaggaaaaaatagcccacttagacaaagcaatcacatcaattaaactcagaaaagaccccagtgttaaaattatcagggaataaatttaaaataactattactaatagtttaaaagttttaaagcatagtttcctcatcttcaaaataacctgtttttttttttttgagacagagtcttgctctgtcacccaggatggggtgcagtggcatgatcttggctcactgttagctccacctcctgggttcatgccattcttctgcctcagcctctggagtagctgggactacaggtgcccatcaccacgcccggctaattttttttttttgtatttttagtagagatggggtttcaccatgttagctaggatggtcttgatctcctgaccttgtgatccacccaccttggcctcccaaagtgatgggattacaggcgtgagccaccgcacttggccaaaatgatggttttttaaagtgccaaattcttctggttattgtgcatattaaatgacataatggagcccgggcatggctgctcacacctgtaatctcagcactttgggaagcctgggcgggcggatcacctgaggtcaggagttcgagaccagcctggccatcatggtgaaaacccatctctactaaaaatacaagaaattagccgggggtgatggcaggcgtctataatcccagctacctgggaggctgaggcaggagaatcgcttgaacctgggaggcagaggttgcagtgagccaagatcatgccactgcactacaccctgggcgacagtgtgagactccatctgaaaagaataaaataaataaataaataaataacaaaatgttagtaaagtgcatgcttagcaaaatatctgacacagggtaaggatttagtaaatgacagtaattgtagtccttatcaccttggatacttaatgaaatactgctgaatgttcaagaaaaaaaaaagtgtgtacttcttcccccttcactctttttctcctgtttctgctacgtaagacatgccagcttcccttttgccttctgccctaattgaaagtttcctcagtcttcctagccatgctacctttacagactgcagaactgtgaaccatgtaaatctctttctttataaattacccactctcaggtagttctttatagcattgcaagaatggactcatacacgacctatgtgttcaagaggagccagccagggataattcaggaaagggtgttacaggcagcaggaacagcaaaggcagaggccctgagctggaaggagcatggtatgatggagaaacagaagtgagaggggtgctgctggagaatagttggggagaaagagacgtgtcgggagaatagttggtgagaaggagacatgtgtcaggaagagctagagagaccagggtggtgggtcagctgggacacacatgaatgattggaaacatgagcttcatttctgagtgtgccaccttttttattcttcaaataggtgataaagtaggtacttctgaaggattaaggatgttgctgaagtgtatcccacaagtgaatatcagaaccatgattcattccctctctttgcacaatccatccattttaccttaacatgatgctaccatgttattaattggttttgaagctccaggtacattaatactgggacagtattaattcctacttaacataaggatcatgagggctaagatgaggtcacgaatatgcagcttttatgctggtggtcaggcatagtctgttcacaataaacagtagaatattgcctcttctgatagctcagtgtttgctttatgtaaccattttaaaaaatgtaattgtggtaaagtacacgtaacataaaacatatcatgttggccgggcacggtggctcactcctataatcccagtactttggaaggccaaggcaggtggatcacctgaggtcaggattttgagaccagtctggccaacatggtaaaaccctgtctgtactaaaactacaaaaattagctgggcatggtggcgggtgcctgtaatcccaactacttgggaggccaaggcaagggaatcacttgaacccgggaggcggaggttacagtgagccgagatcatgccactgcactccagcctgggggacagagcgagactctgtctcaaaaacaacaacaacaaaaccgtgttaaccatttttaagtgtacagttctgtaatgttaaatgcattcatatttttgtataaccaatctgcagaactttttcatcttgtaagatggaagctttatgtttgttaaataacagctccccattctccttaccctccagctcctggcaaccaccattccactttccctctttgtgaattcctattctagctacctcatacatgagtagaatcacacagcgtttgtctttttgtgactgtcttatttaattcattaatgtatttgtttaattaattaattaattaattttttgacccaggcactggccctgcagctgcttccttttgggcgtggaaattcccactcatttcagggatcacgctcacacgcctattgcaggagtattagtaagcaccccccaccagcccacattatccccccaaaataacgagacctcacctggcctctgcatttccacatccctgctcaaagccaaatccattcctgctccctcgccctgtcctaaggttcatctgtattacagcatgtatcaaaatttccttcctatttaaggttaaatggtatttcctcctatgtatctactgatgaacgcttggattgctttcacctttgggctattatgaataatactggtataagcgcggttgcacagatatctctctgggaccctgctttccattcctgtggtacatacccaaaaatggaattaccagatcatgtgatatttctagttttaagttttgaaggaaccactatcctgttttccaagaggctaaaccgttttgcatttccacccacagtgcctaagagtttccacttctccacagcctcgccaacttttgttattttctgtttttgtttgcttgtttgttttggcggtagcctttctaacaggtgtgaggaggttgctctaagtcatcttggtcatgtccttaggaagtatattatttgcagagcagctggaaacatctcattctcttccatccactcctttctgatgaaagcggcatattccattgatggaatatttaccatgtagataaatacttggcattttgccaagtcattttgtatactcagtaccatgtttgtgtgatattaatgagaacctacagacttctttagaataatcaaggggtccttaagtttctgtcttgtgtacttgaaaatatccaactggaaaccatttaaatatggctaaaattctgtgtctctcttgcagttgcacaacccataattaaatgatttgtagaagcagtctgaattaagggccccgttcatcaatactacatgaattatgtaggcatatcttcatttttacattatttatctcagcggccagatgggtacattggctgcaatattcatcagtaagaaatccaaatgtagctttggcacactgacatctgtgcctggtctggccccccgtggggtagagtgaatatttgtggttggggactagggggccctctgcttctaggcaagtcaggagttctgcaagtgatggtatttgacactttatcagtcacctcctaagtagctcccatcagagataagtggaaaggatctgagagctacccaggctttggggaggggatgggcaatgtcccatgagtggtgatgtggacaccagagttttcacaacgtgtttgtcttggttgctgatgctctgtaaaactcagtagtagctaatatttaggaaggcagtgtaatatagtggataaaagtgtgggcattggggtttacattgtggctttcccactaatactgtgagactttgggcaagcagtttcttcgtgtttcttacctggacaatcatttaatataggcacctactgtatcagagtggtcgtgagaattcaccgagcataggcaggttataacattgagtatagcatgcaactgtggattaaaaagataaagacttaaagataccactatggagttatctcaaagatacattattggtgaacacacaaaagggcataatgttatgtattatagttttgatctgggtagaaaaaataatacaattatagattgtgtttgtatgtgcataacatttctggaaggttctaacacaagtcattggtttactttggagaagtggatggcagtaggggatatcttgagtgagccctgttgtatattgtgatctttgttttaattttacgatttgcatatattagtatttttgaggagcaaatagtctgattttgaaaacaaggaatgagttacagaaagctgcatctgtctcgtgaagattttttttttctttgcagttagacaggaacctggtgatgaggctcccctagacttctggagagtcttccagctacgtactcaagatcttagcttactgacctgtatgttctgcacgaggttctcaccattgtttccagctccacaccctggccagatacagagcactcacccagtcatgatccatcaggaaaataggaagttggaagtgggctccaccttggcccattgctgagggcaagtaggattttcacttaaccgtttgggagaagtggatatttgcctctactatggtctgaatatttgtgtaccctgaacatttatatgaaatatttataccccgggtgatagtattaggaggtgatgaggccatggtggcagggacttcatgaatgggattagtgccattataaaagaggctttacagacctccttgccttgttgtcctgatatgaggacggcgagaaggcatcttccattttttttttttttttttgagttggagtttcactcttgtcacccatgctggtgtgcagtggtgcaatctctgctgactgtaacctctgcctcctggcttcaagcagttctcttgcctcagcctccccagttggtgggattacaggtgcactccagcatgcccagcaaatttttatatttttagtagagacaggtttcaccatgttgccaggctggtctcgaactcctgacctcaggtgatccacccacctcgtcctcccaaagtgctgggattaaaggcattagccaccacacctggctgccatcttctgtggacgaggaagcaggccctcaccagacaccaaatctaccaggatcttgatcttggacttcccggcctccagaactataagaaaataaatttctgttatttagaagccacccagtctgtggaattttgttatagcagcccgaatagactaagactgcctcaaagtcaacatttaagagttcagattagaccatatagggtaacttttttttttaattttaatttttattctaagttctggggtacacttgcagaatgtgcaggtttgttacataagtaaatgtgtaccattgtgatttgcttcacctatcaacccatcacctaggtgtgcattagttatttttcctaatgctctgcctcccccaaagccatatagggtaacttcctgaccttgctgtagcatttgtaaactgtcatggcagtagtgggagtgtcttttggcatgcaaatgcattacaaatagtgtataatgagtaatggggacagccaggagtcacttttgttgccctcttggttttggctagctttttttttttttttcttttttttttgagacaaagtcttgctctgtcgcccttgctggagtgcagtggtgcgatctcggctcactgcaagctctgcgtcccgggttcacgccattctcctgcctcagcctcccgagtaactgggactgcaggcacccgccaccatgcccagctaatttttttgtatttttagtagggacagggtttcaccgtgttagccaggatggtctggatctcctgacctcgtgatccacccacctcggcctcccaaagtgctgggattacaggtttgagccaccgcgcccggccggttttggctagctttttaaggcatctttttaccaacgaggtctttgtgacctgtacctggtgccgaccatctgtcacatcctgtgactcacaatccccaacctaccgtgaatgcagcccagtgggtctcagccttaggggatgaaccctcagttttgggaattgcccacccctttcctggaaaactcacaaataatccaccccctgtttagcatataatcaagagataatcataaaaatatccaaccatcagctcttggggctgctatgcctatggagtagtcattctttattccttttaatttcttaatacatttgcttttacttaaaaagaagagttcagattagttcttctaaaactctatattcagggtagatttccatctgttttctttttctataaatgaaccaaaaatgttgaaaattctatcattttaagccattttctggcgccgtgtgtgctcttcaagcattgggttgtgcaatactgtttgcctttttccagcagtgtttctcatttgatttatcagagatgatacttggtaattcagtttgatattgtcccctgtatctgatgataaacacttgagggaaaccaggaaatctattttttatgttaaataataacactggccctttcattatcctttcagcattgcaaatcaccctttctgtctcggcaaagagagaggaattaagatttgttccgtgttgactcctacgtgattatgttattcagtgttaaatatgagagaactttgttacacagagccaggagggggcagtaaatttccttttttactgttattaaaaatggatcctgcgtttcatgcatagcaagatctcacccgtttgctctagaataccactaattcctaccccctaccccagcaagggaaatttttgaattcattgtgactctggttttatgtaacatttccattaggttttaagtagtgtgctttcaaattactacctgtaaagaggcaaaagcaaatttttgcatttgtaaaaaaataataaataaaaataaaacgctattttttctttttttttttttaactttgcaaaggagataaaatcacgacttgtcttaagatctgctttagctcttcccgttcccaagtaggtgaaggtggaactatcactagataaactgaaatcaaagtacagtgcctggacatgttcaggttcttgtgaacaatgagagaaggcaaggatgcctttaatgtacatagctgctttcctggtcatattctatcagttcagcaaacactatgatttcaaacaggtgtgcatgcccagagaactagcttgctgatcagcgtctggactggacccctgggcttgcctgtgcgttttctcttccttctgctgtggctgctgcttcctaaaacttgtgtctttgaatatcattaacttacgtaattgctatgttccctaccagggtacctaatatatctggctagttttaaggaacaccaagttctctctgtgggatgatttgggggtggcttgggaattattattggctgtgctataaatggctgaggagggaaataaaggacactttcaggacacaattaacactttctaatggcacagcctatgtgctacccagagactgggaggcagtgcagacccagagaaataatgacatacgatgagagcgcctcatgaccttcaggtatttggactgaacacacacacacacagacacagagagagacacacaaaacacacacagacacacataaatatatgtgtgtgtgtgtatatataaaacatgtatatatttgccttcaaaagtcgcaattccatagaaagaagaggtgagactcactatcctgcaattctgacaatccctcaacctgcagactggacatttctggtgacttctaaaaggtaataataggttaatgtaaaattaattgcgttttttgccatttctttcagtagaaaaaaaaacgcaattgcttttgcaccaacctaatagaaactatctaaagaatattttcttaagtatccaggttctcattagtcttcattttacaattgttcctggtttttttttctttttttccttcatattcccccgctgcttccacctacaccagatgaagcacagggcaaaaactggattatacgcaaattgtacactgatttattagcgtgagccaggagtttaatgaggggagagggaaccgtacaaacagctcttggggcctatgcttgagtggagttgtgccgccatactaggtttcagtatgaatttgggatagggtcttctaccccctccttccttaaggtagaaatgaggaatgtgtctacttacaaatgtccctggtacacctatcaaatgggctcacacgtgtgagtctctccatgaagtaccctgctgagttcagtagcatccgtccagtatttgttttgtcaggcatttgaggtctttaatgttttccaggacatttgactttgtttctctgttcctcctcgggcatgttagtggcattaacttacagtccagtatttacctgattccattttgaaatcatacagcctgttttggaaggctagttctactacgtacgcacagagatgaagggaagaaaattattttggtctctttaaattccctatctgtaaattgaagaaattgtagtatttccatcctcacaggtttgttttgagatctaagtaacataatgcagtcaggattttagcatagagctagccaccaagtgaacttcaataaatggttaatattttatcattagttttgacttttgttttcatatccattcattatgctttttggaaaattacttcaagcagtgtcacttcttacggtcattgtatcaccttaagtgaagcttctgcaggactgctatattgtggtatttatgcctttaagcagttttcagcttggggaaatacaaggttgcagtttacttatcaaatagtgaaaaacgtaacttgagcaaatttctctcctgtataaacagttaaatcccaatgtcttgtcgttgtttcttcttctagaagaggttattccttgagcccagttgtattttgtatgtttcataaccttggaaattgttcatctctatgaagtaatcccttttattacataatataaagggaagataaagtttttaattctcaacgcatctgaagtggtgacatgtagcaaacagctcattatcccccacaaaaagcacaattactcaatatagggaagcagtgctttcagaagctgcctcatattggagctgccccacgctggctaatgttggatattgattctgaataattcaaatagcaataaaattgggttttcatgacagtcaatcagaggcattttatatttaatgctcaatagaagaaacacggtgtctccttaccttctgaatttcaaagccattaaactaattgtaggtcattatgtgaaatttatctgcataattggaatagttgatctaattcatgtagcattcaaaacagtggccagagaagaactgatgaatttttagataatgatatatatatagtacatgtatacatatgcatacatacgcacacgtatatttgtatacatacacacacttttagtcaaagtagtgtcactttaccagcattcatttttgttaatacagtcaacaaatcatacggggataactttaaataattcatttgatcctgtttctcacatattcccagtggcctcagaagtgaatagcttctgttgaaatggagatactaaactaaggagttttgttctttatatgattttgctgatattttcttcttagttttcatctgtctttccaaaatagacttacctgggagatatatatgattatatgtatataattggggtcaccagaccccagggattctgatttaatttacttgagattgggacctgacgatcaagatttgtttagaagctcctcagttgattctactgtatagcatagagtgagaatcaaggtaaatctaattcagtcattcactcactcattaataaaatagtttatcaagtaccttttatcttctgcagtcttacaggcgttctgacggctaaaaggtgaggaagatagtattgtaggagccttcccagcaatccattaaaatgttttaaagtgccagtttagacatagaaacaaagaagatgtttatatacagctgcctggaaagcctaatacttctgtctctgggaatattatcaaaaccctagagggaaatgggcttctaaagggttcttggctgtgtgtagaaagtacctcattctcttctaactttagacttgcaacccttaatatatgacctcagattagtttgttggaaggtagagtgacatatgaaagcagaattccaccttacttgggagttgggtcttaaagtcacactctgtgttcacttaagttgagtttgtttctagcatgtgcaaagcagagatatttctcctggtaaatgctgaagtatcgtgggacaaatggagtttggaagaaagctgcttagaaacgagaatggcccaggagatacaacatgtaaaacttgtacaggatgcccgactccgagaagagataatggctgatcaaaaactcagatcctgatgccaacaaatgactatacttgttgaatatttttgtctaggaagtaatttggagagcttggaaataatcatggagataatcttgatgttctttatatattcccaggctgcctgttagaaagacatctctccaccttggcaattcctgcttcctttgacttaagtatttgcttccctaaaagaagccttaaataattataactctttacccataaggagaagaggaggggacataggaacaaagcctgagcaaatatatatggttcatatagggagatggtagaaccgtacaccagtgtacggccctaaggatgggggtagcaatggtgagaatcccttgaatctcattcttgcccaatttagaataagaaatacattatatagtaagcagtaagcatgtggaatctctctctctctgtctctatcatctgtgcatctgtcatctctctatctcatctatatctaatctatcaatttatcaaattatctaatctatccatctatctaattacctaactgtctaatctatctatccatctatctacctgtctacctaatctgtctatcaatctatgtatctatgcatctatgtatctgcctatctacagtcctgaaaaagggattggattcagagatgatagtgatatcattgtttaatgtgaagactggtcattttgtggaaaatcttcaatcatggtgaaataacacctcttagatgaaatgccactgtccaaacgatttttaaggtcactgctaggggcaaacagacaaaaccgattatttagtgggttaggaattctagagttggaagatggcttagatttcatttactaggagtttctcatatgtggctgaggagcagagccgcaaggggactgtactaaagattcccagaccccaccctgcttccttgaattagaattaccaaatatggggtggggagatttctatctttgacaggttccccagctagctccacaatgatcaagaaacagcagtgaggaaacactgcttttgttagtatcattgatgtcagagatcacaaaagagaggttatgtttgcaacccagatcagaagccagattataaattcctacctcaggaatatcctttacctttggaaaactggttatattcctcccttggaaagcctgaattagaagatgaatacagagggactgctgaggacagctagaattatctaagatgcaaaaatacagggaagatacatatcagatcctagaggaactaaatccagatactgaaggctaatgggaaatggtaagatgaggtgggaagtagagttctgcacaactaaaaaggacacaaaaatattgccagaagcacaggcagatactgaccatatatcattgtggatcgttgatgtctagggcacgactatactttagaaacaggggatcagtgacctcacatctcatcttttgtagcatactgctactctctgtccttcatcctgtgggtttgccatctttttgtgctcttgcagaattctagctgcgagtatctgtgtctcagttcttgagagtatttctcaggattatgggaagttgctttgcccatgcacaataggagaccagaattgtgaggcaattaatactccagggaatagcccttaactaatggctcttgggagctggagtgtaaacaccccagctccctcactccatgggtaggataatgctgaggcacacgttttgaaagttttcccacatgactaggctcattgtatatctggcttcttagtccatcctttattacaggatgcttttttcttccctgtgctaatttctccatttctcccttccccactgctgtttcctaccttccaaaatgaacaacgttttctaaaatccttggctcattgtctgcctctaggggaatccaaacaaacaaagtatctgggtcttcctatgttttcttgcacagccagttaaaatctgacatctaggagtaatgtatgaaattagctgagcctactaaaaccaaatttgaatcaaaagggaagattttttttaaaggatctaggtaaattctgggaactgtattggaatgacttaagctatggcttgagatctatccctcttttaacctttccttcatttctctttcagtcttccctttgcatctgattcttctgcatagtttctggtctctttcccctatacatctgatccctccatctttccaaagattgactttccctgcttactcacagttgctgcttctctgcagcctcagctggcatgtaactggattacagtggtgttagatgtggccaagaatccacagtgaaattccagctccagaattcaccgtctcggccccaggctcctgttcagattctcacgagagagtgagtctctgacagatgcagcattccttgctgggaatcagcttccccaaggcaggtgacctctctggcccaagcacctgcactgcacctgcactggggagtttattgaggatggtgaggtcacctgattcattgagtatctcttccagggggatgggcttaggatcgtaatctagaaaacatttagtgtagcaggcaattgcttttcatcctgaataggcagactttccaccacgattaatgcacgtagtaggtctgcaaggcagggaccctctgtgttaatgtaaggacagtgacattggagagaagagcaaggtgaatgcttagcatttacatagtatgttgacgtcctctgttgcctaaagcacataagcctgatttatgccatgggagaactagcacattctgccagtgcctctgtacatgctgcacacctacatttttgaagagtaaataatgaggtggagtttttttgttcatgtttttgttttaccttggacagccattatgtaaacttttcacaacaaatttgcatctgaaagtttgttgatccttgtgttatatttcatgacaaatgatgaaaatgctaatttctgaataaagtaagagctacttttacacatttatttgcagaaggaattataatttctttattggcattttttaaaggttaggtacatagtctttttaaaaattaacttattaagagacgtcaacatctagggctccctcttacataaaaagatgctgaaaacagaaatatatgaatataagcactgttgaatgcaaatatcaaaatgtgaataatgagaacagccaacccctcatctcccataggtcattagaaagtgcttcttcactatttatttattagcaggtgccagagccctggcaaactcccttttttgaaatttggccttcagtgtgatagaaacaaatatgacttgggatgatagaaacagaaatatgacttgggcatatatgtagtccttccatccttccataatccagatatgctgaactgatctgtacacccatgtgtcagagcaaagcctgtgcctgtcagctgaacccactcagtcctacagccttcctgaaaattaaattaaaaaaggttttttggtggcttttataagggcaatagcagaatttgctaggtcaagctagtcaacatttttataatgaaccatttaataattaatatgtagcaaatataaataatggttgtagcctgcagtagttaaaaacctgagatccttacaggaagtagccaggggtggtggtgtgcacctgtagtcccagctactcaggaggctgagatgggcaggtcgcatgagcccagaaggttgaggctgcagtgaactgagatcacaccactgcactccagcccgggcgaaagagcgagaccctgccttaaaaaaaaattctgacctctgaaatctgacaaagctgggttctactaccatctctgtgacttgctgctggaaagcaggagctcactccagagctgacgttcacccagaacgcagggccagtgttggttctgattgtcagcgctatgctgtacagggtttcagttcttagatagtctgaatagcatcgttgtctatctttaagggttgccataaagacaaagtttataggacacagtgttcagtccctgccacatcattacagtttaacacgtgcttatgtttcttgccatggtcattttagagaacttataccccactgcctgggtatgaaattccagtcttattaccagaattgcacagggatccgccagaattatacagggttcaacaggtttatttgacgttttttgtgcttttgatttcagcccacatccgtgcagctctgcaattgtatgatgtctgacccctctgtccaactcccattgaatatctatgaatgccctttgttaagcagtgtgcatgcgagggctggtatagagatatttgctttgttcagaaggcaaaaagactatcctctgggctcagttttgaattcacaagattgctaatcattgatcgtaacagctctaatttactgaacactgacaattatgtagccatttcctttacgtggattatctcatttaatcctcatgataaaggtcatggtattgcctcattacagatgaggacatgggtccaggaagttaaaccacttacttgaattctcccaaagtacaaatggcccaactaggagttcagtccatgtaattaagactgtgctcttaactactctcctaaactcagtgggactaggtctctattcctcagacattcttttctttgtgatagtttctcctctcattctacacatattttatcttatttgtgagggaagagtcagaaagcagcactagacttcagttcctctctcctttcttttcctccttttacccctatccaatcaggacaatataagttgtacttaagatttgtggaaaatattttttacgaaatctagatgcataaagcaaaacaggtgcagcaatgaaaagatgagtcattttcaatagttcttgacgcctagtaaaggttatcagaatgtattaggttgtgttgcctcgcttgagcccaggagtttaagactggcatgggcaacacagtgagactgtgtttctataatttttttttaaagtagcctgttgtggtagcacagtgtatgtctgtgttctcagctacttggaagactgaggtggagggatcacttgagccagggaagtcaaggcttcagcgagccatgattaaacaactgtatacactccagcctgggcagcagagtgagaccctgtctcaacaaaaacaacaacaacatcaacaacaacaacatcaacaacgaaaaccaaactggtggcttattgctagatgcacatgatttaatagaaagggtatggtttgggagttaagtacacttgcctcctacccaactcagccactcaccagtgggttcatgttggtggaattacttaaactctaaacctggttacttagtgccgtcagctagggagcttgtacctactattcagggctttacttttaaggattggaaaattgtaaataggtaaatggatagatatttttctgtcttagtctctgcagtgcctgtcggagactaaatcttcagagtatacatatttcaacagttatttatttggagacgtttgagtggcagctactgttgtgtcttttaactatttctcgtccccatggatgtgacttgtatttgcttatgtcccattgcatggctaaaataacttgaaacagaagttgtgtaacattggatcgatcacaaaatgtttgggtaacaatgctgagactctctcagatccctagggttgcatttcccctagaaactgaatttggttatgaaaagccccagtgcaggagtctaccatgatagttcccaagtggcatgggtggtgatctgtggttcctctccccctgtgaagaacacagacatgaggaaatgaatccttgaggcggagcattggttacataattcacaggccctccttctgagacctctggaaataagcagatggttgaagaatgagggagtttttgtcgccattttttttttgccttttgctttaatttttggaataaataaggtttgcttccctactgggcctgctcaagggtaattaacttcttctttttgaaagggatttagaattttcagcatggttaccccaatatttttctgatctatccagtattacacaatttttgttcaaattattttagccatccaaggagacataaatacaatttatgtccatgttgttaccatggaaaaccagtttattttattttattaattttttaaattttatttttccataagttattggggtacagttggtatttgcatacacgagtaagttctttagtggtgatttgtgagattttggtgcacccatcactgcatcatattgtcttttatccctcacccctctactcttccccccaagtccccaaagtccattgtatcattcttatgcctttgcattctcatagcttagctcccacatatcagtgagaaaatatcatgtttggttttccattcctgagttacatcacttagagtaatagtctctaatctcatccatgtcattgcaaatgctgttaattcattcgtttttatggctaagtagtattgcatcatatatatacatacctcaatttctttattcactcattgagtaatgggcatttggattggttccacgattttgcagttgtgaattgtgccactataaacatgcatgtgcaagtatctttttcaaataatgacatcttttcatctgggtagatacccagtagtgggattgctggatcaaatggtagttctacttttagttccttaatgaatctccacactgggaaaaccagtttagaaggacaggttgtgatttgtagcaggtggtggttctgaccatgtatggaatgctgtattcatacatctgaattccagatgtggataccctggaaagtgggatacctagagtctgaagcaattgatttggagcctaggtatagacttagcagggaggagtgctgtgatggattggtgatgtctgctgtgaagttagcatcgggaagcgacagcctgtgtgccctgtattcgccacttatccctgacacgggaaccgtctgaaaagaggagcctcatttaagcagtattcagtgaacatctaccatgtgtcagatacttcagtgggcagtgaaaaatcagttctgagtaagatagtccctgccttcattgggtttacaatagaggaaacaacagaggcaaagctgtaaagaatattggcaagaatggtagatatttggctataggtcaagcaaaaaataactcaatgtaatttaaataaagggttatgatatttttgcatttccccgtatttcttctgacaaaagttcacttgtgattatccctacccttatatgttatttatagatttcttgtttagaagtataaaaatgcatcagttttatctgttgtttaattatcaggtaaagactagaagaaatattgggccttcatgtaagtgtgcatcacagtattaaaatagaattcaaatatttgaaagttaaaaagaacagacatgttactccttgtccagttcagatggccaaaacagctactacgtggtggctatgaactttctggaagtcattgctgctcaacatcagttttaaatctggactctgcttctaggatgtgttttctcgcccgaggctcatttgatgtgagggcttagcaaataaatacagttgggaagagtgaagagtgttaatcaggttcaatataggctaggctttttcctcaaaatgtcccagagccttaggttggatgaatgtctaggtacacaaatgatatatgggatttaaataatagtccatttattaataagaggaaaggtatcttatatcaagattgtttatatttcatttagttaactccttttatttgggacattgcagacttttcctaaacaaaatgtactataatattttcgagatgggggaagccatgaagcctaagttacatttaaaaatttgttaaataagataatgagtaaacattcccagcacaatgcttgagccagagaaaagtgctaaataaattctaactattgccactgggaataataatgtgtgtctgcaacagaaaacaaaaacacaaaggacttgtctcttttttttttgcggtaattcttaaaaaaaaaaaaaagtcaggcattttcctcttgtcaagatggtgtaatagggaccagatgtaacctctcatcttaaatgactgtatgatgatcaaaacacatggaacaatggtttgcataacactgtacatcaaatagtaatggacagcaatccttgacaggagcaaaggatgtgagtcctttgattgccccagcttactgctttaagagtttccataaggagaggaggggaactgagatgaagcctggagtactccctgtattgaggaagtggaactgagggtccggggagcaaggcacctgtcattctgagtatagagcatcagagtggagagtaggagcccaggagagtatttataggaattctgaatgtgtatgtatcgaataaaagagctgtaaaatctgtgaagcaaaaacatgtagaacataaaaaaacagatatatgaacccacagttataattgtaaacctcaacatccatctcgcaacaatttatagaatgactgtataggacataaggaaggatagagaagaactcaccaccatcaaccaacaagatgtcattgacaattacagaaccctttaccccaaaagagcagaatacacattcttttaaggagcccatagagcatataccttgagagaccatgtcctaggccataaaatagacatcagcaaatgtaaagacagtgaaatcttggggtgtggtctctgacaacagtagaatcaaactagaaattaattcataaagagaacaggaaaaaatcccaaacacttggaagctaaacagtaaacttctcagtaatccatgagttgaaaatgaagtctcataatacattttaaaaatgacattgaacttaatgaaaataaacatacagtgtatcaaaatgtgtgtgtcgcagccaaagcagtcattagagggaaatgtatacccctaaatgctttcaatttaaaaatgacaattctaaaatcaataatgtaagctcctacttcagacaaaaatagggaaagaagagctaaataaacctaaagcaagcagcagagaggaaataataaaaattggagcaaaagtcaatgaaattgaaaacagaaaaacaagagagaaatgctagttctttaaaaatatagaagaaaatggcaaacttctagtagggatgatagaaaaaaaaaaagaagggaataattacccatatcaggagagaaggtgagaatattactatagaccctgcagacattaaaaggataataagagagtactctgaacagctctgcacttactcatttgagagcttaaaccaattctcttgaaaagcacaaactgcaattcacccaatatgcaatagataatttgaatgaccctataactattaaggaaattgaattcataatttaacatcccccctccccccaccccaagggaatctccggtctaaatggtttcactggagaattctacccatatttttaaaacatttaacaccaattcttcaaaatatcttctagaaaatagaaggtgggccaggtggggtggctcatgcctgtaatcccagcactttgggaggccgaggtgggtggatcacatgaggtcacgagttcgagaccagcttggccaacatggtgaaaccccatctctactaaaaatacaaaaattagctgggcgtggtggcaggtgcctgtagtctcggctcctcgggaggctgaggcaggagaattgcttgaacctgggaggcagaggttgcagtgagccaagattgcaccacttcactccagcctgggtgacagagcaagactctgtcttaagaataaaacgtggtggtccacattccactttattttatgaagccattacactctggtcacaaaactggacaaagaaagtaacaaaagaaacaagaaaactgcaaatcaatatccctgataaatatagaattaacactatttaaaacattttcaaatagaatctaacaatatataaaaagacttatgcaccccaacctaatgaggaatagtccagtaatacaatactaattcagtatttgaaaatcaattgatgttattcactataccgataggttcaagaagaaaaatcacatgctcacattagctgatgcaggaaaacatttgacaaaattgatacacaaccagaagtctcagaaaaaaataagaatcgataacagttttcttaactcgataaaggatatgtgcaaaaaacctacatctaatattgtgtataatggtacaaatgaatgatttccccttaaatacaggaacaagacaccactgctattcaacatagtagggaatttctaaacagtgcaataagacaagaaatataaataaaaggcatacagattaaaataaagaaataaaactatccttattagtggattccatggttatagagtaaacaccaaaaatttaaaacccacacacattttgtggactgacaagttagctcaccaaagtcacaggatatgaaatcacattgccaaaaacagtttctaaatttcttacagtaaacagataaaagcaacttaaaatacaatacaattttaatcacccagaaaaaagggaaatatttaggtgtgcatctaacaggacttgtatgctgaaaattatcaaatgctgatgaaaaaggccaacatgtaaatagatggaaaagcacagtgtgttcatggattgaaagactccactttgtaaagatgccatttctgctcaaattgatacacagaggtaatgcaatcatttcaaaatatcagcagagtttttaaaaataaatatagacaagattatctcaaaatttgaatagaaaagcaaagaaactagagttgttaacacaattttgaaaaataagaatcaggtgggacaaaccagtctacctagtttcaagacgttatgtaactccagtcatcatcgctatgtggtatttgcttagatgtagacacctaaatcaatggaagggaagagaagacactgaaatagccccagacaacattgaccagctgatttttgccagtaatgcaaaagcaatttaatgggggaagtataatctttacaacaatggtgctggaacaattggctatttataggcaaaataataataataaataataaatcttgacctaaacttcacatctcataaaaattagctcaaaatggatcgtaggttaaattgaaaacataaaactataaaactttcaggcaatcctataggaaaaatatctttcgaacttagagctcggtgacatgccaccaagggtctataaaagaaaaaaatgataaattagacttcatcaaaatttggctggacggggtggctcatgcctgtaataccagcactttgggaggctgatagcaggtggataacctgaggtcaggagttcgagaccagcctggctaacatggcgaaaccctgtctgtattaaaagtacaaattttagccaggctaactttggtggtgcgcacctgtaatcccagctacttgggaggctgaggtaggagaatcgcttgaactgcggaggtggaggttgcggtgagccgagatcatgccactgcactccagcctgggcgacagagccagactcagtctcaaaaaaaaaaaaaaaattaaggatgtggtctctgaacaatcctgttaagatattggaaagaaaagctataatgtggaagaaaatacttgcaaatttcatatctaataaagaattaatatctataaatttatgaagaagtgaaatggtggttaccagaaactggaagggtaaagggttagagaaatgtttgtcaaagcatacaaagttttagttagataggaggaataagctcaatagatcaattgtacaacatagtgatagactgtagttaataattctgtattatattcttgaaaatcattaacagagtagatttcaaatgttttcaccacaaaaattataagtgtgtgtggttctgcatatgttcattaacttgagttagccattctacagtgtatacatttttcaaaacatcatgttgtacgtgataaatatatacagttattattgtcaattttaaaatgtcaaagagtgaaaaccaatccatttagaaaatctttttaaagtgacttgaagaaatattttaccaaagaggatatatggaggcaatcaagaacatggaaagaattcggcattactagctattagggaaatgcagattaagaatataataacatatcattatacacatgttaaacaggtaaaatttaagatagaaactatcaaatatttacaaggacgcatagaaagtgtgtctctcatatactgatgatggcaatgcaaaatgacacaactcttctggcaaattgtttgtagtttcttaaaataaatagacatttaccaatgagtcaacaatcacatttctggacatttattccacagaaatgaaagttaatgtccacgaaaaaccccagaaagctatacacaattattgtcagcagttttatttctgagtcaaaaactggaaacaaccaaaatatctacagtaggtgaatggttaaagaaactgtgagatacccgtactgtgaactactattcagcaataaaaactgaatgaactatcgatatacacaacacctgtgatgaatctcaagggcacaatgttgaatgaaaattaaaacagtctcaaaaggttatagactatacaatgtcatttatataacactttgaccatgagagaagtataaagatttggacatagttgccagtatggtgggagaaaaaaagatgggtagaactataaaggtacagcatgaaggagaaatctgtggtgaattagttctgtattgtattgtggtggtagttacagaaatctatacgtgtaataaaaggggttaaacttatacaaacacactttatcaatgtcaatatcatatagtacaatatgatattatagttgcataagatgtaacaaatgggttaccaatgtcactagcaggatagggaaacaatacttctctgtagtgtctttacaactgtctgtgtatttgtaatattttcaaaataagttataaagatttgccttttatagtgttactgtaaacccttaagttcccactaaaaagatgaaatgtagagttatagctaataagccagcaaaggaaatagaataataaaaattttcaattattgtgaaacaagacacaaaaaagaggaaaagggaaagttgggacaaatgaaaaaccaataggttataggtttaaacctaattctgtcaatcacattaaatattaatgttctaaatatactcagttcaaaggcagagattgtcagacttaataaaaataagatcaaattataggctgtgttataagaagcacattttaaatataaagacacaaatatgttgataaggatgaatggtagtgcacacctgtagtcccagcactttgggaggccaaggcaggaggatgccttgagcccaggagtttgagaccaacctgagcaacatgacaagaccccaactgtacaaaaaatttaaaaattgaagtgagcatggtggtgcatgtctgtagtcccagctacgtgggaggctgaggtgtcagtatcacttgagcctgggaggctgaggctgcactgggctgtcatcacaccactgtattccagcctgcactccactgcactcagggcaaagcaacaccctgtctcaaaaggaaagaaggaagaaaaataaataaataaataaatgttcattattttttctcatgtgttttgactatttaaaaaatcatgttcatttatttctgattatttgtaacacattttcctatacattaattaaggatattaaccattcatctatgatatatacagtaaatgattttccagtttttcatttgtggtttaattttgtcaatgttatcttttcaatatataaagcaagtggtgtgttcgcatgtttaaataaagtgtatttctttcctttaaaaagtaataaagatacagaatgtgatcactaatctaaagaatactgaagtaactatactgatatcacacaaatagattctagagaaaaatacatcagggataaagaaggtaatttcacaatggaaaaggtgacttaatcaagaagacattaaatatttatgcacctcaactttaaaatacatgaaacaaaactgttggaactggaaggagaaatagccaaatatttcagtgctagtctctcaataactgacagaataaatagctagaaaattattaaatatatagatttgaatagtagtattaattaatttgccttaattaatgactgtagaaccctctatcctaaaatagcaggatacatattgttttcaagtacataaggaaatgttttcaagaaaagagctattctgggctgaactattttttttaatcaataaatttaagagaattgaagttatttctccaatcgcagtggaatcaaactagaaataaatgacagaaatataaaatgaaaatctccaaacacttggagaataagccacactttaataaataacctgtggatcgaagagaaaatctaaatggaagtcaaaataaacagtgacctgaacaaaaatatacataagacatatcagattttgcgtagtgttattaaacaatgcttgaagagaaattcatagcattaaatacccatattaggatagtgaaaaatggtcttaaatcacttactttatcttctgccttagaaaaatagaaaaagaaggtgaactaaattaagtagaagataggaaataaagatcagggttgaaatcaataaaacaggtagtaggccaaaaatggaggaaatctttgaaaccaaaagctggtgttttgagaaaattagtaaaatcaatacacttttagccaggcttagtaaagttaaggagaagatacaaattaccaatatcagtatagaaagaggaggcatcactacagactctataggtattaaaagaaaaataagatcatattatgaacaaccttattttatgatattaagatttaagggtgaaatgggtaaattccttgaaagagatctaagaaagctcactaaagaagaaatagatcatctgaatttcctgatatatatcaaataaattaaatctggagttgaaaatcttccctctaagaaaattccaagcccagatgactttgttaataaactttacaaaacatttctttcagaaaatggaaaaggaagttacatttcccaatccattctatgaggcaacgattactgtaataccaaaaccaggaaaaaattcacaagaaaaaacccccgaaaccacagactagtcttcctcatgaatacctatgtgaaaattctaaaacaacaagcaaatgaaatctattgacacatgaaaaggatactatatcaagaatgagcagattttgttttaggattgaaaagatgccttaacatttgaaaatcaatttatgaaatacaccatattaacaacaaaatgtgaactaacacaattattttaatagatgcagaaaaggcatttgacaaaatccaaaatggattctagttttttaaaaagctcagcaagaatagaagataaattggtcaatatgataaaaggcatctatggaaaatgtatagctaatatcatgcttaatgaggaaatactggtgttgcccccaagattgggaacaaagcaaggatttatgctttcaccacttccctttcgcagtattttagccagtgataatgagcaagaaaaggaggtaaaaggcatctgtttagagaagaaaaaaactgtctttattcataggcagcgtgatcatctgtgcataaaattttatgctctctaaaacagaaagtcactggaacttagaaatgaatttatcaagttgcaggatgcagtatcaatatatgtaattcaattatatttttatatattacacaaattggaaattaaagcttaaaaatatcatttgcaatagcattttgaacagtgaaatacttagaggaacaaatctgatggaagatatgccagtcctatacccttaaaactacagaatagctgagaggagttgaaagagacttaaatatgtgagcatacaggccaatatcgtgtgtaggttgagagacttatcttagtctcccctaattgatctgtagattcaacacaatgccaatcaaaccccagcaggcctttttttcaataaaaactcccaaacatattctaaaattcatatagaagtggaagtcaacttgaatggccaaaatatctttgaaaaaaacaatttgggaagatgaatactgtatgatttgcagacttaatggaaagctacaataatcaagaaagtggtgcgctgggcatggtggctcacacctgtaatctcagcactatgggaagactagacagttggatcacttgagcccaggtgttcaagaccagtctatgcaacatggcaaagcctcatctcaacaaaaaatacaaaaaattgccgggcatgatggcacatgtctgcagtccctagctacctgggaggctgaactggggggatcacctgaacctgggaagttgaggctgcagtgacctgtgattgtgccactgcacttcagcctgagtgacgagtgagacacaggtgtcagggaaaaaaaaaaagtgttgtcttattaatccttaactattattaattaattgaaagtttacatagggcagaaaagtgaaatattgatacatataatcaatacttatatatttataagccaaagtttgctagtgatcccaagtctgttataggaatgtgagattttattaagcataacaactcaaatgttgatgtccagttcatagaaactccatctcctagcagtcttctcagtattttgggagacttcagcaggtgtctcacttgggctcaaactaaaatctcatctctcctgtggagctatactactgtgcagatatcccctcaccacagattattgaggtgttagcctacagaagtcctagcagacctctgcagaacccctcacggtaccatagcaggtccctataccatgccaaatgggagatccttaaattatcttactggtcggccaggcgcagtggctcacgcctataatcccaacactttgggagactgagacggtcagatcacaaggtcaggagttcgagaccagcctgactcacatggtgaaaaccccgtctctactaaaaatatacaaattagcctggcatggtggtgtgtttgaaatcccagctactcaagaggctgaggcaggacaattgcttgaacctaggaggtagagattgtagtgagccaagatggccccattgccctccagactgggcgacagagtgagactcagtctcaaaaagaaaaaaaaaatctatcagtcagtcagtcagttagtctgtctgtctgtctgtctgtctgtctgtttatctatctgtctatctgtcttactggtttacttgttgtcacctgggatatgtaagaagcctgttggggcagtattcacataatctctgttaaaagtgatatttttagtatcttctatgggtcttctctttaaacatctcagatattgtctcttgtataaaaagtaaaagttgctatcccacaccacccctactatgtccttctgattgctgccttttttgcaaaagcagaaatatgtcttctgggcaccatccgcttcatggacagcaacttgtgcaaagagattcctgggagttgtcaatctacatgctcatagatgtctgaattgtgacatatcctcagtccctacccgccatccagagtcatttttctgacataaaactttcataggcaatccataccttatggcttcaccattgtaaaactggtggaaagcacaacacgctatcaacttcagcatcatgaggattggcctttgttttctaaatcctttctcttttgaaatgcacctattatacaagacttaggttgtatgatttgaaggattgttcaccagtagtgacaccgttatttattgaaccattttcctgatactttttttgtgttaactgaacttgtatatgtaattattatctggtaggatcattttttttcctagcgttatttatggcatgatttactagcatctcgttaggcaataaatgcatatttaattggatatccttatgggttcagtaccatgctgtgcataaattccagaagtatacagacccagccttcttttctctttctctctctctctctctacacacacacacgcaaatacatacacacacatatatacgtacacatacacatataactatatacatatgtatgtatgtatgagcacaaattatttggggtgggcactgtggctcacacctataatcccaacactttggaaggccgaggcaggaggattgcataagcccaggagttcaagaccagcctgggcaacataacaagatcccgtctctccaaaaaataaagataaaaaattagctggccatgatggcatgcatttgtagtcccagcttgggaggctgaagtggatctcttgagcccagaagttcgaggctgttgtgagttataattacaccactgcactccagcctgagcaacaaggcaagatcctgtctcaaacaaaacacctaattatttggagtatatagaatttgaacttgttatgcatgtatgaacagaagttatttggagtatatagattttgaagttggcttagatgtatgatgaattctcagaggttatgattaattatctttacctttcattctataagattttattgaataccttctagatgctagaatttcagcaatgagcaagactgataaggtctttgtctaaggaagaacatagaccccataaaattagtgttacagttctttcagaatttgtctagcaacctttctggtttttgctagaaagttctctcctaattgataaaataaaaatatttttgaaagggaagaattaaaaatcatgggattaaatgacaggaggagccaatctgggtattcataaaatgactgatatttctgtccacagttgagtgaaaagtattggaaaccaacattcactgagcaactactaggaaggccggatggcattcgagagaaaaagttatggtctcaggcagatctgagtttggatcctgctctgctgtgcattccaggcaagatcgtgttttggcaagttgtctgtcccatctgagcctgggttcctcattggtacagaaagtcagtaatgacatcaacccaattaaatgagagaacagatgcacacaggacgcattccacacagcgcctggttcaaagtaagtgctcaggacatgagtgccaccatccttcccccaaggaggcatgagatggaccctggttcttgctgttacggtcactcaggcaatttatactcataaccgtccggggaggtaggactcatgttttccccactttccagataaggatactgaggttctggggatttgaactaacctgcctttgacttcatatccagcaggcagccatgccgatttcaaagctccttctcttttcattcattgcaccgtttattgacctcatatacattcttcatctcctggagtgtctctcctaatcagtacatcaggggtaacaaatcttagtgacctcagtaaataataagcccaaagaattgcagtgcacagattcttgcttaagaataacagcgacttggaaagtttttcagtgttaacagagcagccttatgattaaaatcactgaagaatgcgatgtaaaatgtttttatttcgttttgctttctgtttcccttgaaataatagtcagcaggaaacacatttctgaaagacttctccatttctacatcctcagaatacaataagggccaagctgactgtgtcagggtgttcagagttagtaggcacacaaatgaaaagatggtgctctcagagttttatgaatttttctgtctagcagtcttgggttggaaagtcatctttgaaattgatgtagctatcaactaggggctaacattaagatttcagtcgaggtgtatagggttatgatctttctgttactgtcagaactgcagctgttgtatttgcattgagtggcatgctggagagagcaaaatgggatgcaggagaaggaaaaagaaatagcaaaacctattgaattgtgggctctacctgagggcatttgttaaaggtaaattcatcaatagctgttaagtcatttgtattgaatcattctcatagcctcacagcagttcttagttttaataatgggtcatagagaggagcttggtgatagatgccttattatggtatttaggcacttaattgcaactgggcttaaaatagcagcagaagctgaaaccagggtggctcaggagtaaattatgttttcagtctaccaaaacaccctttttaaaattcaagtttaatatttcttgacatatgtttcttgatacgctgttaacagcagtttatcagagatagaagaatgttaaaataaactggtgaccgaactatggtatctaaaggcatgccttgttcatcaccatcagagatattttgaaagaaacattgagacccaagtttaaaacacctgcaattatgctgggacaggggtgttcattgattcattcattcatgcattcattcattattcgtcatttattgctaatgttaaagggatagggcagtgtatgagacagacccttgcctttgtggactaattattcagtggtggaagtgagaaaaacataaatagttaataacaataaacgccaaagggggatgtgtgtgatgatgaaaccaggaagctgaaatagtgagtgatggtagaagatacagtagtgttttcttcagattagtgggctagggaagtgctcttggagaagaacccatttaagcagaggtctgagtgatatgaaggtgccaactggccaaaaagaggaaggatcattagaaacagaaacagcatgttcaagggccctgatgtgggaaagaactaaaaggagatcagggtggcaaagcttagcagagaagtcagtggaggggtaggacataggtttgaatagcagataaaggccaggtcctgtgtggccttttcatttactttacattttattcgaaatacaatgggaaacaatgaagagttttaaggacaagggtattgagctctgatgtatattattaggagattgtttttattgactctagaatggatggggagtaggtggctaaggaggaagttggcagtggtacgggagagaaatgacagtgccctctaccagaaaaatgaatggactgaaaatgtacttagaatgcatgctagtagataaagaggaactagctaggaagttccctaaaggagggtggtctgtattcttggggcatttgtaccctgatgactgaacatcctgacttcctatgtcttagtccatgtacagcaactctttgcctcacttgtaggtgaaatgattttggagtcactagttggataaagaactagaaaggtagaacatacagtgcttcctctgcacatctgatttgggagttttgaagtttacttgtcttagactgcatgaaatgtcaaaggaagccagtaacattgatttatttcttgagtccgttggttatcatcagcttgctgcttacagtatacaagcagatagagccagaagcggcatttccaggaattgaacctgcgttgtttactgcccctgtggtcttatgaagaatgtgtgattatcgtaacccacttgctattattttcataacaaagctgtctctgaccagctacaatcttggacttacataattgaattttagatggagatgcgctgctggtttatatgaattttccaggggtgccagcgtgagtccaggctttaacaaacaatatttttaattgagattttatgtccttgccctcaaatcaagcactttaataggatcccagttggaataggtgactcagtaacaagttaccactgctttcaacttcagaaaggtgttaatttctctaactcctgctgggcgtccatctactccggtgacccactgcctgcatgtaccataaaaacgagtgttttgcattccattagtttcaaagtacagccttagtagtctgcatatttcttgtagcatgtgctggctttgttccatcaggcaacattaagatagaaaagtattaaaaatattgatttgtcatttataacatcgaagtgatagattgaaatgcaatttggatgtactccagacctccaataactttgacattatcagacgaaatacaatgatctcagtctaattaatatgctgtgtccatatgagtaaagtagagagaatgaagcaagaaattggccacaaggaagtgatagctccatgtttcaagtagttgtagaatttagagatggaatatgacatgctctgtcgctggaccttgctatgtgctggaagctgtgttctttccatgtttgttcatctttgaaagcaagttagcgcattcctaaagaatagagtgatactcttcactgaactttgtaaacttctttaagctttttattatggcatcttgccataatgttcttccattcccctgctctggaataccggtaataactctaacacacacacctttctgcgtatcggtttcatgcaacaggtgcacctatcttgatttcaaaactttcctatccccctttcccttactgcttcttcacttccatcctttcctgctggtaatgaaattgtcaaactttattcctactcctatttttttttttttagcagggttctgtgttctctgtcagcctctctgctcacatattgcagttcctctgttctcccagagaatttttatcttcctgttggcaatatgtttatacggtgtgaatatgtaataattgtacttggttgctatggagaagggaaaaatacaaatgtgcaaatttcaaatacacaattgtgcaaatttcaaaatttattgtaactttttcatagtggtcatatagtattattaggaagtaatggcataaaaaaatacaaatattgaacttgagtaaacatcatgtatactgaaacttgtagggggtattttaatgatgtgtgaaatttactttgaaatgcaccaaaaataagatgggttgatggttgcagagagggatggacagatggaaatagctgggataaagcaagtatagtaaaatgccagtagtagaatataggtggtagatatatggatgtttgctgtaaaattctttcagctttgctgttttgagatttgcatactgcagtattggaaaaatatggtacaaaagtgaatagtcatatagtcaacacatagactgagataaaaattgtgtgcctgcattaatatctattcttttatttagggatgctttcaggaccgtagttgcaggaagatcatcttgctataacccagtgtccccctttcatctcctataccatgtctctctgcctgttttcttcttctctttgaatatttgttacatctgtcttaatagagactgtgcaatttcatctcttcatcaactcctgtaagtagaaccagcaacagagcgaaagggagaaaaagaaacgtacttctcgcctgccttccttttctgtctccccgtgagaagcctcgtgccctcctcctgtcttgtgtcttgtgtcagagttagcggagcagcagctctggcctccttggatttatgtgattcgtagtgagagaatgctgccacagctgaggctgttgcctgctctacattgattgagtttcctgggcttgagggatttttgccgagctgagttttatggttgatgtgctctcggtcatttgtcataaaatcattcccaccaagctgtttactgggtttgaatgcttaattactgaaggagaagagaatcactccttatggagctgactgttgacttggatgctttttactgggttgtcttctggtacccaactcttgctgagtagtttatccaatatacatacccactcttcagcataaaaaaataaagacacccataattttacctaagtattttgagcagtgcaaagacatatcatttcacttcatattatgacagcatttttcttttgagtacaaattgattgcaaaactcaacactcaggcagctacagctaggaaagtgtctatgctctggggttcaaatgacaatgttcacctgctttattcagatcaatttccagaaatgcattgctgactctccgccaactcaatatcctcaatccaaattgcataaatggtgttggatataattatctctctgaaaaatttcacctaaattggaattaaatttatttgtaaaagcaaagtcatcttgggaattatatttcaaaacctacggtcgaagattcagtgaatgaagctctttccttttgtttcttccacaatttcagctcctctttttcatgaggaaaattgaagcactcttcgggttcccactgctccctcctctgcactaattcccacatagaatttctctctacaaattggcctccactaattttttgcattggttgtgtcttgttgaatttttcaggagcacacttttatatacggggatgttgttttagaggtgggagaaagagagaattagagagagatgcaggaaatggaatgttgttttttttttattattatagtttaagttttagggtacatgtgcacaatgtgcaggttagttacatatgtatacatgtgccatgctggtgtgctccacccattaactcgtcatttagcattaggtatatctcctaaagctatccctcccctctccccccaccccacaacagtccccagagtgtgatgttccccttgctgtgtccatgtgttctcattgttcagttcccacctatgactgagaatatgcggtgtttggttttttgttcttgggatagtttactgagaatgatgatttccaatttcatccatgtccctacaaagggcatgaactcatcattttttatggctgcatagtattccatggtgtatatgttgcacattttcttaatccagtctatcattgttggacatttgggttggttccaagtctttgctattggggatagtgccgcaataaacatacgtgtgcatgtgtctttatagcagcatgatttatagtcctttgggtgtatacccagtaatgggatggctgggtcaaatggtatttctagttagatccctgagtaatcgccacaccgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtctcctgttttaatgccaagataacccgtcagaacacctgaaatatttgctacagttttgatgtttcatttatctcttagtggagcattgtgttgtttcagtgttttatcatgaagaactgtggctcttttaactgtaaggaatgagaactttagtaaaaacaacttttaatcactttgctataaatataatactagagaattcgtttcttggagtatgatttccctgttattcaaaaacaactacttgtcacccccttgtactttggccttcttttttcttctccccttcttttaactgttgcccctatttggagcgattatacttaaagtaatatggattctttcagagctgccaaaaggtgaaattgactttttgagaatgtattgctgaaaactgcagcagatgcactttttccatgtagaaacatcctgtgtgttaagaccgaaagggaccatttacagccagtttcaaattgctagctgaggtcaataagtgcccacttctgcaatcacatcagccccgtttggatgacagtacacaatgaggtgcctcccagggagtgaccacattggcagcaaaaccctttttgcaagttttatttggtcattcatagtagaaacctttaaaaatcttcaacatttaatttcaagcatttaaaaaatatatactgtagtaccatttacctataactggatttatttaaaaattatatggattggggaaaggacaccctcttcaataagtagtgctgggaaaaaaatggatatccgtatgtagaagagtgaaacaagaccctatttcttaccgtatacaaaaatcaactcaaaatgcattaaagattgaaacccaatactataaaactactagaagtaaacataggtaaaatgcattaagacactggcctaggcaaagattttatggctaagacttcaaaggcataggcaacagaaacaaaatatacaaataggactatattagactaaacagctttggcacaacaaaggaaacaatgaatgcagcaaagagaggatctgtagaatgggagcaaatatttgcaagctattcagtcaactcatatccagaatatatgacaaggaacacagtcaactccatagcaataataataataataatcccatttaaaaatgggcaaaggatctgaataaacatttcttaaaagaagatatacaggccgggcctggtggttcacgcctgtaatcccaacactttgggaggctgaggcaggggggtcatgtgaggtcaggagttcgagaccagcctggccaacatggtgaaactccatctctactaaaaatacaacaaaaattagccaggcgtggtggcagacacctgtagtcacagctccttgggaggctgaggcaggagaattgcttgaaccgaggggatggaggttgcagtgagctgagatcgtgccattgcactccagcctgggcaccaagggcgaaactccatctcaaacaaacagacaaacaaacaaacaaacaaacaaacaaaaaacatacaaatggccaacaggtataaaaaaaatgcttattatcactaattatgagggaaatgcagatcaaaacctcaatgacgtataatttcatcccaattagaacgactattatcaaaaagataaaaaataaatgctagcaaggatgtggagaaaagggaacttttatgcactgttggttggaatgaaaattggcacagctaatagggaaaacaatacagaggtttctcaaaaagactaaaaatagaactaccataaaatccagcaaaatcccactgtggatatttacccagaggaaagaaaatcaatatctgaaaggacctgcacacccgtgtttactgcagcattatttacaatagcaaagatataaaatcaacctaagtatccattaagagacgattagattaaaaatgtggtatatatgcacaacagaatactattcagccctgaaaaaggatgaaatgctgtttgttacagcaacatggatggaactggagggaggtcattatgttaactgaaataagctgagcacagaaagacaaatatgacatgttctcattcatatgtgggagctaaaaaagttgatctctggaggatagagagtagaatggtggttaccagaggctgggaagggtagagaaggtgggatgaggggaggctgattaataagtacaaacatatggttagataggagtgagttctagtgttccacagcatagtatggtgatgatggttaaaaacaatttattgtacatttcaaagtaactagaagaaaagatttgaaatgtctccaaccatagaaatgacaaatgtttgaggtgatggatacccccaattaccctgatcataacacattgtgtgcatgtatcaaaatgtcacatgtaccctgtaaatatgtacaattattatgcattagtaaaaaaagattttaaacaattacaacaacatccaggttttgttggttgtttttaatgcggcagaccctgtcctctattacattgaactgtcacacttttaagaagtcagtccaaactactatcttctttataccaataagaaggatcaggacacagaaagttaagtaaatggtccaagtcagtaaatggggattcatgattttgaaactttgtggtcagacttcaggtactgtcctcttaatgtcttgctgtgagatttgagatccaagataacttggcattgttgagatattgggaagctactatcagaatcagtcctctgcttgctttgttggtgtaaactagagataatttagtgtaaaatgtcccaataaaaattttcccccaagcatatgtaaaccacgacataatagatttatcaaagtagcagaatgctattatgttcaagagattaaccagaccaaagctatttgtcatagcaacgggtgctagagttgacaaattacaattgaacccagtttgtagcaaaatgttagacagagccttggcactgattaattgacgtgagagtccagcctagaatacattagagcaatttaaatatcattcaaaacagaatataaccatgctctctaaaacatcccaaactgtaccaagcaactacatttgattgattctataatgcaaatattttatgcctaagacttttaaagcacagactgtgttagtagcaagacacaccaccaatttagtaatttctaattaaaaagaaaatacattttacattaaatgcttatattgattgccaaggaacctgactacaggtcttttaaaacttgcatcatggggttgagagggacaatcatctcttagaaatttcttaaaaagaaactttaactctgggtaatgtgtttaccctaattagataagaaacctcatcctaataaaagtaatggactgaaggtgacatgtgttcagggagtcgggggggaaagagtttagaaagaggaaaagcctttgctttctaagctagaaaaatggatgttgaacttaaatctattcagacaatgatgagctagtcatattgtcacaagaataggttacctctttcttgcatttaaggttcccgttatgaaacagaaaacaagattatattctactgaaaataaagttgaaatggagtagaaaaagtggagtttcatattacttatcaattcttttttttttttcttttgtgagacagagtctcgctctgttgcccaggctggagtgcagtggcataaccttagctcactggaacctccacctcctgggttccagcagttctcctgtttcagcctcccaagtagctgggattacaggtgcatggcaccacagctggctaatttttgtatttttagtagagacagtgtttagtcgtgttggccaggctggtcttgaactcctgacctcaggtgatctgcctgcctcagcctcccatagtgctgggacccaattaattctttagtcaaccaacttcatttcttgatatgtcagttgtctgtgtgtgtgtgtgtgtgtgtgtgtgtgtgtgtgtgtgtgtgtgtgtgtattttcagtttttgtccatctgacagttgctgttgttttcattgttaggatatgagttccagttccagtatttctgtggcagagccttttgttctttagcatgtagggatttatttaggtctattacttgttttcactttctctttgccttttcttaaatttcaactttaataatagcctttaatagaataacagtgcattagctttcattgactacatgtatgctgaagaattcatgctaaagaaataataaggaatgtgtgccaagatgtggctatgaggatgtttattactagattgtttataatagcaagacagtggaaaattacccaaatggcctataacagcgaactgatgaaatcaagtatggtataaggctacagtggaattctcattagtttattaatcatttatcaaatattagttgagaggatattttgtatcagcccttgtggagtctctgaatatgtagccttcaagggcattaatagtgaaatggtggaagaatcgtcaatggcacagcaaaaggtgagcatatggctcggggagtccaaactcagtgtgatcttgttttcattaaaagataaaaggaaggtagaaatatgttttcttaagaaaaaaaaatgtacgtacacaaagataagcatcgctatgtttgactccttggatatttattctctaaatagtttgtaatgaattcctcatgtctttaagcaggaaacaaattgcaaatggtttaaaaaggcaattgctttaaaggattgaggagagcattggcacctatgtttctgttatctatgaaggtggaaggggaatcaagatggtttcagtcttttgtttttaaagcaaatggaattcttcaacatcttaactatcttttaactcttgctcttacaagaagtgatactttaatgtttaagaaaggcatgtattattaagaaaaaataagataaaataccaaggataccagcaatcacagcggactgagtggtatgtgaaaagataaacagtaaatgcttttggaaggaattgttagtcttctcgacagtttagcatttgatcttgttttgcgttggtagactgacttgaagtactagactgaattgggtgagacaaataaaagcatatactggagcagagagatccaatctttccctttctctgcaaggtttgtatttaggttataaaaataagtgtaggagggaagattagggcaaggcacagccttggtgcaagatgcagagatgagcagtcacgtatttcacacagagtaggatcagagattccaactagaaccaacaccaacagtgtgtggccccagggagtggcgctgcctctggtcaatgccacccaccagaattggactctaatggatagatcttcctagcactgcgtctggtcaatgccacccatcaggatcggactgtaatggagagatcttcttagctctctccctaaaagttgactgagccatctttccaattaataagaaaataccaaacagaacattaaagtttatagcttcacatttttgaattaaattacctattgattagtagggggctatcattaaaaattagcacaatcacgactgacaatgccttagaaattttcatcatgatgactttgatcaaattgtaaatgtgaatctgtactttattttagaactaaaggaggcaaatgagcaataaatttgaagcccaggtaattgggggaaaaagtaatcaatttaatccgtccgaagggctaagtgattcagagaactgacacttggatatttggttgaagccttttgtctgaaaatgtcacttgtatatgtttaagaaaatattctataccagacatacatttagtctttgcatctcttatgttgttagttttcagtttttaagcataaactcaaggtaacagttttcctgttagtttttagtttttaaacatacactccaggtaatagttttcctttctcccaatctcctttttttttttttttttttttttttgagacagagtcttgctctgtcacccaggctggagtgcagtggtgcgatctcggttcactgtaacctctgcctcccagattcaagcagttctctgcctcagcctcccaagtggctgggattacaggtgctcgccaccatgcctggctaatatttgtatttttagtagagacgaggtttcacgaacttggccaggctggtcttgaattcctgaccttgtgatccacctgcctcggccccctaaagtgctgggattacaggcatgagccaccacgcctggccctctctctccttgttgctactacgccatccagactccagtcactcaaagcaactacatctctcattccaagcaggtaccttcttcctcactctaatcccacattgtcttcacctctagactgatgatcatttatctctgacattttttgttcaaccacagcccacttatgcctgccttctcacgtgccgctcaagctcgacaactctacaggtgctaagatgaaatatagtgtagatgttaaaaggatttctctggagcctgatctccacatgtggttctatcttctgctagttgagttaccttgggaaattagcttagttttctgctacctctgtcttctcctctgtaaaatgtagtaacagtaacataaaaattccatagggttataattagaattagataaaataactaaataattgcaaataatctattatgtagagagtgataggttatatatgtagtgtctagagtgcagacttctagtgaaaatactgacttttggtcttcagtaaactagtaatatgtcaatgttggctttttcaaagtaatttttagcaacccttactagtgcacttagaaggtaaatattagcaaacagtacttaattgaacataccaccaccgacaatgaaattatggattacctacctgtaagaacaaaagaaaaggtgtgaatttttggattagtttatggctcaccagtgttacccctttacaaggtatacgcccacggtcgttatgttcaaaggttgaaactctagactactatatttaattctcctcaagaatcttagatatgaaaggaacagcaaaagtcattttatcaaaatttagtcctggtagaagaactccattaaacttggcatttggttatttgttttgggccccagtgatttgctaaagaataggttgagttctagagatagaaaaatagtaaggtaaagagccttaccccaaggggatagggggtagtcaggaagacaggcaaggaaacaggcaattgcaaaataaaaaccaggtgttaccagagtcatagtggctctcaaaggaggtacctctccttgccttgggtgggagtaagtgggtacaaagagaatttcagagaaaggtagcatctgagctgaaacctgaagaacaagtaggagttccccaaatgaagatagaggaatacagcaaagaaatttgcccagtgcaaataggaacatgcaagatagagaatgtgacgttcattcatggctgtttattattaaggtcctacaatatatcaggactgtattacgagaacttatgtaaatgtcagaccactgtctcctccacctctaaaatgagttttttcagggcagaaactgcccaatttatctttgctaacctaatgccttcagctcaatgtttatcaagtggaagatgttcaataattatttgttgaaggaatgaattaatcaataaatggtttatcacaatttcctcctgttagtgagaagcaaagtcattggaaaaaccatttaccagtatagggtcaggctagacacttgtaagcccatcaccagtgattactttcctgttggagagccatccattccatcagtattgtttggcacaaccattcaaccagcaaactgtatcttcatgggcctgtacacctgtcttattcatggatatttcacaagcgtaatggcagatgtgtgatttctgacctctcctccaacctggttgacttgggttatagcaacagagaaaatgagttttgcttggggttatttcttaataagctatcattgaccattaatcatcaacaaccacttgcctttccagtgtctcaccaattacgtatttcattctctgttctacctcccagcaaagtatcgggtctgttttaggatttacgtttttattagaatgtttgccccttttagcctgatagcacgtttatcattccaaaaccactggacggattccacacaaacattaaatgtttaaatgtgttcacactgaaacgtgtgggaatagcaaatggtcttttgttgtaacttttgaagatcttctgtaattcctctatttcatttgcatattgaagtgcttgcttatgttcaggaacctgtgcttagcgtttgtatatgtcctatggttcccaatattaatgagtcctggagaaagttgaatctgcaagtttctttacagtggccatcagggaatgaggtagcaggatgttaatgctgtctgcatgctgtgaaggatgataaactgtacttgggtgaccttattaatcactcataacgtgatcttaaaggtatgtgcattttctgtgcctcccagtctttgcgtatggagagggaaagatgggcattccctagtccccttaagctctaggtgccctcaatatctcccacttgagcatctgaacttcatctcagttttatgacagcagctggcatgcaaattggctggacttgaaagcactgaagttcacctcactttgctcaatctgtgcacaaatgatcaagctcagcaattttgaaaatggcccacccttttaaagggaaaacctgaaatattttcagtccttatggtagtcgggccaagcagtgtctggtagcccattcttagttctgttaccagcaggtaatgcaggttagcttgatgagcacaactctttgtcttctctccacctgtctctgtccattcattcatcccacggatgcttattgaatgtccactcaatgttggagcaacaacaggaaataaggacatggtttctgtccccatgggacttacattctacttggatatactagggagaaaaaagagtaaacaaaacaattagagatgataattattaagagtaaatgcatgggctgggtgcagtggctcacgcctgtaatcccagcacttttggaggctgaggcgggtaggtcacttgaggtcaggtgtacgagaccaacctggccaacatggtgaaaccctgtctctaccaaaaatataaaaattagctaggcatggtgacgggtgcctgtaatcctagctactcgggaagctgaggcaggagaatctcttgaacccagaaggtgaaggttgcagtgagccgagattgtgccactgcactccaacctggatgacagagcaagactgtttcagaaaaagaaagaaataaaaaagaaaagagtaaattaatgggatattgtaatggagaatcataatgtgtgtgttggctaaggttttcagaaaaaaaaaaattcatggtgacatgaaatttaagcagaaatctaaagtcctaaagaatgcgagggaatctggggaagcgtgctctaggctgatggaacagcaagtaaaacgacagggaatctgtgaacagtttaccttgcatgaggctctgaatgcagcacgtggtaagggagggggtggactaaaggctggaggaacagaatgaggccagaacacacaggctcctgcaggccaagatctgggtttgattgcaaacacaatatatagctcaagtttactttgtactcaacaaaatccattctgtctaccactggaaataatagcaaatacggcttgttggaaagtccgtgtgtaacttatctcttattattgctgagaggatcaggaaaaataactgttgagtattagactgaatacctgggcaatgaaataatctgtggaacatacccctataactcaagtttatataacaaacctgcacatgtacacctcaacttaaagtttaagaaaaaaagaatgctggtgggaatgtaaatgagtacaacctctatggaaaacagtacagagatttttcaaagaagtaaaagtaggtctaccattcggtacagcaatcactctacccaatactgggtctctacccagaggaaagatgcctgcttgcatatatttatcataacacaattcacaattgcaaagatacagaatcagccttagtgcccagcaaccaataagtagataaggaaaatatggtatattcaccttgaaatactactcagccataaaaaagaatgaaataatgtcttttgcagcaacttggatgaaactggaggtttcttctaagtgaagtaactctgaaatcaaaaagcaaatactgcatttcttcacttgtaagtgggaactaaggtatgaggatgcaaaggtatacagtatgatggacattggagactcagaagatgggagggtagaagggggatgaggagcaaaaaactacctatttagtacaacgtacactactcgggtggcaggtgcactaaaatcctagatttcaacactatgcaattcatccatgtaaccaaaactaacctgtaaccctaaagctattgaaatttttcaaaaaatatttaaaaagaaaaaaaagcaaaattttagatatggagaaaaaaaaagacatgaataagagcccttcagtccaaccagaatttgatttcactttcctctccttgtcattgtttttatacagctctttatctctttccaacagaaaaagtaaagaatttttccttttttatttagttttttaatgttcagagtggaaaagacataacttttcctacttgagcatttgtctgttttttcattgtaaatattattattgtccctgtagcctgggaggcctttcaaaggtcacttggccttttctagtacagtcacatgcccttcttcatttttaaatctttgagggggagaggggaatgagaaaatattccggaatagcactgtccaatagaactttctgcaatgacacccatgttctttatcatcagtgtctaatgaggtacctactagtcacatgggacttgtgagcactcacagtcaagctagtgctaccaaggagctgaattttaaattctatctaattagccacatgtggccaacagctgtcatcttggacaacacaactctagagcctcttctgaatgttatgccagtgaattcactgaaattcacaactggaatttacaccagtgatggtcttcatatgggcttccgttagtgactttggtgaagtttcaggcgagacctaaaggatgggaggggatctggggaagcatgttctaagctgatggaacagcaagtaaaaagatactcagtctgaggacacttgacctggcatgaagctctgaatgcagcccgtggtactagcccttggtaagtcgggggaggctgaaggctgaaggaacaaccttccagctcaattccaggtcatttctggtcatggcgaggtctttttcacaaaataatcattgttttcatctattcagtatccatttcctcatcctgtggtcctataattgcatttttcttaggggaccacctctcttgcatttttcctccatacttccagagagctggctccttaccgagctctagagttgggtatggaacctaaacctagccagctggcataactccaattcccagccacagggactggctcctagatgaccaagtggctcaagtctctccaaggagactcagtctcagaacacttgttaaagctgttagagactgaacacattgagcctgaaattgatggccatttctctgcccccctgagaatgtggccaacctcctagaaagaccacagggctaggactgagttccaattctctgaatgtagccctgctgcaatctataattatcctgaggtttttcacttatgtgaacgaatacatttctttttttgcttaagccaatttgagccagtgttttaatttaaaacctcacccccaaaaaaattctgatgaatacaataatgtcaaatatagcatttgtgacagtataaatctttcaaatcccaaagaactcatccctaagaaattatggagaggctaggtgtggtggcttatgcctgtaatcccaacactttgggaggccaaggtgggcagatcacgagatcaggagttcgagagcagcctggccaatatggtgaaaccccatctctactaaaaatacaaaaattagccaggcatggtgacgggtgcctgtaatcccagctactcaggaggctcaggcaggagaatcgcttgaacccgggaggtggaggttgcagtgagccgagatcgcgccattgcactccagcctgggcaacagagtaaggactctatctcaataataataataataataataataataataataagaagaagaagaagaagaagaagaagaagaagaagaagaaattatggagaaaactggacaaaactgggagtacagaagtggaaaatcacattgtgaaggagctagtgaattttctcccttagttatttagctggaaatatgaatccactgataaaggtggatttgcttggcccccgaggcagaggttgcagtgagcagagattgtaacactgcacttcagcctgggcaatagagctagactccatctcaaaaaacaaaacaagaccgaaaacaaaagaaacaaggacctcactttttactccatatacttttttttcctgtttttgcttttttaaacaataaatgtttgtaatttatatgacaataaagagtcttattaaaaagtatttcaaaaattttttttcttctagggtagatggtgtagttttcttattctttgaaaatacaaatataattgctccaagcaaatcaaacatataagagtgcagagagagagggaaaattcccccccagcccacacaagccttctaaatgtacttcccttcccagagaaaactactatgaatagtatctattttctatacattgacaaaaatatttagagatagtgggtatgtatgagagaaaaagatggatcaataaatacacatctacaaacatatatgatttggtttaaatatcgcctacctgtatatattcattagtatgcgtatgtacaggcatatatatgtaaaatatatatgtacctatatatatatatgtatatatgatattatgatgatattatttttctttttttttttttgagacttgctttgtcgccaggttggagtgcaatggggcgaactcagctcactgcaacctctgtctgcaggtttcaagcgattcttctgcctcagcctcccgagtagctgggactataggcacccaccgtcatgctcggctaatttttgtatttttaggagagatggggtttcaccatgttggccaggctggtctcaaactcctgacctcgtgatctgcctgcctcgggctcccaaagtgttgaggttactggcgtgagccactgcgcccagccaatattacttctttttctgtttaacagttgatattgtttggctgtgtccccacccaaatctcatcttgaattcccacgtgttgtgtgagggactgggtgggagttaattgaataatggaggcaggtcattcccacgctgttctcatgatagtgcataagcctcatgagatccgatggttttataaaggggaatttccctgcacaagttctttctttgcctgctgccatcgatgtaagatgagacttgctcctccttgccttccaccatgactgtgtggcctccatagccatgtggaactgtaagtctattaaaggtctttctcccgtaagttgcctaggcttgagtatgtctttatcagcagcatgaaaacagactaagaatacagcagtacatcaggaatattttccatgagctacatctccactgcaacattctttttagcaacagtgcagcattctgtagtttgtatgtatatccttaatggtttatcacccgccttttaataaacatcaggctgtttcctgtttttgcctattcgtgacaatgctgaaacagcttcattgcgcataagcaagacttctctatggcatctccaaatgatgactgttggctctaatgtataatacgagtgtatcttccatatccctctctgctaatgttccctgctgatgtaggataagcttctgtggcttgatcttggctgataatttgggtacaaatctaacaaaggcatgagatgtgttctaaacttacctctagaaaagtcagggttttttttgcagcaatgatgccacaaaacacattctgaggacaactcaccacgagtttgaagatgatttgtttggagcgatttgaaatcaaagttcagatttatttctcataagtctgttgtttagagggggatttcgtgaactgttcctatctatgtgccttatgcctgcaggctacaggtcctttatgagatggctatttttaaaggaacacctctattctcaggatggttgacaggacttttaatgaggaaagaaattagaaatcagagctggaggcaaagtggtcagcagaaaggaaagaaaaacaaggaacttgtattaagcagaaaggcagcttagtataccctttcaagtgtctgttattgtaaatattcttgtatatatccattagcagtcatgggtgagaactacagaattttttgggttatcatcataggaaagtacttaccacatctccacaggctcctcattttacttaaacttgaccaaatccagtagcaattgaaactgtacaaatcaaataatgtatttaatgcaacagggcaggggttggaaaactgcagcctgtgggccacatttactccacttggattattattatttctgtaataaagttgtattatgtatacccagctgcacctatgcaagcatatatttctgcggcagcttttgggtaccacggcagagctcaatattaggatagccctgcaagtcgaaaatattttctttctgcccctttacggaagatgttcgtcaacctagggaatctcacaatttcaaggtgttccctgttcaatttttttttttaatgtgagaaaagaaatcaatctctactcagaggctgcagagccttcctgggaggagagaagagtccacaaagttctccgtctgcctgggaggcagatgcagatgagaggaagtggcataggctgagctgtacctgctggattcattcttcttgtctccccagttgggaagttaaggaagttactctttatatgacagggaggaaatgagcaatggagagagcccatttctaaatagtagggctgaagtctcccatggataatgcaacacagttgtcagtgacacaaaatgatgtgcttgggtctgagaattacctcttatttggaggccgaattgtgtctccactacccccgattcaaatgctcaaattctcacccacaggacctcagaatgtgagtctgtttggagacaggatccttaggaagttaattcgggtttcatgaggttattaggttgggcccgaatccagtgtgtttggtgtccttataagaagaaaaaatcagaacccagacacacagagagaataccatataaacaacacagagggggaagatggtcgtctgcaagccaaggaaagaggcttcagaagaaaccaacactgcaaacaccttagtcttgaacttctaccctccagaattgtgagaaaataaatttctgttgtttaagccacacagtctacggtgctttgttacggcagccctggcaagctgacacacttctgctcaagtctatgttggtatcttcttagatatgatgcagatagtacacagatctttctgacgcctaagtcagcagccctggcaagctaatacacttctgctcctgtctgcattggtgtcttcttagatatgatccagatagcagagagactttctgatgcctaagtcagcagtcctagcaaaccctagcaagctgaagccaacacacttctgctcaagtctaccttggtgtcttctcagatatgatgcagatagtatagagagctttctgatgcctaactcagcagttctcaactgtggacaattttgctcctcaggagacatttggcaatgtcaggaggcatttttgattgtcataattagtggagcaaggcactataatgctactggcgtctagcgggtggaggccagggatgctgtttaacatctcacaatgcacaggacagccccctatgacaataagttacccagcctaaagtggcaattgtaccaagactgagagttcctgatggggcagaagatgcattactgtcaggctgtgtcttttcccttctccccattagacctttggtgttctttgaaggggccggaagaggttatctcctactctgggcattgtgtagaatagctatataagatcctcaaaataattgaaacggaaagactcccttcggctctttctgccattccagtaaattcctgctaagtatgctctaggaaaactatgaggtgctgtatgatttctgtgacaggaactgtggctttcctgaggaacagtcttcctttcaatgctgttaacttcccccaagtttgtggtctgttggtggttccggtgtgggcaaagaggaatgaatgattgatggactgtgagcctcccaagtagaagtgggctagtggggagtttttttaatatcatattttatatacaactgcaggtcaggccaggctatggatatacagtgcctgaccctagtacagaggaaggatcgattgtgctcaaacagtgagctatccaaataatttatttatgcagcaatgcagctgtctgcttctttggaggtgggcacaggctggaagggttttgtgtgtgcgcacgtgcgtgtgtgtgtgtgtgtgtatgtatgtgtgggcatggggtgcatttgtatgtgtatgtgtgggtatggggtgcgtttgtgtttgtatgtatatgggtgggtatggggcgcatttgtgagtgtatgtgtatgtgtggggtgcatttgtgtgtgtatgtatatgggtgggtatggggtgcatttgtgagtgtatgtgtatgtgtgagtgtggggtgcatttgtgtgtgtgtgtgtgtatgtggactttgagtgcatttgtgtgtgtatatgtgggtgtgggatgcatttgtatgtgtgtgattgtgtatgtgtgggtttggagtgcatttgtgtgtgtgtgcatatgttgggatgtggggtgcatttgtgtgcgtatgtgtgggcctggggtgcatttgtgtgtatgtgagtgtatgtgtgggcatgggatgcatttgtgtgtgtgtgtctgtgtgggcgtggggtgcatttgtgtgtgtgtgtaagtgtgggcttggagtacatttgtgtgtgtgtgtgtatctatatatttgggtgtggggtgcatttgtgtgcgtgtgtgtgggtgtggggtgcatatgtgtgtgtgtgtgtgattgtatttgtgggcatggggtgcatttgtattgggcttggggtgcatttgtgtgtgtatatgtatgtgtgggcgtggggtgcatttgtgcgtgtatgtgtatattggggtgtggggtgcatttgtgtttgtgtatgggtgtggggtgcatttgtgtgtgtgtgtgtgggcatggggtgcatttgtgtgtgagtgtatgtgtgggtgtggggtgcatttgtgtgtgtgtgtgggcatggggtgcatttgtgtgtgtgtaagtgtatgtgtgggtgtggggtgcatttgtgtgtttgggtatggggtgcatttctgtgcatgtgtatgtgtggatatggggtgcatttgtgtgtgtgtgtgtgggcgtggggtatatttgtgtgtatctatgtgtatgtgtgggagttgggtgcatttgtcttggggggcatagggtgcaattgtgtgtgtatgtgtgggtgtggggtatatttgtgtgtgtctatgtgtatgtgtaggagttggttgcatttgtgttggggggcatagggtgcatttgtgtgtgtatgtgtgggtgtggggtgcatttgtgtgtgtgtgtgtgtatgtgcatgtgtgggcatggggtgcatttgtgtgtgtatgtgtgggtgtggggtctatttgtgtgtgtgtgtatgtgtatgtgtatgtgtgggcatggggtgcatttgtgtgtgtgtatgtgtgggtgtggggtgcatttctgtgtgtgtgtatgtgtgggcgtggggtgcatttgtgtgtatctatgtgtatgtgtgggagtttggtgcatttgtgttgtgggggcatggggtgcatttgtgtgtatatatgtgtggatgtagggtgcgtttgtctgtgtgtatttgtgtgggcatggagtgcatttgcgttgcgggggtgtggagtgtgtttgtgtgtgtgcacacgcacatggttctcatggtcctcccgttttcaactgaacctgtaattagctcctcagagaccaggtaatcacagtttgctttttctacctgtaaatgctcattggctttctgatttcccattaatttcctagctttaaattaccaagaattggactttttgtaaaataccaagttatcggaacaaagaccggcactctgggaaggcaaatgaaaaattccagtgtctctgtaactgagattgcctgttattagtaggtttctctgtctgtttggttttgtctacatttgaaaggaagcttttgaggaattcatggagcatgtctactctattccctcccaggtgagatggtgcccctccaggaaagtatcagaatgcagccattagggctggacatttctaactggccaagtctacacaggcataacaaattgagcaattgtggttatgatcacaatttctaaaactgggactctaaataataggttccagaagcaaattaaatatcaacaacccaattaccttttgtctctgctaccaagcatgaattctgatagtcattgtcttacttctctatgttcagagaattatatttaagggaagaagcagctaatgataatttactgattgttacaaacaatctacatgtcagctatatagagtcatctataggaattaattgtatgagctatatatgtcaggaatatatagagtattcttgacagtaaattagcattagcattaaaacgattagtattataattttataatactaattataactattagttaattagttcaactgttgagttgaactttctgcaatggtgggagtgttttatacctgagctttccaatatagtagccatgagccgtatgggcctactgagcatttgaaatgtgattagtgcaactgaggggcttttaaaataattttagttaatataaacttaaccccattgagtagtggctaccatattggacagtatacgtctataggccctaatctcatctcctctttaaaaagaatgaatatgtatctttattaataatctgtgttcatatcttatataacatacctaaaaatgtagacaaggcagggcgcagtggctcacgcctgtaatcccagcactttgggaggccaggtctggcggatcacgaggtcaggagatccagaccatcctggcgaacatggtgaaaccccgtctctactaaaagtacaaaaaaaaaaaaaaaaagttagcctggtgtggttcggacgcctgtagtcccagctactcgggaggcaggagaaaggcgtgaaaccgggaggccgagcttgcagtgagctgagatcgcgccaccgcactccagcctgggcgatacagcgagactctgtctcaaaaaaaaaaaaaaaaaaaaaaagtagacaaaaagcctacaaacagacacacccaactgttaagacctctcaggttgggattagaaaggtatgaagaaaggattttaacatcttgtcttgcctaatcccaaaaagaaaaaaaaataggtgataagattaaaaatgaatcaaataaatcagatgcaaccaattatatcatggaaccagttatgtcagtccatctctttgaattaaaattaaaggaaaaaagatggagggttctgacagttatctctctaatcgagacagccctctccctctctctgtccccttacagagaaagtgaatttgggagcttcggtcaaacatcccttgtctttcgtcaaattagtgcctaatgtcatcattttggtggctttcaaaggtgtgaaccagcaaacgggtgacagtgagaggaaggaacaagcatgtgaacaaatgcgtgaaccacagtcagtctctgaatggaaatccatgtgtcttatgaaaatcagttattgttgaaagccatttgcaaagcttccacgatcctcgcttggctggtgcacggctgtgagtgcttctttccaagtctcctgtgggtgacggggaatggctaaccagggattgtgttcacaggcatatcgattccaagtctgatcacagccacaaatttctttcccaggttagtaagaagaaatcaacactttactttcttggatcatatgtttttaaacattagtactgaggaaataaagaaagggagagaggaagaaaaaagaagtacaagaaagaatacactgggctgggcgtggtggctcatgcctgtaatcccagcactttgggaggccagtgcagacagatcactaggtcgggagatcgagaccatcctggctaacacggtgaaacccagtctctactaaaaatacaaaaaattagccgggcgtggtggcgggtgcctgtagtcccagctactcggggggctgaggcaggag[135 bp omitted]caaggagaagcaacacagtgcaattctttaaagtgcatacaattaaaacacatagaagaggaaccttggctagaattacagagcttgatcaagtctcatccatggttgacactgtttgttggatgatttggacatttggagcctctctatgtggggagagttttctttatccctttcaaatcggtatgccatctctacatacctgaattattataaaggtaacaaggttataagctcccccatgcctgccaggatgcactgctttgctgtgactgagccacactaggtgctaaacttttctgcactaatgcaatcaaattagaagttaaatctgatactgtaacaagttaccacctgggaacagaaatgctttgctgttttattttttcttcgtagcattgtgaaatgaacatggcatgtggcacattttaattacagcaaatattaatttttaatgggaaatgtacacctggctttgtattgttcataaattatctgagaggttgaaatttatttacgtgattttgatgcagttgtaattaaagtgaagaaactaatagccttctgtaattgaaggcacattaatctgaaagctacctgagggcagggattctgtgttaaccgtgttgtatactcaatttagtaaaatacgagtcttgggattagtggtcttgtatgcgatgtgctacacattttccagatatttctagggtattttctgagctttagaaaagtgataatatgatctagtactgtaggtaattatgtgctaagaaaagaggattctatcacattatctggcattgcttttttagttttgtaatggagtaattgattagtactactgcattttagcaaggtattttgctcctatacctagtggatgatgtttaagttaactctatttgtgtgtccctgagaaagagaaccgaggcaggcgctcggggaatggaacagggacaaagaaaccaaccaaataacactaggtatcagttttcagctgcatgtaaactcaacttattttttaatgattttattaggaagctttctacattctattttgtaatgcatttccctgagggaactttagaccttgcaggcctgtttgcaattcctgtcagattaggggggaaagaaagagaacagaatgatggaaatttcacacgttattcagtgttttaaaaatccagtttcttagcctgacagtttcttaaatctgtagaccttgatgttttaatcttatgcattctgatggagcttgatattcataactggtgggcttggtaaatttttaatcaggaagttgaatatgatgagaaaacacaaggggaggtttgtgttttgcaccttgtcatcaagctttccagtttcattttcactttttgcactaagagtattcctcagaggtgtcagagctgcccaaagctgacttccatccatattgaaatgactttttctgagctttccaaaattccaatttcagtgcaggtggtaatatctgaatgtgagcagcagaataaatagcagtttaaaactcatataaatatacatttatgctccatgtgtgaactcataaggtgtgggataaatcttgtcatttcaacataaacggaataacaaatagattgaaagtgggatgcactgttgcgaatacatgatctggatgcgcagtgcgattaaacagtgatggcttcatgagaatcgaatttcaaagatcacacaatcgattaaaacaattcagtctccctggtcatttttgtcagtaaattaaaacattaatttcatcccaagaatgtttttcagtgttttttattgtacaaagtaacaaacacatgcaaaagtagagaatagtaacatgattcctcatgtacccatccccagattcgataattaaaactcatagccaatcatgtttaatctatatccccacttgttttctccacattcctgaattgttttaaagccaaggccagacatcacacattttatccataaatgtttcagtatgtatctctaaatataattacacccaatccttcaacattaacattgattccctaagatgattaatatctgatcgctgttcagattttcccagttatcttacatatttataaagtttccttgaactgaaatccaaacgaggactatagaatgcaattagttaatatggctagagttccttagtctataaagagtaaagaactttccattcatattttactctcttttttcttagaattcttaaattaaagaaactagattgtcttcctgagtcttttgtgaaaaatatgattgtgaattttcttgtttatcgcacacaataaatccaccttataaattattgattgaaccaataaaacctatcaaaacaatttaattgaatacacatacaccacacactctagttttttttttatttttaatttttatggttatggaagagttgtacatatttatggggacatttttataaaagcatacaatgtgtaatgatcaaatcaaggtaattgaagtagcctaactttaaatatttatcattttgttgttttgcaaacattccaaaactactactctagttattttgaaatatacaatgcattattgttaactatagttgtcctattgtgctagtgaatactggatcttatgtcttttatctaattgtatttttgtacctatgaatttacctacttctaactcccccttgctctcaactccccttccttgcatttggtaaacattattctactctgtatctccatgagatcaatttttttagctcccgcatttgtatgagcacatgcaatatttgtctttctgtgcctggcttattttagttggcatcatgtcctccagttgtgtctatgctgtttgaaatgacaggatgtcatgcttttttgtggttgaataatattccattgtatgtatgtaccacattttttcattcggttcatacattggtggacactcaggttgatttcataacttggctgttgtgaagagtactacaataaacatggcagtgcacatatctcttctatacactaactttctttcatttgaatatatacccaacagtgagactgctaaattatgttagtgttagttttagttttttgaagaacctccatactattctccagagtggctgtactaacttacgttcccaccaatagtatacaagggttccctcttctccatatccttaccagcattcattattgcctatctttatttatttatatatatatttatatatatatttatatatttttatatatttttatatatacttttatatatttatatatatatttatatatatttttatatatacttttatatatttatatatatatttatatatatttttatatatttatatatatatttatatatatttatatatttatatatatttatatatatttatatatatttatatatatttatatatttatatatatttatatatatttatatatatttatatatttatatatttatatatatttatatatttatatatttatatatttatatatatttatatatatttatatatttatatatatttatatatatttacatatttatatatatttatatatatttacatatttatatatatttatatatttttatatatttatatatatttatatatatatttatatatttatatatatttatatatatatttatatatttttatatatttatatatatatttatatatttttatatatttatatatatttatatatatatttatatatatttacatatatatttatatatatatttatacatatatatatttatacatatatatatttatacatatatatatttattcatatttatatatatttatacatatttatatacatatttatatacatatttatagatatatttatacatattatatatatttttatatatatttatatatatttatatatatttatagatatatttatatatacatttttatatatatttatatacatttttatatatatttatatacatttttatatatttatatatacatttatatatatttatatatacatttacatatatatttacatatttatatatatttatatatatatttatatatatatttcttttttgttttttgttttttagttgttggtttcttttctttcttttatatatgtatatatctatattgcctgttttttcagagagctattttaactggggtgagatatttcattacaattttgatttgcatttctctaatgattagtgacgttgagcatttttccgcataccttttggtcatttgtatgtcttcttgagaattgtctattcagatgtttgctcatttttatttggattatttgggttggggttttgtaccaagttgtttgagctcctcacatgttctggcagttattctcttgtcaggtgggtagttggcaaatgttttcttccattttgtaggttgtcttatcacttgtttgtggttgcctttgctgtgcagacactttttagcttgatgtgatcccatttgaccatttttgctttggttacctgtgcatttggtggcttactcaaaaagtatttacccacacccatgtctggaagcatttccacagtgttttcttgtaatagcttcattggtccaggtcttacattaaattctttaatccgttttgatttgatttttgtagatggtgaggaatagggacatagtgtttggtcttcattatgttgatatgatatgtcacatttattgatttgtctttgttgaaccatccttttatcgcaggaatgattcccatttgatcatgatgaatgatctttttaatatgttgaatttgattcggtagtattttgttgaggatttttgcattcatgttcatcagatatattagtctgaagttttcttttttcgttgtgtatttgtctagttttggcattaggataatcctgatcctgtagaatgagtttggaagtattgtctactccttgattttttagaatagtttgaatagaattggtattaagtcttccttaaatatttggtagaattcaacagtgaagccatcaagtcctggccttttctctggtgagaatctttttattacttcttttatagcattacttattgatttatccatgtttactattatttcatgtttcaatctttgtagttttttatgtccaggaatttatccatttcttccagattttccaaatcgttggcctatagttgataaaaatactctctaatttacctttgaatttctgtggtatctgttttaatattttcttagctctgatttcatatatttggacattctctcttttttcttagcgtggctaaaggtttgttgatttcgtttttattttccaaaaacaagtttttattttgtattttctctcaatttcatttatttctgctctgatctttagtgtttcttttctttgactagttttgggtttagcctgctcttacttttctagttctttaagatgcagttttaggttttttgttgctgctgttgttgttattgttgttttttatacggagccttgctctgtcactgggctggagtgcagtggtatgttcttggctcactgcaacctccgcctcctgggttcacgtgattctcctgcctcagcctcccgagtagctgggactacgggcatgcaccaccacacccagctaattgttgtattttcagtagatacagggtttcgccatgttggccagggtgatctctgtctcttgacctcgtggtctgcccacctcgggctcccaaagtgttttgttttccttttttgatacaggcatttattgttataaactaccatcttagtactgcttttgctgtatcccataggtttcagtatgctgtgtttctactaaatttccttcttaaattatttaattcatccagtagttattcaggagcatgttatttaatttccatgtatttatatagtttccagagttcctcttattgatctcttcatgttttctattttttcatggttcaatcttggtaggaattttatgtcccgggatttttatgtccaataaatgcttattgatttctagtttcattccattgtggtcagaaaagatacctgctatgatttggatttttctgaatttctgagacttgtgtttcggcctaacatatggtctaccctggagaatattttatgtgcccatgagaagaatgtgtattattcagctatcgaatgaaatgttttgtaaatgtctattgatcaatttgttctgtagcgcacattaagtcagatgtgtctttgttaattttctttctaggttttttgtccaatgctgaaagtggtatgttaacttagcattcccaactatcattgtgctggggtctgtttctctctttatctctaataatatttgctttatatatctgagtgatccagcattaggtttatatatatttacagttcttatatcctgttgctgagttgacttctttatcattatataatgaccttctttgtctctttttacagattttgtcttgaaatatattttatctggtataagtacagctctttatgttcttttttggttttcatttgcatggcatatctttttctgttctttcattttcagtctgtgtgttttcgtaggtaaaaatgagttccttataggcagcatatagttgggtctttttaaaaaaaaatttattcagctagtctgccttttatttggagaatgaagtccgtttacactcattgttattattgataggtgaggacttactaccgccatttagttgttttttgttgttgttgtcattttgttagttctctcttcctttttttttttcttcttgtcttcctttctatataagcaattttctggtaatgttttaatttctgtcttttaatttttttgtgtccctgttaaaggtttttgctttgtagttaccatgaagcttgcaaaaaaaaaaaaaaatcttataaccaattattttaaattgattaaagcttaactctggtcacaaagaaaaaacattaaaaaggagaaaactaaattctacgctttatctccatctcctgcagtctgactttttgctatctctgtcttttttactgtctttcaacaaattgttgtagttattattatttttcataggtttgtcttttagtcttcgtactaaagatatgagggctttacatacaattataatattagaatattctgtatttatttgtgtgcttgcttttaccaaggagctttagaccttcaggtaatttcttgctgcacatttgtacccctgtctttcatattgaagaactcccttcagcattccttataagacagatctagtgttgatgaattacctcaggttttgtttgtctgagaaagtctttacttctccacgtttgaagcataactatgctgaatataatgttctagctttgaaagtctttttgttcagcactttaaatatgtcatcccactccctcatggcctataaggtttctgctgagaagtctgctgacaaacatttggacttctttatattttctttgcttattttctcctgctactcttagggtcctctttttgtccttaacctttgagaatttgattattgtatacctctgggtttcatctgcttggtgttgcttgactttcttgtacctggatattcactgggtttgaaaagttgtctgttatttttttgaataaactttctatcccaatctctttctctacttcttcttcaaggccagtgactcttagatttgccgtttttaggttattttctaaatattacaggcatcttttgttcttttttagcttctttttttctctacagactgtattttcaaatagcctctctttgagctcactgattctttcttctgcttcaccaattttgctgttgagacactctgatgcatttttgtgttgttgattgcattcttcagctctgcaatttctgtttgatttttttgttattataatctctttgctagatttatctgatagaattccaaattcctcttctatgttatctccaagtttgttgagttttctcaagacaaccattttgaattgcctgtctgagaggtcacatatctctgtatctctaggattgatcactgatactttatttagtccatttggtgaggtcgtgttttcctagatgttctccttgcatgagggcatttgttaatgtctgattttttttttttataaaggtgctttattgtgtggatagttgttcaatttggtgttcctgtggtcgggggttgtggggaagtaaatccctggaattttctatttagccatcttgttccacctcatatatttcattgttttaagaaaaatgagtagaagttgaaagagttgtataagagctaagtgaaggtcggctggagttattgtcaccaagcactcttctaagttgcttgaaaaatagcacaagcagtgtttcttaactgctcatataggggatctttcttccttgggtaaactcatggttggcattgacattgatttgttgcacttctgagtgaaaaaaaataggcatttaacataaaagagattactcttaggaaatactggatgtgactttagaaagtggtcatggttccttccaaaaatattcattattaaatatagtgttatatttcatttctgaacaaagagatctacgagatctggtctgctctggagaaaaaaaatgacaaaggagagaatttgagggaatctcccagtccgttcgtaactaacataagagtttatgcaaaacaagaattattctaaacaccatggatggtgggccataagccatctcatttatccagacatctctgtggttcagcaaatttcccagttgccctgtgtatagagcttttagggagtggagttattgttgctaaggagaggtcactgtttttaggctgggcaaaactgcattgatccttaggaagaatctagactagacaattggcaataaaagccatttgcatctgggcaacacctttccatcctaccttccccaaagcacactcagcagtagttcctcttaccacttaaataaaaacttcaacatgtggggacaagttttccattaaataagctatttttcctttgttttcaactgcacaataaccatcagaaacacttacctaatatttatttccacgttccatgtaccatgttccatgtgagcatgttacagccactgtccagtttaatatcatatgaatatgaaataccaattccactattgttatcatcattttccagatgaggataccaaacaaatgcaggaaacaatgagagcatgatgagaacttactttagaatacagagctagaattagactcaaagtccattagactctaaaactgatgctgctcctcaggctccgcttagcatttacaaaaaatggcactgtgactgaggaaccttgtgtacatgcatgtgacttcccaggtggcacttaccaacagaccatccttccaaatagctgctccttaaacaccccatcttgagcttagagacacacacaaatggtagtgtctgcactggggaggatgtacctggggcagaagcctgttcagggcctggagtgggctttgtcactttggcaaaagtctgcatgactttgggtccccctaaatgaatggagttcgggggccaggcgaagattcccatgaccctgttgactcctcattccttggggaggggtatgtcagaagagggtcagaactggaccctcacaagtatgggcctggccaggagacggggctttttggctctgagatctcttaaccacttgttataattcttcccacattacaaaggcccacaatgtacccccacaatgaggagagtccctgttgtcccagacagcattattcttcttgtacctttgggcttcatgcatcatttttcaggaggtagatcaagtggaagaaacatttttacagggaaaaagcagaaaaataacaacaaagagctgtgtagccccttaaaagactgtagctgtgaacatttcagacagagttcagagatcctggaaaggaaacagtaagccaaaaaacctctccaaaaattaataataaggacaaagctggttcccctgatccttatgaaggggatgaggagaatggatggtgctctgtgcgcatttagaggtcaagtaggtcaacaaagttctgttttccctgaatggggaccctagcactacggtgctcccatctagctctttccttaaacagttggaaatgagatacttaaagaaactccacccaatggaagtggacatgaggtcacatcgagggtcatggtcacaattgactaaaagggtagggaattgatttgaggatagcatatttcagaccagaaggaagagaattgcttagccggcaggcttttttacttttaaaaaaaaaaaggcttattgactcttagggaccttatctgaaagtgtcatgaccatgtctccctctgcacaggtcacccatctcactaaaaacttcctgctttggggttcaggttggaatgtcagaaatacattagttgatttgaattttgaatacgtgaaaagaaagcatccctcatagattgtaccttcaccgaaatgcaatgatttcctgccccaattgagtgctctccaagaaacgttgatgaaacatttatcagatgtgtggagtgaaggtcgtatgtggcacgcttggacagaaataagctggataaagcaggcagcattctctatgcagttccctaactgatcggcccgttctaggcagcataatcttaagagcaaaagccaggttggtcctgccatgttcgtgtattcatcaataacagcacataaagaagttctttcaacttaggattttatgcagaaacggtgaaatgattaacatcagaaatagcaacaatgccgtgtgatttccaaaattattttatttttctcctggttatacagttagagtgtgaattggagtctccctgtggttaagttgaagttgtgtgactgtatgctgggcaatagaaattgggtgtaaactgtattaatttgtgccaattccagatttagccgtaaatcacctgtgacacccttcacagtctctgttctccatccactgtgaccttggaggccaggttttgaagacacgttattacaagatgaaagagattgcatccctgagtgattcatgatcgtagcattccattgattactctaaaccaagctgcaaatgagcacagagcttctgctggcttaatccccaaaacctggagttgtaaaggacttagtcttcctccataatacaacttaatccacgtctactgaaatagaagtatatttatattctataaagttaacataagcgtaactcgatactatagagagaagttttaatattaatagccaatctgtcattactaaacagctggtgaaaggccaatgaggccgggcacggtggctcatgtctgtaatcccagcactttgggagtccgaggtggggggaccgcttgaggtcaggagttcgagaccagccagaccaacatggtgaaaccccatctctactaaaaatacaaaatttggcaggtgtggtggcgcatgcctgtaatcctagctactgggaaggctgaggcaggagaaccgcttgaacctgggaggcggatgttggagtgagctgagatcgtgccagtgcactccagcctgcaacaaaagtgaaactccatctaaaataataataataataaaataagccaatgaggtctgctgcatcatacctgttctgatttgaataggatgtcccttttccaaaattccccagcatctgcagagtattttattcaggttcaacacaagctggtgaggcatgtaactaccttgtaactagtttcataataattattatcgtctctctgaaaatagtcagcctgctttggacacaggtgctgcactgattttttttttattattatttatttattttttattttttatttttttgagacagagtctcttgctctgtcgcccacgctggagtgcagtggcgtgatctcggctcactgcaagctctgccttctgggttcacgccattctcctgcctcagcctcccgagtagctggaactacaggtgcctacgaccatgcccagctgattgtttgtatttttagtagagacggggtttcaccgtgttagccaggatggtctctatctcctgatctcgtgatccgcccgcctcggcctcccagagtgctgggattacaggtgtgagcgaccgtgcccggccccccactgatttttctgaggatgcctctgtgatgtcatacgatgtgccaatttccatcttatgtcctaaaatggcatcgcctcacttctgagaaatactgtcactctgtagctaactctctgctctaagaactcagcgtccccaagccaacttcccgagttcctcctagcattctctattctttccgccgcacaatgggacatgtggttttattccctgaaaagtcacttctggatggacccagtctgaagatggttctcctgctgtatagaaacatggatgtcgcgaaattgcctattaaacagggaagctattaaacagcctccctgaatttaccagattaggattttagtgaaaaattaccgcctgcccactgcttgtgggtagagtgttcttcagaagaaacattaaggtttaaagactgtaagtcatgaaatgcacgtgacaagatgaatgtcattgtatcatttcccaagccgcgatccccatggttcaccagaacttaaatacagcagttgatatttatagccagtggtataagaccttgtcttcaaggtggtgagtttccgctttgagatgtattccagaatgttacaatgttaaggggtcctaggtgttaatatcaattttataatttttaagacaaagaaagtgaagcgtgtggaaggcgagagaaacactaatggtgtcaagttggtattttagagagaagcagtcatttcattctcagttattacctatgctggttgtgcaaatttaagcaaattattgcactcaataggcgccattttctgtatccatagacagtggggactgtttgactcagtgctgtgcccatctttgcataaaaggcatttttacatttgtgtgcattggtgtgagttgtctgtttcttttgcccattttcatccttttcttgtttcattttctccatgtcttcgaattttcacagtaatttacacagaagtctgcatagtagtctcttagttttttaaaaaatcttctgtttgaatggtgatcctcttgtaatttctcattttctgtctttgtgctttctcccacctttttcttcattaagtggttagctactttttttcttattttcaaaaaatacccttaaaacatatgatttggtttattaattagatctataattattctcttccctaacttattgatttctggtcttccgtaacttactggtttcttacgtttatgaatcctttcttaagcttttttgtttgtttgaatttactgttatttttctaaatttttgagatggagatttaataaacttatttatatttttctattatattgaaatttttcatgctgtgaattttcttctggttctgatttaaatgtgactcttagattctggattttattttattctattattattattattattattattattattttatgacagactctcgctctgtcagccaggctggaatgcagtggtacaattttagcttagtgcaacctctgcctccagggttccagccattctcctgcctcagcttaccgagtagctggtattacaggcacccgccaccatgcctggctaatttttgtatttttagtagagatggggtttcaccatgtttgcctggctggtcttgaactcctgacctcaggtgatctacccacctcggcctcccaaagtgctgggaatacaggcgtgaggcactgggcatggcgccctccatcgttctttttgttttgtttgcatcatagtttgcaaagtgtggttctcctttcctatttagcctctattcccccaaaccattgttttcccaacactgccttctccaattcagcacatgtttttaagtctctttactgtagttaggactctgagcttcctgttctgtctgtcattattttcacttgtatggtggatgtgatttcagttcagtcttggctctccatccctcctcttcttcttctcctgtgtctctagaccctccttattcttgtcaaaagctcaggatgggaaataggaaaatagttctgctagagggtggtatttattttcaaatcacagttatttaactttatagttttgtgtgtgtcaccaaattatggtaaaggatggtatttgtgtggtttattttttcctgtttatctttttttttttgcaatggggtctgactgtgtcacccaggttggagtgcattggtatgatcttgactcactgcgtcttctggctctcaggttcaggtaatccttccacttcagccttctgagcagatgggaccacaggcatgccaccacaatacctgactaatttttgcattttttgtagggatggggttttgccatcttggctaggctgatctcaaactcctgacctcaagagatcctcccgcctcagcctcccaaagtgctggggttactggtgtgagccaccacacccggcctgttcttgtctatctttatagagttggcagaagatgctaggagattccagctgccattgactcagctgcatggaaattgcttttcttttttaatacattcattatatatgattagttattgattattcattttaaaatactttgcatcaaattatttctctttccaggcaggactggctgtctaataggtgcagccctgtgaaaatgaaagttcagggccccttcctaaaaaattgtaaagaacttcaagatggcgaaagtagagcatcacgccagtcacattggctcacacctgtaatcccagcacttcgggaggccgaggtgggtggatctcttgaggtcaggagttcgaaaccaacctggccaacatggtgaaaccccatctctactaaaaatacaaaaatcagccaggtgtagtggtgcgtgcttgtagtcccagctactcgggaggctgaggcaggagaattgcttgaacctgggaggcagaggttgcagtgagcagagatcgtgccacactgcactgcagcctgggggaaagagtgagagtctgtctcaaaaaaagcatcaaaccaggtgcaggaccctttgagtggcatccctgtgtgtacacagtcatacctccaggaaggtggtactggttcaatacttttatatattaagtaactcttgtttaataactttatatgtgttaagttatctaacacagagagagagagaactagagactggaacttaggagagccgaattctattcccaaatgtgtcttggatttatagtctgactttgaactctggagttctgttttcctacttgaaaaatgaaagattttaccctgaattgcgtttcacgaactatcacatatattactgataatacctaaatacattttaatagtggtattaattatatcacataaatagaaaaaaattgaaacacataaactatgctttttctgtatattttttcttagcaggtagttaaggtgagtaataacaaaacaaggtcaattttaaagcactattggagaattataggtgatatttagattttgtaagaattgtgaagattacataaatacatctaaagtttggaaaacgttgctcaggatgatccctaaggacgctttcaagtcctttcagcattttaggattctataattgcatatctttatgcagaattatgcattttttgatttagcaaataggtagatttaaatatataattaaaggtcaacctgttcataccttccagaaagactggggtgagatgaattccatatttttgtgtcatctaccaccacaaattttatttcaatttcatataaaggttaaaaattgagatgtccccatgtacactcaacgccatgtagtactgtgcctcctactacgaagtcagggttgcaaaaagccttcatgtaacattgctgtctatggtaacttgatgtcatgtctttttcatttctggttttcatgtctgttgtatctgacattctaaagaattcaaaatagattgttcttgaaggggatataaatagaagtgatgggccggcatggtggctcacgcctgtaatcccagcactctgggaggccgaggcagatggatcatgacgtcaggagttcaagaccagcctggacaagatggtgaaaccctgtctctactaaaaatacaaaaaattagctgggtgtgatggcgggcacctgtaatccaagctactagggaggctgaggcagagaattgcttgaacccgtgaggcagaggttgcagtgagctgagactgcatcactgcactgcaggctgggcgacagagtgagactccatctgaaaaaaaaaaaaaaatagaagcgataatgctgtacatctgttagccacttggatgctctctgccagattgcacaaaagttcatggtacgcctgctgtcaccagatttgggtattattttttaagaacccagaaattaaaacagataatatgatcctgttgatcaaacagtataatttttaaaaaggtactgtttgttaattttaagaacattccagtagaccgattggaggagaaatgtggtccccctgttaggcttagattttacataaaatttttaaagtgaaatttgattggagaagttgagttttttttccaaaatatgattttcttccattgagattgattggactctataggttcactgcaggagggtgggacattcttacctgttcgtaatacagaattctctgagagaaatatcccttcatctcagtgtctcagtggacattgttggtattcctgagtgttttgacattttggccatttccaaacatttctaggtctttgttattgacctgcctacatttcaattcttggcccttccctctgttttgaaatgactcattcttcacaagagcaaactgaaagctttactgttaagcaaaaaaagaaatcttgagccaaagtattataacttgctctgtaggaaatgaaaacagtgcattggccatcttttcaccctgttgttagagtatattaaattaaaataacacagcaagaaacattagtttccatgattcattttagatttatgttggtgtgtggatttggttggttgtttctttggttagtagaaggtgatgtattaaagtggaggtctggtatagctgatggaaatgagtttttttaaaaaggttatgaaacatctatctccctcttgagcagtagtccaggggagtgatcacatactgagatgaaaacaagagggtggtaatacagcaagtggtgtatgattcagtaactccaccggattgctttattggttaggtaatgaagcacgctagggaatttctatcaaacaggagtcaacatactgcccaataacatctgaaatgactgaactataagtttagggagcatgggatgaggtgtactgttaaatcgctcctatgctggaaagtgttccctaagttcttcccatcactacctggagaagttgatgcgggattactgggagaaggcttgtgacttttaggtcctctcagagctcttcactttgctccatgttgtgtgttgttttcttgttcgtgatttttttttttttttttttttacaatgaaggcattccaatcgggctaatacaaacatgaggcattctcaaactacaggaaattgctttccttaactacactctttgaaaaaaaatggggtttaattacctgctgcttttctattgctcagattcccttcaggatgcagggggagggatgggagagaagtttcctttgtgatttaatgtaattattcataatgactacatatggtcattttataagttcctaattattttaagtgattggtgcatggtcatttgcataggctgtttagcagaaaactcattcagtgacctacatataaatcatggaatagtttctaggcatgtaaagcgggtgagagaaaccaaacccttccccccatcacttatggttccaatgtatgcatcccagaatgtttaatgtaaatcataatagcagcttggatccagtattcttcatacaaatgtgtggttgatgtagggaaacatgtttaatgttttctttcagtagcagatggtacatggatttttatttgatgcaggcactgctttccaaggtaattgtcaagggcttttttccccctatgaaaaaaatggagggaaggcctctggatcaacccattcatttcacagatgagcaaactgagacctcaaatattgagtaattttccctaaatcaccagtttttaaacagagtgagggctaaaattcacatctcctgacagtcagcttaattctcttttcgtcatactgcacattttctcttgatagttgatgtgatatatgtcactttaaaaaaatgagtttccatttctgggtatattttatctactttcctcctcagaaagccaagttctgttgattcatagtaaggaccagatatttcatagtgctaattccaagctgggtataatttgtgacttctaggttacccacttgtgtccacaaaccacctaaattttttaattgtacacagtcaagtcaccttgatagaaggggccttgagagctcatctaattcagtgatttttccaacactggtttcagggctgctgatgtgctattgcatttcacccgagtccacaacaaaataagaagaaaaaaaatcagctctggggagttttgtcctcaagttaaattaattcccattttttttaagttacgtctttatcaaatgttgatgcttaaagagagacattgttggctgcgcacgttggctcacgtctgtaatcccagcactttgggaggccgaggtgggtgaatcacgaggtcacaagttcaagaccagcctggccaatgtggtgaaaccctgtctctactaaaaatacaaaaattagcctggcatggttgggggtgcctgtaatcccagctacttgggaggctgaggcaggagaatcgcttgaaaccagaaggcagaggttgcagttagccaatgttgcaccactgcactctagcctgggtgacagagtgaaactccatctaaaaataaaaaatgaaaaaaaaaaaaagatagtcatcgttgctttcttttattttcatgagaaaacaagaaatgacacatgtatgtcagctttccacaaaatcaccccctgccttccctttccttttatgttcttatgtttttattgtgtttacctgtcagtgaatccaaacattgagaaacattgggataagggaatgttattttctaggaaaccaaagttttaaaatatcatggttactgtattagtccattttcatgctgctgacaaagacatacctgagattgggcaatttacaaaagaaagaggtttattaggcttacatttccacgtggctggggaggcctcacagtcatggcggaaggtgaaaggtatgtctcacatggtggcggacaagagaagagagcttgtgcagggaaactcccattttttaaaccatcatatctgaagagacttattcactatgaagagaacagtgaaggaaagacccacccccgtaattcagtcaactctcactgggttcctcccatgacacttgggaattgtggcagttacaattcaagacgacatgtgagtgggtacacagccaaaccatatcagttactatagtcattttttggcaaaaccaagaaatagcaaacttgagcccgattccttaaaacagataaagcaccctaaccccccactgccaaatcaacactcttccactatatcattttccattttcaataaataactctttcatccactgtaaataacagaatagatgttgtctatgaattcactgcttaatatttcatttatctacttccttctacccttattcatacctatcctaaacacttttcaaaggaactttctctctgtctcttgttaaaaattttctcttgtaattcttaaatatgtacagatgttaccaattggtaagagattcttttttgatgaactttctctcctgggtacacatttatgatcctaaacgccccatgaagatgggcctacatctgccttccaacttcttctatgtccctcagtcataaatatctacattgtttctttgataaattttgggaatgatagaagacaataagttgcatgatgactgcttgtcttgttctttgttaaatgtacctatgtctccaccccctttcttccacatctcaaattggaaatcattgagtactaggagagagaggaaacagggcattccttagtgggaaaacataagatgccacgggcagtctaaatgtcaagatttggactgctggtctaaaaggtttccactctctgggttgctctagtgaagcaaataaatagagtaacacatcgatcctcccacaggtagaaggctctgctgttcgttgttttactactctgcagataggcagcagcagcagcagaatttgttagcaaggatcagtctgagtcgcctatgtttactaaggaatctgtccaaattggccgtgcctttgatggatattgttattcccccataacgctgtccttaggatcctggtaaatctcagaaatctctatacaaagttaccgtttcagagcaatgaatgtgggcaaaggtgaaaatcattatgaagcagagagtggagattattaacaggtggtcgaaagagagagcgagagaaagggggagagagatagagttgctttgttgcgcaataacatgaagataaaacagttaaacacatatatcctgtttcccccagtacaagcctaatgttgctgatttcaggttcctgtgacatcattcatttactgcacctattatattacaatgggggtaaaagaagcactttccattttcatgacagaagaaatgaaacagcaccagcattaacaatagcatactgggcactgtatctgttctccttggttctggaaaggtcctagagatttatgagtaaattggaccattccaactataggcattaaagttctggtgtttccaaaccacgttggctcttggggtccattatacctggttttatgatgtttaaaaatccaatatcatttggtaagaagtaacacaacattatgtctgcaatcatgagctctagaaccactcgacttgagttgctatcccatttctactaactggtagctagctgacttttggaaaggtacttaaactttctgtgtcagtattttcttgtctttgaaatggagatgatgatgatggtgatcacggtgatggtgatagcggtgatggtgatgatgggaatagggatgatgatgatgatgatggtgatgatgaagttgatagtgataaaacccaacacataggcatgttagaaagactataaatatatgccacacccttaaacagcatctagcacgcatttaataaataggtctcattgtgattagcagaacaaatgaaagcagggcgtttctagtctcttctctggtcgtgtccctaagagaaactggaggtgcctaagaatcactggggatactagtcccagagaagagttcctggatcctgttacatgcttcctgaatctgcatagattgtatctagaaacttgcatttttgataaactctgaaaaaggttaaattttgagaattgatggatttgggcaaacgtgaaagccattctgagacagaagaagtagaggctatcaccaggtggtcctgcttaatagatagggagagacagagagctgctatgttgtttaattcagaatggcagggagctgaaacattgcctaattctgaaccagacccctgatgcttaaataggaagcccagataacacccccaattctaactgcagccatgctaactaagataacagctgtctgtattcaaagacacatatatctgtgctttgttgactagtgcctttcgtttctctggccaaagcaaatgtgcttttttggctttaattttgtgcttttcactaattaagttgtttatatgaactaaaatatttatacacccaagataatgaaaataacccatgataaatggaacaaatggagtaaaagtaaagtagatttagtggcaccatagtttattgagcatctgtgattagattgtgttccctaggatgcttcggggagtgtaattcaatctgcagtttgaactgatgactcttcctttctgtagaggtttagagaaaaaaaatgaattcttgtttttaatatctcaagtttctcttcaaatggctacttgttacatcttggggtaggaggggagtcttttaggaaaaagaagaatgggtatattttgttgccatccaggagggagactgggcagaaaattaggctatatttggtagcttataatctaggatgtgtgaagatggggtacggtgactagctgatgcaggtgaatcccagaactggggctcagcttcgaagagttcttagctttgctcaggaaagaattcaaaagtgtgctgatggaggagagccagtttactaggggaaaccgtgcacagcaatatggctgctccatagacacagcagggccaccccacaggccgagtagcactcctggattgttggctagctgtatttctagctacttatcattatatgctattaggttggtgcaaaagtaatggcagtctttgtagttaaaaaaaggtaaaaactgcattgacttttgcattaacctaataaggcgtgagttattcgcaaactttctggaaaagagggagttcccagagccattcatgatggttaatattaggtgttaacttgattggattgaaggatgcctagagagctggtgaactattgtttctgggtatgtgtgtgaaggtgttgtcagaggagataaacacctgagggagcggcctgggagagaaagacccaccctcaatctgtgttggcaccatccaatcagctgccagtacagctcgtataaagcaggtggaagaaggtgggatgagctagtttgctgagtcttccacctttcgtctttctcctgtgctggatacttcttgcccttgaccatcagcctccaggttctttagcctttggaccgctggacttaacaccagtggtttgctagaggctcttgggactttagccacagactgaaggctgcgctgtcagcttccctgcttttaaggtttcgggactcggagtgagtcattactggcttccttgctcttcagtttgcagatggcttatagtgagacttcgtcttgtgatgatgtgagtcaattctccttaataaacttcctttcatatatattaaacacatatatcctattagttctgtccctctggagaaccctaatacaccatctaagataacttctgggcattgtcatggtgtcagtaaactgtcatggtgctggtaggattgtcttatgcagatgtattatcgttcctagtcctactggtttgggccaatttctttgcgacatccagttttgatcaacagggtattgaaaacaagtcttgctgttttcctgcctcataaccatgtctgtttgcccaagactgtcccagttttagcactcagcattgaaaacccagcaccctggaaacaccttagtcctgggccaaccagacgggctggtagtaccaaaagtcagggctacctatttttgtttttcatgcaataagttaaggaagtggtttcctactctaggatagtgcttctcactctttaacagtgataggcattgcctggggatcttgctaaatgcaaattttggttcaataagtctcgggtggggtcggagcatctgcatttctaataggcttccaggtgattcaaaagccgcccttccgtgcacgctacactttaagtaacaagcttctagagggcccggtaatcacctggccggatggttaaagagcaaattcaggataccaacattttttaattctttgcaattacttttttctctccctaaaatttttgccttttaaatcactggagtaggcccgtggacgttcagtttttcctaaaaagactccttttatcttttagataaagtacaaagtaagggtctctagaaagcagtagatgacaaagtagcttttgaaactaaaatctcatgtgagtgactgtataaatagcatacaaaatggaaggatttttcattttcttctggttgtttttctatgtagttggaagttaattcacttcaagtggaaatctggaaactagtttgctatccgtcttgcccctgtttgagtatctctcaagggtatctgacaacagtgtgggaaatcaataaatgtttgttcaataaatgaaaaagtgagaatcatttaattcaatgatacttaaacttgaacatgcacaaaaatcagacggaggacttgttaaaagtgcggattgccattcagtagatctggggattgacctattaagcatttctgatatgctcctaggtgatgttgatgtcttggaacacactgtgaatggcaagaatcaagattgaacatgcaaaaaaaaaaaaaaaaaagtaacgttacatatcatgtattttgccatgcaattaaaatgctgggaagtgtgatgatgattttgtcctttagaacatataaatgggatctacagttgagagagaaccatacaaggctcttggtaatggtcaggcttatgtatttaaggtgtaattgcatctatctttatactagttcctttcccttgggaactgctcagctgaagataaataagcaaaacgggcacatgtgtagcctaatagcaaatataaagattattgagccagtttatagtgactcaataaaattctgcttgtcatgggtaagcaaaagtcagggcccttgaaatttagggtgcagcaaaaggaagcccataattggggtggaggttggggagatggccaggagactcatgtgtccatcaggagacagctaattgggcaggaaaggtgtttctggaccaaactgagggtcacactgctatttctcgtggtctaataatgaggtgcagatgaactggggaggaagagagtttttatttctgtaaccagttacagggagaaggtctggaaaatattgccagaccgactcaaaattacaaagttttccaaagattatataccttctaagttgtatgtctacatgtaagtgtgcattcatctgaagacctaagtggttcatttattgtcatctgtacctaagatctgagtcctgaggaccttcatctggaccttcagtaaatttaatctaaatgggtctaggtgctggggtgattacccttatcttgtctcgtgctaatcatggaggttgggggagttcttttagaccccgcaataaacttgtttgtggaggcctggggagtttcttcagatcccagtaaaacttgtttaatcctaaacaagtcctgttaagaaatccttcagtatcttgtcaggatttaagccccaggaaaggcctgggcacaattctgggtgggctttggttgcatcccagcctttgtagatgggctctggctgcctcagcttttattatttaacttaaccactcagtcagtgccgaaacagtagttgtggaggcctgtgttagtgagacctgatttgccacacagggtcctgttgtgcttctctgggaatttcattgcttggatgttatttgacatttcccttttaacagttaatgttagaaagtccatgttatggcctggcgcagtggctcatgcctataattccagcactttgggaggccgaggtgggcacatcacctgaggtcaggagtttgagaccagcctgaccaatttggcaaaaccctgtctctacttaaaatacaaaagttactcgggcatggtggtgcacacctgtaatcccagatacttgggagggtgaggcaggagaatcgcttgaacctgggtggccgagattgcagtgagttgagattgtgctactgtactccagcctgggtggcagtgagactccgtctcaattaaaaacaaaaaaagtgcatgttatttgatggtttttatattcctttattcatttcggcaaaagccattcccccacgttgttgtaagaatctgattgttagatgatactcttgaagtaggctgacccaaaatatttttcggagacttggctatgaagaattttataaactaacttaagttgcctttcttttaaggagctgacatagtggaattgtgcaaagaagttattttagtttcccttagggttaaatatttattgaagagggaagatggcttcttccacaacaatttttattttctccttttctaatctgttctaaaagtcttttagctgccttgctactaggaaaagggacttactcatttccattgaactcaaaatgttactttgtgtgtgtgtttaatttccccatcacccactctgcagactcaaaacctctgagctagaccatgccttgattttttttttcttttaaatgccatgagttagacatttaaggacaccaaatgattgaaaatagtcgaaaatgttcacttgaccctcattgcctatgacattgctgttagctttctgcatgaaagtgcaaacttcaattttcaggaaggcccacatcccagaactggcattgtttccttagtcattggaagcagaaaactacagcagaagtgttgcctccagccgtacagagaagaacaatctgcaggcacaatctggaaacctttcccagtgaagggagaaagtgagagtggcgttctggccttggaaaaacaaacatttgttattactttcctagggactgaaatttttagctccccagtgcaatctgtgtataatctagatttccagatttcctaaatggaaaacagataaacaaaaatcagccttcttaaattatgtatggtggtaaaataaagtaactgagaaggaaacaggattcctaaaccgaatggactttagcaaaagaatctttcaccattaataatttctccctgaacaaatatgcagatattttaccagacagagaatagagactttgttttggcttatcttgcttaagagtaattctgagaatctattacttgtgagagaataagattcataaggaatgttcgttagagagttgtactgggagattcacaggctacatttctaattttttcctaaagaactccttttacaataaaaaaccatgctgtaagctgcagagtgttgctgaaatgtaagcttttaccattgttgtagatctggcatcttgtttagaacccatagtttcctaatatttgcacgttataacatatgaagctaaactgtatagtacataaaactcatacaattttttttttttcgagatggagtcttgcactgtcaccctggctagagtgcaatgacatgatctcagctcgctgcaacctctgcctcctgggttcaagtgattctccttgcctcaggcatccaagtagctgggattacaggtgcccgccaccatgcccagctaacttgtttgtatttttagtagagatggggtttcactttgttggccaggctggactcaaactcctgacctcttgatccgcccacctcagcctcccaaagtcctgggattacaggcatgagccacccagccctgccaatacatacaaattttaactccagggtaaattgataagacttcttccttcatggaagttaaattctaataggatccctaatgccccatctagccctgcagtatttcaggtcaacaataactctttgctgactgaagatttgactggatggtacacgccctccaatggaactaacaggctcaacagctctaggtgcataaataatcttcatcctacaaataaagaattctaaattggactctaaatattgtatgtggctactgtggaagctaggaagattgattggattaatatcaagtttcacaatgtgttctttcattaggatgtcagtaatgagaatgaactattcattagaacagccaactttctaaagaataagagtgctgacctcacacatgactggggcagaacagggtactgtttacttcatgagagccctagaatgggacgcagtggattgggggccgttccctactctattgccaagtatgtgcatttgccactctgacttcttataggtaaagtattggcagttatgtcctccatagtcaatttcattcttaaaaaggccatgtgtcccaaacattaactgaaaaacaaaaagcgagattcaaagacttctcatatgctgttggtcggagtgtaaattagttcattgtgaaaagcactgtgaaaggcaattcatcaaagatctgaaaactgaataccatttgacctaccagtcccattactgggtttatatgcagaggaatataaattattctaccataaagacccatgcacgtgaatgttcactgcagcattactcacaatagcaaagatatggaatcaacctaaaggcccagcaataacagattggctaaagaaaatgtggtacatctacaccatggaatactatgcagccataaaaaatgagatcctgtcttttgcaggaacatggatggagcttgaggccattttccttagcaaactatgacaggaacaaaaaaacaaatattgcatgttctcacttacaagtgggaattcagtgatttgaacacatggacacacagaggggaacagcagactttggggtctcctggaggatagagggtaggaggagggagaagagcagaaaaaaataacttgggtacttggcttagtacctgggtggtgaaataatctgtaccatccccataacatgagtttacctatgtaatgaacctgtacatgtacctctgagcctaaaataaaagttaaaaaaattctcacttcagttatcacattgaaaggaatacagatcatcagacaatgaagagcaaatcaaattattcctggtatctcttcgaggatgtttacaaggagggaagtctgttaatgaatgctgaaaacatgtgaaattatccttaccatcttgtccattctgcatgcctcacaatgtaccctcctttcttcaaggtttttccctccactgtaaagtctgaagtgtaacacccaagccatgtggagattttcacatcttcgctgccctgttgtcctcagcatctatctccgcctttctccttacagtcacacttggctctttccaacacgaatcactagcctttactttccctgttgtatcttctttactcattgctttagttctaaaccatagaattccaaaagccaagctggaaaaggaggagttaccttttgtgaggtgagaaggggaaaaactgtgggtattcatactcaaaatatttgctagttgcagctctataagaagtcatccagcagcttggagaagtatatggttcacaaagatgattcatccaagaaccagtttgaatatttagatgatttagagtggaattagttagaatagaaatgagtatagaattgccacaggtcacaatataagagaaaaattagcaaattaattaattggatgttgttctatagccagtatttgttttagagatttttatgaagtacttttccttcctgaaagtcattataaagctttgtagtaacctgataatgttgaatatttactttaatgtcatccaaaaaactatagagttttgaaagatggaatgagaaactggtctgtaataaggaaaaaccagaaagactgtaatacatttgcatctttttcaaattcatatgctaactagagctaacaaatgttaaataatttcagaaagtatctttgctgggcctattctgaccagtaaataaaagcatttgaatgagttcaccatcttacatggatagtctgtggagaagaaatggattttaaagagcctgaactagttcccagcaaatttgatcacatcattggttttttaaaacatgtcttttacctacacgcggtaacagatttgtattatatgcgctaaaatgataatattgatattaatgaggtgatattgtcttacatgtattaccaggggagcatctttctgttttttctccctttctttttctattttttctttgtttctttttctctttccttttcatttatatatataaataaatatataaatatatatatatatatatatttttttttttttttgagagaaagtcttgctctgttacccaggctggagtgcaatagcatgatctcagctcactgcaaactccacctcctgggttcaagtgattctcctgcctcagcctcctaagtagctgagattgcaggcacgtctcaccacgtccagctgatttttgtatttttagcagagatggggtttcagcatgattgccaggctggtcttgaactcctgacctcaagtagtatgcctgcttcagcctcccaaagtgctgggattacaggtgtaagccaccgtgcccagcctctttttttccttttaataaaacactggttacaatgtgagaaacagattggagattggacagggagaccagttaggagtctgttccagtagttcaagtgacagctgatgccctcttaaactaaggtattgagggagatgatgggaactaaacagcagattcaagagttctagggcatacaatgaagagaacttggcaataaattgataatgggaattttgagacaaggatgagtgagtccaagttgatttctgcatttagggttggttgactgaatggtggtgccattcacctggatgggaaatgctggaggaatgttggagtagcacacagggctggggtcctgagttctgcactcactaatgggactttgcttgtcctatgatattaagatgcatactatggcggagtgtggtggctcacacctgtaatcccagcactttgggagcctgaggcaggcagatcacaaggtcacgagattgagaccagcctggcgagcatggtgaaagcccatctccactaaaaataaaaaatttggctgggcatggtggcagacgcctgtaatcggagctactcgggaggctaaggcagaagaatcacttgaatccaggagatggaggttgtagtgagctaagattgtgtcactgtactccagcctggtgacagagcgagactccatctcaaaaaaagatgcttattatatatatagttctattgaatatgtatgttagtatatatatctagttctgttgaatatatattattgtgtgtgtgtgtgtgtgtatatatatatagggtataatatgcatatgtaatatatgcattatatataatatgcgtattgtaccctgtatatatatatgcatagaactatatataatatgcaaattataccttgtgtatatgtatatatactatcctatacaatagaactatatatatataatcatactcaatagaactagatatatataggatgtagcaatatgcatagaactatatataatatgcatattataccttatatatgtgtgtgtgtgtgtgtgtatatatatatatatatatatagttctattgaagtatgcactagcttccagcatgtagcctttatattctactgatgccccatcactttggaattacctcttatctttttctctcctgcctttctaatatcaccccaccactgattcccatctgattatgcctacttcactgaagcacccttgtcactcccttcaatgcctaaagtattgctttcttaagtgctatggaagcagagttccttttcttgcagtgaataaactacatcccaaggatctcaccccttgcttccccagtgaatagctctcagatggaaaataaaacagcaccattactctctgagattaagagggacaggtttgcatactcaacaaacattgtctgatggggaataactgccaaatttatcatctcagggtgttggtagttgttattttaatgtaaattttgaatagataatagattaatatgaatcttattttaccaggcagaaaaatggtatacagtgaagagtaatgcttcctccaacctctgcccccaggtaatactgttcttttctccacagacaaatacctggttatctctgggtctgggtattaactgtatctgtgtcttctcccagtcataacatacaatatctctaattcatagaaaatcactacctcttaccaagggaatacttcctgtaacacctttagcagggaacaatatcggataatcccaaagcaagatgttaacgcaaactaaatatgtcctgagaaggactctgtacttctatatttgagtccttgtggatgaactgtaacctagcttaatagacaagactgaaaacctgacttaggagtatgcacctgtaacaatagttgagtcttggccaatcccagccgccatacttcaaccacccatagactgctaagtgttcaaaaaaggcaaacaccaacctgtcaccagttcagctgtttgtgtacctcactgctgatttctgtaagtcatttccctttttctgtctatgaattttctttcaccaccttggctacgctggagtctctgaatctcatgtgattctgggggctgccttctgaatcgttcattgctcaattaaacttctttaaatttaatttggctgaagtttttctttaaccagagggaagaaataaactaatgtagattgcctctaagtgccagccactgtgccagacactttctaaaggtgcatttttaaagaattattttttaaaatttttgtggatatacacatagatgtattgatttatggggtacctgagatacaaaaatattatcttcctcatctacattgaagagctgtcattcaccccaggaggcagtgtggaataagtttctgtgcacctgagactatatcctattgtatatgaagccttcaaccaaaagtgccataaccttggtacagaattgctaccccatccgaagtccataggaacacagcatagaacaaactgaagtctgagaagttcaggtgagatacgtagagctgcagaagaggagtttttcattgtctctgaattggtctttctcagcgacagagttatttatgagatggggcaatcatagaaagcagtggcttttaaaaaacacttcagctgccaaaaatcttattccaattctctggaagagtgctgtcgtaccaagtgtaattcaccagtccggtgcctttctggaagttatgaaattggagagagttgcttttgtacaaatgaataaacaccaccaagatgagcctacccgcttgtcctgagttgagattgatatgatcagacatctagagcttgttctcctgggtgtctctctgaaaaaattctcttctctctcaccttttttttttttttctgttaataagtagacaatgctctggtctgatggggtctcaggaaggaaactggtatctatcttttcttgtcaacatttaccaacaaatatgcctcttatggacagggatagggattacggatcactctcattgtcttatgtgtgcaacttggagtggattgttagctatccagaaaatgtccatccctctttttcttggagaaattcactttttaccacattttgtgattcaaattggtctgtcactgaaattattctgaaaggttaaatgagacccatgagggccgtacaggaggcttccgtgcattttttcctctccttgtccaagtggtgaagaggtaggcacataaactaagcgtggacaatggtactttttcctgggagaaggatgactaaaaagatggcgacacaaaggtatctaattttccgttcatggcaccgttcatgagtcttgattctgtgaatgtccccatatgcccctccaaaaacctctttttttttccttaagttagccagttataggtttgtattatgagtttcatagtgctataaagagctataaagaacttcctggagactgggtattttataaaggaaagaggtttaattgacgcagttccacatggctgggaagtcctctggaaacgtacaatcacggtggaaggcaaaagggaagcaaataccttcttcacagggcagcaagagaacggagcaagagcagagagaactgcgtcataaaaccatcagatctcgccagaagtcactcactatcaggagaacagtgtgccgggaaaggtcgccatgatccaatcacaagcctccctcaacatgtggggattacggttcaagagctgatttgggtggagacggagccaaatcatatcaaggttcggttgcttccaaccatacacgtaacagatatttcactaaatgctattccagaacggatttacacaatttttggaaatagttacagaacacacacagaaaaactgatgatgataagataccccgaaaaacacacctgggtatttctttctgggatgttgtggctgagataccttgatagaaaagccgattttgctgagtaacttctaaggcctccaattctgaaggaagaattaagtgatatgagagtttggaaaataattgaagagacctgcctttgcaggaaataatataggcaggaaaaatcaagaatgccacaaaattgagtaaaagagaacaaaagaagagaaatagaattacctctcaactttgtaaaatagaattgaacccagtaatactggataagatttaaaaatattatggggtaggatcacttctattaaatgtgattagcttttagctagataacattgaatattttaatgtttcattggctattatacaatatatttttttcctctatgaatattgtaaaattcctgtttgatttaggagtcagggatgtttaagtgattatgtagctagtcctcagaccacagttaaaaaggtacttttgttttgttttctggcgttgggaagattagcaacctgggtgctagcatggaaaaggcacaggaggccagttacggtgcctcaggtctgtaatcctagcactttgggaggctaaggcgggtagatcatctgaagtcaggagtttaagactagcctggccaatatggtgaaatcccatctcttcaaaaatacagaaattagctgggcgtggtagtgcacgcctgtaatcccaactactggggaggctgaggcaggagaatcgcttgaacctgggaggcagaggttacagtgagccgagattgtgccattgcactcgagcctgggcaacacgagtgaaactccatctcaaaatataaataaataaaatacaaaatataaggcacagaaaaaaatactgaaataagttgcagactggaatttcttacagatgttgtttctcctcagcatgaacagaggtggccatgccatttctccagataaatagtgcagtacaagagtgttggttggtttcatgtatcaccatataaagttgtattatcagactccatatgatgaagaagccttcacgagaaactcactaccaaagcaaaatcgttttaaattaatgaatgattttcaagtaaaggccccataggattttttatttgtcctcctgttagaatgaatatctgtgaatattaagctcctcacatttcctgttttgttaagaaatttgttcaaaatgaaagtatctccctttagaccaagctaggacggtctactaacagaaccttagaaaggaaacacaatgcaaagtgccaattagcactgcaaagttttggttcagtttcttattttttattttttttgagacggagtctgggtcttgtcacccaggctggagtgcagtggcccgatctcggctcattgcaacctccacctctagggttcaagtgattctcttgccatagcctactgagtagctgggattacaggcacatgacaccacgcccagctaattttttttgtatttttattagagacagggtttcagcgtgttggccagactggtctcaaactcctgacctcaattgatccacccgcctcagcctaccacagtgctgggattacaggcgtgagctaccacgcctggccttggttcagtttttaatgcctaaatgtggtctaaatcttttaggacaagtgtggcctcatgcaacatggattgttggaggcctcatttgtgctcataagcggcattttccttgtggacctcctgttttactccattaggttttgcatacagcagtaccatagaagatggagcacttagaaatggtgggaagcccctgagtcctttgtccatcatgtcagagtgacgatgtttctagaggtcattgctgtctttctttggagactgggagaatagggaagtaaaggaagatgtttaaattccctacttctctcttttttgttagatttttaaataaaactttatttcacaaaagacctattgtcatggcaaccagtcaaacaatgctgatgtatatgaagaaaaccatgaatatattttcactcccattaaaaaaaaaaagtgcaacctaagttttcaggcctcacctttgtatggttaaatatcaggccacaatgacttcctataacaaaattgtgattatagcaaggatgattggctaattactgaaatttacacttctccggttccccagatagtattccagttctttctggcagtcctcaaaacagccatattccatgaaacaaccctcttcgtttctagcctccagttgaccacattcatgtaactgccttcagaagctgctgcttgttgcaattcccatcttgagaatgctcgtatgggttcccaggtgtcacctctgaatgttctcatggctctagtttggggaccccagctccttcttaggttttcttcagagacagggccaatggctctttccccagccctatgctatgatctgtcacctggtccctaaagtagctttgcttgtgctgaatctcactaagtgtctctttcatcttctgcatccaaacctctctctccacaggtggctcaaaatcaatctgaagaactgagtagggggtggatgcaattccttttcattttgaatttctttatcacctttccaagtcccatactctctcaccctatcaaaatcttctccctctgtccctagttataaaatcaaacctcctgggcatgccaatggcagcaggcacctgcagagatgcggaggattcctgaagaatgagtgaagggaggaggcgctgttgatacccccaacccctctggcttccatctgagctcagccagccccttgttaggtaatgaagggagataatggtccagactggttacatttccttcctcaagttacccagcaaactattaaccagtccttgctactaacactctcatcatggcactggcaatatctgaggaccggttcagtgatctgcacaaagggaaattagattcaaacataacaacttgtcctggagtgaaaagcagatgtataatttctctcatttgtccctactttatttaatagcccacatagggagcttatttaaaactcctagaacaacaacacaccaaacaagccaatattctgagatctcattgcatgatcaacatgatgataataactgttttcttctttcatgtaataacacagagagaaaattgtggtgggggggagggaggaggtctaagagagtcagaaatgtccttttctgatcttcaaactgaaagcaagaaagttgattaagacatagctcctgatcatgtcctaagtgtttccatttctttctgacattgttttccatccattcttacggtaaataatctctgtgtgtcaagcctgacattgggtggtagaagcaggtgggtgaacaaggtagatgtggcttctagcttcatggggcttagagtctagtgggagacaggcattgatcaaattaataatgacaatccttagtatgtgctgtgaagggaagttacactgatgagcatgatagatgcgaatcacagagattctcaagtaaatggcagttaaggacagagctgaatgacaggtaggggacaaagaggctaagggggaagggctcctccaagcacagggagcagcatgtggaaggtcttggaaacctgaggaagtgaagtgaaaagtccttcagtctggaaccctgggggagaggtggggctagagttgaggttggatagaagcagcacatcaaggggtttgggtttatgtcctgtgagtgtttctggaaaggggtcctgatccagacgccaagagagggttcttggaccttgcacagaaaagaatttggggcgagtccatagagtaaaatgaaagcaagttttttaagaaaatacaggaataaaagaatggctgttctacaggcagagcagtggtatgggccgcccagctgctcatccttatcattacttcttgattatatgctaaacaagggatggattattcatagtttttcccggaaagcggtaggcaatgactagaactgagggtttctccccatttccgaccatatagcgtaacttccgggtgttgctacagcatttgtaaactgtcatggcgctggtgagagtgctgttgagcatgcaagtgctttataattagcatatagtgaagagtgaggatgaccagagatcactctcattgccatcttggttttggtgggttttggccgacttctttgccacttgctattttattttctaggtctttgtgccccgtattgtgtgctgaactcctgtctcatcctgtgactaagattgcctaaccttctgggaatgcagcccagtagatctcagccttactttacctaaccccttttcaagatggagtcactctggttcaaacacctctgacattcgcagtggaatccattaaaagatgttaaggagatatgattatatttctaaattgtcactccagcatcccctacgccagacattatgccagtctctatccatacagtatctcatttaatcctcccgtcattaatctcattttaccaatgagtaaacttgaagcaaatgagtgactttctcaaggctacctacttacgccttaccagggccaggattcaaacctagacttgttcagcgacagaacacacacttaaccattacccactcttctctctggtccccagcaaaaagtctatagtttgcagccaaacctcattctctaattccaactacctaatagtttgctcttaatagttactttaagaggaaaagcttaattctcacaacatttgtcaacactcagtctgtttgaatgggtataatttaaaaaataatttacttccactgaaggaaagaaaggactgtcttgagaagtaagaaacttgaagatctttaagagtattaatattaaggttggcaaatcctttgagaagagtttctttctgcctattgtaccatttaaaaataatcggccaggagcaatggctcatgcgtgtcccagcacttttggaggctgaggcaggaggattgcttgagctgaggagttcgagaccagcctgtgcaacatgaggagaccccgtctctacaaaatttttatttttaattaggtaggtgtggtgatgctcacttgtaatcccagctcctttggagactgaggtgaggattgcttcagtactggagttcaagaccgtagtaagctatgatcacactattgcactcgcacttgagccacagggtaagaccttgttgcaatcaatcattcagtcaacaatcattgtgtcatgtctgcctgcctgttgaaaaagccttttagatgaaagtcaatcttcggttttgttgttgccagactggccccttcatgtaattttttttttttttttttaaagaaacagggtcttgttggccgggtgtggtggcttatgcctgtaatctcagtactttgggaagccaaggcggacagatcacaggatcaggagatgaagaccatcctggctaacacagtgaaaccccgtctctactaaaaatacaaaaattagccaggcgtggtggcgggcacctgtagtcccagctgcttgggaggctgaggcaggagaatggcgtgaacccgggaggtggagcttgcagtgagctgagactgcaccactgcactccagcctgggtgacagagcaagactgtctcaaaaaaaaaaaaaaaaggaagaaaagaaacagggtgttgttctgttacccaggttggactgcagtgatgcaatcatatctcactgcagtctcaaactcctgggctcaaacagtcctcccacttcaccctcccaagtagttgggactaaaggtaaataccaccatgcctagctgttttttttgtattttttggagagatggggtcttaactgagttgcccagggtggtctcatactcctgtgctcaagcgatcccactgcctctgcctcccaaagtgctgagatggcaggtgcgagtcaccatgctcagcctctttgacataatttttgcaaatcaatgaattggacttgacatctaggtgactgtggatacagaactgatgtattaacctttgacatggctgcaacctgctgagtaaaggctgatcccttgactggacctgttatacatcactgtccacttgattaggtgcaaggaactttgttgcagagattttaaagtggaatcagacacccaggtaacatacttctgaccaccttaatgtgtcatagcttcaaacacatttaaccaaagcccctctcccatgtacgaggaccctgcttacctgttagctgcgtgtgtcacccttctttagtgtctcatggtagaaataattcagttttaaaattaacttttagctggacgcagtggctcatgcctgtaatcccaacgctttgtgaggcagaggcaggcagattggttgaggtcaagagttcgagaccagcctggccagcatggtgaaaccctttctttgcttaaaaaaaaaaaaaaaaaaaaaaatttaactggatttggtggcgcatgcgtgtaattgcagctactcgggaggctgaggcaagagaatcacttgaacccaggaggaggttgcagtgagctgagattgcaccactgcactccagcctgggcgacagagccaaactctgtctcaaagaaaaaaaaaacaaacaaaaaaaactaccaacagtctacatgaaggttgtgtgtgttaagtacatctgttaaacttctaagtttctgacaaaaaccttattaactataactcaagaattcatgaagtcccctgtgaatgtgactcatatcagacaggagatcccaagcccttcatgaaggcttgcctcataccctgttcctgggccattgcccaaaaatctactgtgtctctctgttgggcttcagaatgagatgatctggttttaaacgcaggcctgccatcctcaagctaaatgagcatgggttagtggctaaactttttgtgtctgctctcctatatctcacatgggcataaaactatcttagatgtcatgatgtaattgcattattgtttcagattttccacccctccctctatggaagcccttttctaggttcctctggtagagtaccaggcatatggcttcctgccacagggatcctgctgttggtcctgtgacagtttggccaacgaaatgttagcagacatgatacaagcagaggctttagaagtaggtgcttgtgtagctggattcacctgtgtgtgcgtctttcattactatgagaatcatggtttctaaatgggtgtgacatacggagctcacctcacccatcccacaagtgggacttaaaccaagtttagaagaaatgaacttcatctgacgtacagatccatgagtggccaaaaagaaaaaaaaaatattattgaatgccagtgagagttttatgagtgagtaaatgccagtgaggtttgttatgtagttactaaagtggcaataatacaagctgttgtaagatttaaactctagttcccttttttcttctaaagttgctatggcactctcatttaacctctagtagggcatgtatcactcagcacctgtgatgaatagctgctattattcatttttccccccttcttctggtaaagccccttagtgtttctctagagaagtcctctcttccaccctcagtctgtgtcatcagatagaaaaagccccaagcttcacaagggggagtgtgatcgaggcctggccactgatgccatttcatcctcctggcctccctgactggtccgtgcctgggcatatcgcccaactcagtccaatgagattaaatctcaggaatttacatggaattctttggaaagagactcgatttcctctgggcatgctgaactgatagaatgaagtcgaaattttggtagccacctctccatgggttgaaaggcacctgtctgagaatcaaacttgacacagaggaaaataaaggtaagtaacagagatggactatcaacggcattgtataagcgacttgaatgagttctgtctgaatccaaacaccacagacttccggtttcaggatccaacaatttccatgtgggctatggcagtttgtatcatatatttgacccctgtgagccttgtacactggagtgtcctaacattctgtttatttccgtatagaaatcgtcttcattcctgtggttggcaatcctgcatcatttaactttgtgtctcccagtggaaatggcatagtcccttgtacatagcaggtgctcacttaggtttgaattattgcttagatgaataaataatattggtctacagtgaacacacacacacatcctttaacatggctgtagagtttaagttgcaaaaggtcatcttcagaaaccaaaaggtaggccgggcatggtggctgaggccagtacttagggaggcccaggcgggcggatcacctgaggtcgggagtttgagaccagcctgaccagcatggagaaaacccatctctactaaaaatacaaaattagccgggcctgttggcgtgtatgcctgtaatcccagctactcgggaggctgaggcaggagaattgcttgaacctgggaagcggaggttgcagtgagccaggatcaaggcattgcattccagcctgggcaacaagagtgaaactctgactcaaaaaaaaaaaaaaaaaaaaaaaaaataacaacaccaaaaggtatatagtataacaggtattaaaatctatttcaaagaaaggaacttgttgattacgacactggtaatttacagaagagcaagcatttgaatccagccctctgattccagtgtaacctacaatgtaagtgctttcctcaagcataccttacagagctctgcacatcagggagactgttcctgcagaggtgatgtcatctggtattttcactcatcctctggctgtgtccccacccaaatcacatcttgaattgtagttcccataatccccatatgtcatgggaggcacccaataggaagtaaaattgaatcgtggggcttgatttttcctttccttttctcataatagtgagtaagtctcatgaaatctgatggttttataaaggacacactgtctcttgcctgccgccatataagacatacctttgcttctccttcaccttccatcgtgattgtgaggcctccccagccatgtgcaactgtgagtcgattaaaccttttcttctttataaattgtccagtctcaggtatttcttcatagcattatgaaaatagactaatacgtcctcttaatcatcaaataatcttttgattccctaatggatagataggattgttcaggtaactgtgataggcccaacacagtggctcctataatcccagcattttgggaggctggggaggaaaaatcagttgaggccaggagttcgacaccagcatgggaaagatagaaaaaccgtctctacagaaaaagtttttaaaaagtaactgggtatggtggcgtgcacctatagtctcagctacttgggatggtgaggcaggaagattttttgagcccgggagttagaggctgctgcaagccatgatcacactactacagtccagcctgagtgacagagcaagaccctgtctccaaaaaaaaaacaagcaaaacaaacaaacaaaaaccgaaaactgcagtgcattctcattcttagaagattttttaagagcctctataggcctcaaatcgatgctaagtcagagacttattactgcaaaaggcctgtgaatgagcacagataaatggaccattggtacttccaaagaagccatgtagaagttaattatttttgacccatagtgttgctgtttttcatcctttgtcatccttagcagtttggaccatacatttcatgcacaatggttgaatgataattaaagctaccagttattgaatttgtattatgtgttatatacagttacttgtaagggagtcttagggttattatcacttaattcttaaccctacaaaacagattcctatatatttccagtgtgagaaacacatctcagaaatgttaaagtatcaagccactacaccattaaaaaacaatagtgatgagattcagtgccaggtttatctgcccatgttcatgatctctttgctggaaggcactcctggatttggctagaagtccagtcatggcctctacccttgtagctgttttaaatatggtgtctctttacatctaaccagggctatcacctgggtctgtggtgctttcctctcttccctattactaagttttgctacctgacatgttttgtccccaaattggaaaactagtctagtctttgatactgttttattttaaaaaatttcattgaggtgtattccacataactgatatcaattatttttaagtgaacaattcagtggcacatagtgcattaatgttgtgcaactaccacctttatctagttccaaaacattttcattatcccaaaaagaaatcccatgcctattaatcagatgcttttcatttctctctccccccaaccgctggtaaccactggtcggtctgtcacaatggatgtgtccgtttatgatatcttacataaatcgtacaacacgtggcctttttcatctgacttctttcagcataatgtttgcaagattaattcacatgatagcctgtatcagtgcttcatcaatttttatggctgaataatattccactgtagaaatgaaccaattttttcattgatagacatttgggttgtttccattttctagctgttgtgaatgatgctgttatgaacatgaaggtgcaggcacttgtctgttttcaatttttgtgggtatatacctaggcatgaaattgctaggtcatatggtttaaccctttgaggaaactctgtttttcacagctctagtttctgatgtgattgcctctactgtttggggatggatgatacttcgctgacataccttctacatgaccaaatagggagcatggttgtatagacttgacaagtgatcatcatactgagactactgccagtgaaatggttgcgtgtgatttttctgcagctactgggggagacagactgagaaaggatacagggaagcaaaacgggagctcgtgtgccaagtcgaggcattgtaagaggggagaatgatggatggttggatgacagtcagtttgaaatgctggtatggcagatttcccttgagtatcaatgctcagtagtcccactttctgccttttccattctatcaccattattctttgttggacatgcacattcttcaatgcctgttgactctcagccattctgtggtctgttactgtcacttgcaagaatttggctgtcaggggagatgccagcaagtcttttaaaagccactgcaaactttcattgctaacttgtaacttggaggaactttcagagaaagggttataaataaaacacatgcatcaatctgagtttcacaacaggaatgcaattccacttcgtggctagagataaaacatgtcttgccgtgcacagtgagctcttcgccgtgcttgcattttatttcccatcacaatctaagttatggcagatgaagctgctcataaggtatgaggttagacaaccccatgctaattcacttttacacgctatggtgtgtttttaaagatccaagctctgctttcttcagcaactcaggcttgaaggaagggagaggggtggaaaagaacccagaagaacctatgggacaagcgcgagtatggtctgactctccaaccaggttaagccttttgagagcaatagctgaatcttagatctctttgtgccttaaaatgcctggaacagtgattcacataaagggcatgcattaatattaacaagtgcgtgctgctgcagcagaggatagttctgataaccattagagttcatggacaaaaaacgatgatccctaacagcttctcaacgtgtagatactttgcttagtactgtatgtgcattattctgatgtcatgtttgttattggcatgtgtgttgaatacaattatttccattttacagatgggagactgagcatcagagggtcatagccattttatgaagcctgtatttgatagaagccaggaccatctcagccccaaagtgattagggagcctgtgttccttcttaagcattaagcattctacttcactgacctcttggcccatctgaaattgttttgttttcttttttttttttcttttttttccccagaaagagtcttgctctgtcaccgtggctggagtgcaatggcatgatcttgactcactgcaacctccacctcttggattcaagtgattctcctgcctcagcctcccaagtagctagtattatatatgtgcgccaccacacctggctaatttttgtatttttaatagagatggggttttgccatgttggccacgctagtctcaaactactggtctcaggtcatctgtatgcctcagtctcccaaagtgctggtattacaggagggagccactgtgtctggccaccacatgaaattcttataagggagtatattatcttcttccttccttgaatattccaccagttttcctcccttgattttgaatctccctattcttgatttcttagggtcagtggaaatcattcttcttccctttttcattcatttgttcattcattcattcaatatttaccaccaattgaaattttgaatgttaaatatcagccactgttctagttgttgcagataggaaaactaataataggagattcctacctctggggacctagccaggtaatcagagaaatagagggctctgtgctgtgggctggggttgaggggattacagattgctgcaaaaaggagcatgctggagttacacgtaagaaatcagtgtaagaaacggtgtcctggaagaggtggcatctggtccaaatcttgaaggatgggtatgagctggccccatgaatgaaagtgtggagaaagtgtagagttctccattatctggatttccatatctttgtctacaccttgtattttgtagtaatggaatggtgaagaggagtttccagaatgtaaatagttatttggctaggcgctgttgctggcgcctgtaatcccagcactttgggaggccagggcgggtggatcacctgaggtcaggagttcgagaccagtctggccaacatggcgaaactccatctccactaaaaatacaaaaattagccagatgtggtggttggtacctgtaatcccggctactcatggaggctgcggtaggagagtcacttgaaccagagaggcacaggttgcattgagctgagatcatgctacagcatgctccaatctgggcaacagagcgagattccatgtcaaagactgtaaacagttatcttactgtcaaggcaactcaagatgttctattgctttaaatagaaaatggtagtggtgttttgtagtaaattctatatttcattttttaaaaattaacatgttgagtatatctcctatttttcttaataataatcataataaatactaatacaagtctgtaagttaaaggtgtgctgttttgtcaacagattactctgaagagaaaatccattccttatcaaaagaggttcttggattcatcactcactaccttgaaataataatgtttttcttgtatatactctctgttttacttttctttgaaaaagtccaaaagctttctttaaaaacttttctggaagaaaacatttaaaaggaattaaatatatttttaaatttgtaataacatgtcaaagataatacatgtggattggaaagaaacactattaacatttcaaaagtgaaataattgaaagtggtattgttgggttcctgccatcttccctagaggcaaccattggtacatgattaagtgcatccttctacactgaggatttcttttttctttctttcttggtttttttttttttttttttttttttttttttgagacggcgtctggctctgtcacccaggctggaatgcagtggcatgatctttgctcactgcaacccctgtcaccctggttcaaacaattctcctgcctcagcctcccaagtagctaggattaacaacctcactcagcacccttggcgttgctggtcagatgatcctttcttgtgggggggctgacgtgttttgggaggctgcttagcaattaacctcactgccctctagctactagataccaatgccacaccccttccctactctagatgccaaaaatgtctgtagatattgcccatgttcccctggggacaaaaatggctggtgttgagaatcagtcttctagatatttttaaatacacacttaaaattcacgaattaacggaaaagccagagattattcagcaaggcagggatgatttgaaaagggaaaggaaaaataacgacaggaaaagggagttgtgtgtttagaacaaacaagctgagaacacaaaatgaatctcactttttgaacagtcttttgatattgaaggtccaggtacctacgcacgtgtgaagcatttttgagttccattttctcttccttttagaaactgcaacatcctctccctgggagtgggtatttattcaccgcttcactgcagaaagcaggagtcttggataggtaacacaaggaaagaacctagtagcagatgaagaggaaagggagggaggcagggcagtcgatgccagggacacgtgtaacggggtcctgaagacacgcagctaatgaaaggtaagggtggagacagaggcagcgatcctgcacaggaacttgcatcttccatccggaaggaggaatgaatatccttggggagccttctgatgtaggtggcagcaagactttaggaatcgtgtgactttaaattcaaatcctggttgtaccgcagggtgctcatcctttaacgatacgagtttccatgtctgcaaaaatgttgaaccttctttacattttgggtaggccgaccacatcgtggtgatgtgcagaggtggtccacgttcattgcccaggtcccccacgttcattgcccaggtctcccgctagctgtttatttcatcttggtcatgccgtctcacttctccctaccccagttttctcatctggagaagacaggactcatcgtcgccacgtaggttgtatgtattgagtcagtcgacgcatgtaagagcttagaacagactgagtgtggtgccttgtacctgtaatcccagcactttggggaggccgaagcgagaaaatcgtttgagtccaggagttcaagaccagcctaggcaacatggggagacccccttcttatttacagaaaaagggaggggtgcttagaacactgcctggtacatagtaaatactccagagttgctcgctgggatcattagcactcaagtaattcccatgggttgttaagaggcttagagatgagaaaataacctagaacagtgcctggtatacaataagcgttccataagtggcagtgtgggcacagtcttccgggcatacgtgcttgcgggcatgcgtgctctcacgtgctctattcctcctctctttggtccctctccctcttgacattttcctttcttttttttaaaaaccttcctttttttctttgtttgctaccagcctaagagctcaggagagaggactaaccctaagaccaggtgatttatttttctcacgctcatttctctttaataattatcatattgactctgaatttattatactacaagaatgactttatgtgaaatctcatgaatttaaacattaatgtaagataaattaattttaaattgaaatcctcaaacgcagttggatgtgtttccgtatgatgaataagaaattttccgaataaaatctgaatctctgatgttccattttttgtgcaaatggaagaaataggtgaggatatttgacaaggttaaaatatgattgcactgcaatagataggccatgctgtaaactaactttttagtctggggagaaagcagtttgggggcaggctttggtggataaaaagtgaagatttctttgcacatacttaccgagtctcttagtgtcctttaatctaacaccagtgaatataagatataccatcctaaagaggacactattttttacatttttaaaaataaatccattgtattagaggtgtgtttttttttttcttcaactactttaatctcattttctcctaaagttcttctcttcaatatgatctgcaaagggttgaaagtgctgtcctccaaaccaggcgtaagaaagtggttacagataaagcaagtaaatccattaaagaagaaatgggaagatgtgttgtgtgccttatctgacccagcattatcgctggaggggaagtgcttatagggaaggaagagaagtttggtcaattgatgcagtctcagtatgatgacagctggtgacttcctgagggttattcatcacacttcagcagggtgatgttttcaaagcctgagtgtgaccatgtcactcctctgttctccagcgctttcaaaataaaactgaaatccgtctcagagggccagtctcagagtatcccctgccagccccatccttcactgctcagcagtcacctccttccccctcctcacccttttgaggtctcttctgatccttcaggggccagcttctctccgtcccatggttgtttgcccatgctgatcccctacatggatctccggtcacctccatcactcttacctggttagtctttccctggcctttatcccaggtcagcttcgcttctgcaggaatgcctgccttgaaacctcaggtccttctgttccccctcttagagcactgggctattctcctgggaggcagtaattccagtagtaatttgcatacatttgtaagcagttttgattaatgcctgttgtttccactagactctatgctctgtaggggacaaatcttgtctgctttttgctcatcaatttttccccagcacagagctcaatactggcactggtaaacccttgagaaaatgattaaaagcctctaagatgcatgcagttatgaagaaccaacagaaggtacaggtggcatgggacagcagtcaggaagcaatttggcttaaggaggaaggccagtgactcacagatggagtctcagcacttcccttgcccgtagaagtgagaaacaatacaggtagtcacagcatagtaaaaatttcaggccaggcacagtggctcacagctgtaatcccagcactttgggaggctgatgtgggtgggtcacaaggtgaagagatcaggagcatcgtggccaacatgatgaaaccccatctctactcaaaatacaaaaattaactgggcatggtgacacaggcctttagacccagctactcaggagactgaggcaggagaatcacttgaacccaggaggaagaggttgcagtcagtcgacatcacgccattgcactccagcctggcaacagagcgagacgtgtctttaaaaaaaaaaaaaatcagatagcagtttcatatgactagaggctgtgggctgatcagatcctgaaaaaccgggcatggaccaagctggctaagaccaagtggacccaacatggtgctgaatttgacctaggattcacctaggacctcatgatgtgtttgttaacatcctaagtcactgtgacttgggatgttaatgagtgacttaccatgttaatgagcatatcacgaggtcctaggtgaccagcaccatgaattccgagaatacctacgtttggtgtaaaaatggatggcatcacaattctaagaaatttccaccctttcccaggaattttcataagtattccaccccttggctaaagaaacacataaaggtagcagccccaaatccccttaggcatggtgctctcttgagtccgcctacactccccctttcttgagtgtgtacttttcccgttgttataaatctctgtacttccactgttgcctgactcatccttgaattccttcttgagacggtgtcaagagcctggacacctgccgggatcagggtcccaccagcatttggggacctccccaagcccactagtatcagtagagtccctataggtaattgtctaataagtggaaggtgggtgtagaagtttcaagaaaccaaagaaatgtcagatgtgtcatttgacccaaaagaaaagcattttaaaggaagttaatgaaatgcagtcagaaaaaaaaaaaaaatagcataaaaggagaaatctgagaagttctacttttaggaatttaatctacataaatacatatataaggaggcaagaatatgtgaggaagtaaattcaatgtgtacacacacatacatacacagacacacatagatatatagaacgattgtaaaaggctatttgtagatttcttgggtaagttttgggtctgtccatgcaatgaaataccactcaaccattaaaaaaaaaaaaaacaaaaaaacgttaacttataggtacttagtatgacaaaataagtaccattagttaaacaaaaacaggtatttgcataatcatgtgagtaatatgaatgtattttcttttttcttttgtttttttaagacggagtctcgctctgtcacccatacggcagtgcaggggcgtgatcttggctcactacaacctccgtctcctgggttcaagagattcttctgtctcagcctcctgagtagctggaattacaggcacctgccacaacacccagctaatttttgcatttgtagtagaaataggatttcgccacgttggccaggctggtatcgaattcttgaccttaggagatctgcctgccttggcctcccaaagtgctgggattacaggtgtaaaccaccatgcccagccctttatttttattttattttttttatttttttgagatggagttttgctcttgttgcccaggctggagtgcagtggtgcagtctcagctctctgccacctccgccttctgggttcaagtgattctcatgcctcagcctcccaagtaactaggattacaggcacacaccaccaagcctggctaatttttgtatttttaatggagacaaggttttaccatgttggccaggctggtcttgaattcctgacctcaggtgatctgcccacctaagcctcccaaagtgctgggattacaggtgtgagccaccatgcctggctgaatgtattttcttaatgtgtgtgaagacatcagtatctaagaaaagattgtgcattctgatatacacaacagggaaagtctaaaataatacagaactattattcctggttagttcctaacattgtttcataagaaaatattccactttttttttccagtttatctttgaattttactaacgggaagtaataatagatcaatgaagaaaaatgtcacagggaccgtaagaggaagaccttagaaaaataagcaggataaaagcatcctctatgccaggagttctcaactgagactgttttgttcccccaggggacagctggcaatatctggaggcattctggtttgtcagaatggggtggggaaattgatgttgacatctagttggtagaggccaagggttctgctaaacataccacagtatatagaacagctcttacacaaagacttccccaagccaaaatagcaacagtgtcttggttaagaaacgttgctctatcatggttaaaatatggttctctactctttgcattctggtaattttaggaggatgacgtcctctgttgagatggtaaggggtcgagagagtcatccagataaaatcggtgttgactttacaatatctgaatcactcataaaattattcaagatagtaactctcccacctcctggtcaggttgacatttcagcaaccaggtagaattggtcatatagcctgttgtgaatccatggatattttatttaattgcgatatgtaaagttctccaaatgtggatgccatagaaccttcggatttaccatctaagccttttcccaattgatctcactctttttgctctaatcaaatgtacctcaacctccatctaaagtaaagctggatagattcatactactccattatcactaaggttcattttatttgcaagcggttttgctcattataatttcattagcatatttggaggtggggaatgagagaggagacaacacagcttagtcttaccttaaaccttggcttgacttggtcgaattttaactctattcttggctcacccaggtcttatagtccaagatgtaaatttacagaaacaacttcttggactctcctgttttttccaatgtcttattagatgatacgtattttctagattttactgagttaacatattttagttgtgttacctatgcaaaaaacaggaatactctgaaacatatttaaccacataattatacctcagcaaaccctccaaccaaatgcccattatatatcatttacttagcctaatatatttccctttttgaatataagagatttcacctctgaacattacatctaaagatgggcaactgtttaattatttgagtaactcaaaaatattttcaacaagagccagggctgtgggaagtgtcctcaaatggaagggttttaagcattttttttaatacaaagatgataacttgcaaccagttctattatttttaactctttgccccttcctccatctcttgggtttgagaagagctggatctttgggcaattatttattccatttccacatctttgggaaggagggacagtgggaagaacaagacccagcacttggggaatttttatgattatctccagctgtgaatgctagggagcatcatttatgcagtgaaagaagtaggaaaagcaatgtcttacttctgacgaagaacttacagttctctctaaaggggtggaataaaattgctattgcaaaaacgggaagatgttgctaatgggaatataccgaatggtatcactaattaaataaagtactttggaattcattgacagcctgcacttaagaatataattgcatattaatcaaccatttgtagacaaaactgaatgctatttattatgttaggataaaactttttcctgatatttcaaagcctgcgattcaactttgttcctaaattcatcttcagaaatgaatacactgtatttgtatgtgaggagcccaagtgaataaataagcaggagtttctgaagggaacaacacagtgggatttatcttgaaaagagcaattgctgacatatgtcacatgtcattaccagagagttggagacagtgttactcattatgtggttacagagtgttctaaattagagaaatggattattggtagtggatgatttccccagattgctacttaatagtgactgaggggtctgcattactcatatttgcgatgaaaatggtgccaaaacccagcagtggttgactgaaatgaaatgtaacacctattgggtattatcttgagatgctgcctaattgtatgcctcttgcttagtatgaatgtcttggggtctcaggggctgggtgcttgcagcagccgcagacggaaagtgaaggtttctaagttatttacctttttgttgcttcctgcctccttgctgccatgcctgtgcacttcagtaattactttacccactcaaaataagtttctccacttgccctttttccattactgggaagggtctatctttgcagctctctgtaactgtccctacctgtttgagctgccaggcttgtgctcctaggtgagcagcccagctactgttttcattcatttattgattaaatagttaagaatcccaactacgtatcaaagcctgtgctagaccttggttctggattgacaggcgaactagtgtatctgcatttctgcagctttcaatctctggggagacagatattaaaaatacagtcacacaaattgatatgtaactcctgctcctcatttaccactaatgttctaactcagcactagtcctacaggcctcttttctcttattcaaatatttcaggctcttttccacctcatggtctttgaactcactcctctttctggaaggctttttctgtggcactttccttttttttcaagtcttgtattttattttattttattttatttttatttatttatttactgagacggggtctttttctgtcacccagggtggagtgcagtggtaaaatctcggctcattacaacctccgcctcccagattgaagagattctcctgcctcagcctcctgagtacctgcgactataggctcccaacaccatgcctggctaattttttgtatttttagtagagacagggtttcaccatgttggttccgctgttctcaaactcctgacctcaggtgatcaacctgcctcggcttcccaaagtgttggggttacaggtgtgaaccactgctcccagcctcaagctttattttagctcccaccttctcagggagaccctccttgacttcccagactggaatgccagcctggccagctactctctgacagtctgaccgatcatttcctccactgcacttatacacctgttagtatgttgttaaagttacatgtcacagggcagagattttgtcttcctcatgtcttcccattggcacctagaattgactggatgccaaatagacatttgttgtgaccagagaaagactctagatgctatggaatattaaaacaaaaagaattaatttggatgggaaggttcattgaaggtctctgtgaaggactagcattgaggttgatgggtaggtaggaattagataggaagagagatggaaaggagtggtgcagactgaggagacagcgtgggcacagcttgaggaggagaggaacctggcaaggttgatcaatccacagatgagtgtgtccagagtgatgtgacaaggggctagagacatcagccttggaggcacagtagggtttggactgggttgtgagtacactgggaagccattggaggaatttaaaggttgggggtacctgatccaataaatatttttttttctatttttatttttttgaggcggagtctccctctttcgcccgggctggtgtgcagtggtgtgatctcatcccactcggctcaccacaacctccgcctccccagttcaagtgattgtcctgcctcagcctcccaggtagctgggattacaggtgcccgctagcacgccccattagtttttatattttttagtagagatgggggtttcaccacgttggccaggctggtctcaaactcccaaccttaagtgatccacccacctcggcctcccaaatttgctgggattgcaggcatgaggcaccacgcctggccctgatccaaaaaatattttaataagatctcttgggctattgggagaacacttgtttgggaggggaagcgtcaatggatgcctatagccttgcctggtacagagaaagtactcagtaactgtttattgatgaatgaatgaatgaatgaatgaatcagttaattaattaacaggagatatcagtaagtgatttgttcttaaaaagaaaccttgcagaaacttgaaggtgtttgtttgggatgactaagcaagggtagacagattgttgttactcataaatgtcaaaataagaattataaaatttagaataatattgttgtcatgctaagtgatatctggagttaagcgtcctctctgacctgcgactgctcgtgagacagttgcatttactcaggtaactgtggctctcagagtcattcttaaatgttttctttttctccccaatgtgtttgtgactttgtccatctggaagtcaagttcattttggccaattaacttcaaaggcctgacttctctatttttttttttttttttttgagatggtgtctcgctctgttgcccaggctggagtgcagtggcgcgatcttggttcactgtaagcttcatctcccaggttcacgccattctcctgcctcagcctcctgagtagctgggactgtaggcgcccaacaccatgccccggctaattttttatattttttagtagagacgggttagccaggatgttagtgttagccaggatggtctcaatctcctgaccctgtgatctgcccacctcggcctcccacagtgttgggatcacaggcgtgagccaccacgcccgaccggcctgacttctcttgtgaagatggctccgttagtgagcgctgtggactaagatccacaaacacagctgctatgcgggttccctttctgcatctttgtgagtttcagtgtcctaagctagccctcatataggcatagactccttgatattttactctgcataatcaggacaggaaaagatataggacctgtattaaagggacacaagattcagaatcacattaacttccaaatctcagtgccttaacacaatttaagtttctatcttcttggccgggtgtggtggtcacgcctgcaatcccagcactttgggagtccaaggtgggaagatcacttgaggccaggagtttgagaccagcctggtcaacatggtaaaaccccatctctaccaaaaataaaaaaaagtagctgggcatggtggtgcacgactgtagtcccagctactgggagaggctgaggcatgagaatagcttgaacctcagaggtagaggttgcagtgaaccaagattgagtcattgcactccagcctgggtgatagagtaagactctgcttaaaaaaaaaaaaaaaaaaaaaaaaaaaaagtttgtatcatgtgtagctctaaatcggtgtcctgatggatggacagttctactccataatgtgatacagggacccaggctccttccctaggtggctccacctttatggttgccaaagaaagagaggatcatatgtgctgagcctaaaatgataaagagcagcacctccattcccattccatctgccaaaagtgtcatctggtcacatctaactgcagaagaagctcagaaatacagtctctgtccttggaggagaaaagaaacctactgttcaatagctagctcagctctgctacaaaacgcctgctatagaaatgggagacaatcatgcattccttttctacaatttatggtatttcatgggtgaaccattaatacgtcaccgggtaacgcattattgaatatgttagtcattttcttttctcatcgtttcttgaaaaagaagttgtctaacagtcctaacttcccatctggcttcttaaaatctgttttacaagcaatgagatagttaaggattttcagctctgtggttgaattactccaaagaaagaaaactgcttttgaagttagaaactgaaacacacagcaacagaagcaaccagaaaccccatagggttttaaccttgttttgtcatatttctcaacaaactccttatttgtttggggattctgcttagctctgtgcagaggtatcttgctttctgtatcacttcaaaccttccttctacgtgagttagccttagggtatgaccacgaatgacaccttcaaatgggaaccttttgtgcctagagaaatcaaatcatctttcaagacttggctcaaggggtgtatcttctgtgaaggtcttacggactttcaccccgcttcgggggtgacagttcctttcttatgcccctaatttatcctgtgtggactatgatagctcccttgctacaataacatagttctttgcatttattttcttaaagtataacaccagttcattacagaaatttctaatttctgtaattagaaagtacagatgttttttaaaaaatcaagtaaatattatgtgtgagtccatgatgcagaatacttactgctgaaccacagggcctgtatggttaatcattgaatcagcgttgccaagcaaagagtgtgacacacattacttccatatcagtagaagggtggaaggatggctggatgggtggatggatgaatgactcacatagcttctcacggatgaacacacctatttactcggcttttacagtaagcccaggacagggtaaggatgagttggaaatgatatatattggttaacaatagccagagcagtactgagagttcccttgtttgcaaacagtacagttttaagttattcaggaaagctggttttctgagtttaaataactaaaatcaggttaggttgtactaggtaacatacaaactgtggatctccgtgttttaacacttgcatattgctctctcatctgagcgtgctgctagtctgttccacgaggtggctcaagacccaggctgcttccattttgtagatgtgccacctggctgactctgataaggaagtggagtcagagttcttgggttctccgcaatggtagtgacttccaatcacggtccaccagctagagctgatcacccagcctcacccaacagcaagagtattttgagccactcagaaggtgatgagaactagacatggatgaacataaccatgtcctatgcagtaccgggtaattgggaagactataataaaaatggtttagcatgtgagtactgggctcagactggttttgagcctctactgggaacaatttgtgcaatcttgggcaagtcgctcaatctctctaagcctcactccctcattgaaaattgaggataataatagttttaattaaataatgtgctaatcactgtgggcattgtgcaagttcagataaacattagttatctttaaatgtccatgaatacttaaaataattgtcattattacaatcttgttatcattggtagaagtggtagtaatgaggtagcacttgggactccacttcagaccacattgaagactggcggaaactgagaagaggcactgaaagcatgcccaacagcaacaatgacagtttactgtcaccatggcaacagcaggaagttaccacctctttccatggcaacacctggaagttaccacccctttccatggcaatactgggaagttaccacccctttttttttttttccattttactttaagttccgggatgcatgtgcagaacatgcaggtttgttacaaaggtatacatgtgttgtggtggtttgctgcacctatcaacctgttgtctaggtttaaagccccacatgcattaagtatttgtcctaatgctctacctccccttgccccctagcccccgacaggccccagtgtgtattgttcccttccctgtgtccatgtgttatcattgttcatctgccacttaagagtgagaagatgtggtgtttggttttctgttcctgtgatggtttgctgagaatgatggcttccagcttcacccatgtccctgcaaagaccattaactcattcttttttatggctgcataatattccctggtgcatatgtgccacattttctttatccagtctattattgatgggcatttgggttgactagcccttttctagaaatgtctgaataacctgccccttaatttgcatgcaattaaaagtgggtataaatgcaactgcaaaactgcttctgagctgctactctgcacacactgcctatgaggtagtcctcttctgctgcccctctgctgctgctgtgcactgccacttaagtaaaagttgctgtctaacaccactggtttgtcctagaattctttattgggcaaagccgataaccttcccatgctaatccccagtctgggggcttgcccgtcctgcatcggtaatacatttgcttagcatcctccaggggtctcaattagtgtcatacaaatgtacatgcctcaaaaggatatatcagaatactccattctcagctttctcaggtgcttccccgtcatactctgaaggaaaatcacactgagaatctcacccacagaaaaaggattcttcattattaaataccattcaagactgtgcactggtttttgatttttttttttaagaaaaaataaggggaggagtgtatccatcattttcttttttttctttatttttgtgaccgagtcttgctctgtcgacgaggctggagtgcagtgctgtgatcttggctccctgtaacctctgcctcctgggttcaagtgattctcccgcctcagcctcccaagtaggtgagattacaggcacacaccaccacacccagctaatttttgtatttcttgtagagacagggtttcaccatgttggccaggctgttctcgaattcctgacctcaagtgatccacccgcctcagccccccaaagtgctgggattacaggcaagagccactgtgcccggcacatcattttcaacatagctgcctcagtctgaaaacgataactcctcactctactattaaccccactgactccatctgggcagaaaggctgaggttaggttgtcagctgcgtcactgctgtggaaacatcgacagactcaataaacaccctgaaatttaacatgcttctgctatctgctgaacagctctgggcacaaataggtttcttttattatggacagaaaggccaagtgaaattttaatcagacagacaaggagggtatctgagaacactgaaatgccagccctgctggtatttccacaatattgaacttgtctttcggggaccttggtaggtatttcaattagctgtgagacacacagcctgtgtttttgcaaactctcctatttttaattaagatgctgttcactgggatattagaaggcacacgattcttcttgtaatatgcaaactatagaagagaaaattaagcagttgaaacatttggatgtagaaagtggattgtagtcatagctaaaatcatagcacttcgtgtactcatagctataatcatacctctgttcttacgtgatatttggggtatcttttcccctcccatcccattctctcgatttcttaactttcaattgcattattatgtatatttgctttaacgtatgatgagcctgttttcctgttttctttttaaaataacgaaatatttggtataaacaaaataatatctgtagcaactatggaccctgggaaggataataaaacaaaaatccgtgagtttactactcaacttaaaaattaaaatgctgatcagtactactgaattgacttgcttgcttcttggtgagtttattttttcatggagataatcaggcaccgttttgccagttaaggtgcctaaaagcaccataaatcactggaaattctagactaaaaagaggtctttctttctttaaagctttgtccatcttttagtcacacggaacacactgaaagaccttccgaaaaatgaaaaggcaactttagggtgtaaggggctgcagggccgcctctaacattcattcgttcattcattggtccctgtatttcaggattcctgcgttggttcctccattccttcattaaatgttgagtatgatcacagtcttctttcaactataattagtagaattaactgctattggctgaatgttcatgtccccctaaatttgtgtgttgaaattctaatcccaaggtgatagtattagaaaatgggatctttgggaggtgatggggccatagagcatagccctcatgaatgggattagtgccttcataaaaaggcttgagtctggtcacagtggctcatacccataaccccagcactttgggaggccgaggctggtggatcatgaggtcaacagatcgagaccatcctggccaacatggtgaaaccccgtctctactacaaatacaaaaattagatcagtgtggtggtgtgcacctgtagtcccagctactcgggaggctgaggcaggagaattgcttgatcctgggaggtggaggttgtggtgagctgagatcgtcccattgtactctagcctgggcgacgaaagtgagactctgtctcaaaaaaaaaaaaaaaaacgaaaaaaggtttgagagacccctcaccgctttaatcatgtgaagttagagttaagggtatctaccaggaggtggacactcaccagacactgaatctgccagcaccttgggcttagcctccagaattgggagaaataaacttgttttgtgcaagccacctgtttgtttgtttttaatttttagcacctttttttttcaattttcttgtgcatttgcttaagttccttgtacactctggatattagcctatggcattttgctagaagcctgaacagactaagacaatgattatgaaaagatttagttataaacattataataatggtcagttatcctgcccattatactcaggttcttttgagaattccttgcgaggtttgataaggacattagattttgtttacatgtttgtggttttagacagcaaacatgcattgaagaatgttagacaggaataaagttgaaatagcctcactcacactaaagagcccagagtgttaattgacatcctgttttccataatttttttcttttgtttgcttgtcaataaaaccctcatgcaacctgagtggaaggggagagtcattaatgcggtagatctggatgattttctgaacaacctaacctcacgctaatgaggcgagtattaccacaggccctttctcctacgagctgtccacccacagttgaagagctaattttactctcaaaactctcacgaatgcttttggttcctgccggctcttgagtagtaacagagtgctttagccctctgtggaaaatgatggaggcattgtcagggcacatgaaccctctaagaagtggatgtggtcccacctctacttaaacctggaccatgcagcttaagggttccattctcaagccagtgaacatcactgtcttcatgtgaatgttcttcaggtagaattttttagcataaaaaattccaacaggccgggcgcggtggctcacgcctgtaatcctagcactttgggaggtcgaggcgggtggatcacgaggtcaggagatcgagaccatcctggctaatacggtgaaaccccgtctctattaaaaaaaaaatacaaaaaattagccgggcgtggtggcgggcgcctgtagtcccagctacacgggaggctgagggaggagaatggcgtgaacccgggaggcggaacttgcagtgagcggagatcgcgccactgcactccagcctgggtgacagagcaagactgtctcagaaaaaaaaataaaaaataaataaataaataaataaataaataaataaattggaactgagtgttagctatttgagtagtctcagctgaataatacctctgacatggtatcattctgtggcatatatttttctgtaaggaaataaaaacaactttcttaattatttttttctgatcagagaaacaacacatacacatctttggaaagacaaatactttgtgcacatatagagaagaaatgttctccttatttaatccaactacttggagattattcactgtttgggcaactttgctgaccttgctctatatttatatacaaatatgaatgtgtgtgtttgtttagaaaaaccaaattgaatcatatatttttatcctgcccttttcagcttgatgaatatctgtatcaactttttaatggctctgcagtgttccattgtatagacatacttaatttatgtatccagtttcctgctgacagacatttagactgttttttttaaatctatttgctttttttttttttaattttacttcaagttctgggatacatgtgtagaatgtgcaggtttgttacataggtatacatgtgccatggtggtttgctgcacctgtcaacccgtcatctaggttttaagcccggcatgcattaggtatttgtcctaatgctctccctccatgttcccccaaccccctgacaggccccggtgtgtgatgttcccctccctgtgtccatgtgttctcattgttcaactccgacttatgagtgagaacatgcagtgtttggttttctgttcctgtgttagtttgctgagaacgatggtttccaggttcatccatgtccttgcaaaggatatgatctcattcttttttatggctgcctagtattccatggtgtgtatgtgccacgtgttctttatccttgatgggcatttgggttggttccaagatttactattgtaaataggttgtttcttattgttgttgttttcaaaacataacacattttaagcatatgattctctgagcaaagttttctattagagtggatgtctcttgggtttaaagaatgggtgaaaatctctttatttctgtgaaccttttgcaaagttggacagcagtatcaagttagccaaggaaggatgtcacacagagtggccatggtggtcttctggagcaaatagagaaaacacatattccagggaggaaaaaaaaaaattccttactttttgtatagcccaatcttattttcagttaataaagctttggccagacatggtggcttacacctgtaatcccagtactttgggaggctgaggcgggcagatcacgaggtcaggagatcgagaccatcctggctaacactgtgaaaccccgtctgtactaaaaataaaaaaaaattatctaggcatggtggcgggcacctgtagtcccagctactcaggacgttgaggcaggagaatggcatgaacccaggaggtggagcttgcagtgagccgacatcgcgccaccgcactccagcctgggtgacagagcgagactccatctcaaaataaataagtaaaattataaaaaagctttacaggtagttccttttcacatataaattaagttagtagatttaggaacgtatccttcactattctgttccatgccaaaagaaataacaaaaacaagatttgacccttaggttgaagttctcctgaactgactgttccctcaatatcttcatatcccctggattgtccttcagtatctaagaatatgggggggaaattaccagaattctccactgtctcatggaaatcacaaggcttgcttggatcgtaatgtgtacaattcactattaacaaaggatatggcattttctgtctgaaccttttcccaacaatccattttctttctctctctctttctctgtctctctctccccacccccaaatccctctctgtctctaagccaccatcacatcttccctgcatggcttttctctctctccatcattacccctacaggccagtccccttatagcttctggaggaatcttctttttttttttccttcatgttttaagttcaggggtacatgtgcaggatgtacagatttgttacataggtaaataggtaccatggcagtttgctgcacaggtcatcccatcacctaggtattaaatctggtgttcattaggtattctttctgatgctctctttccttcccctcagcagatccccacgcccattgttctctcccatgtgcccatgtgttctcatcattcacctactacttataagtaagaacatgtggtgtttggttttctgttcctgcgttagttatcttccaactccatctatgtctctgcagaagatatgaccttattcttttttatggctgcatagtattccatggtgtatatgtacgacttttttttttatccagtctttgtcattgatgggcatttaggttgagtccttgtctttgctatcgtgaatagtgctgcaattaacttacatgtgcacatacctttataaaagaatgatttctgttcctttgggtatatagccagtaattggattgttgggtcaaatggtatttctgcatctaggtctttgaggaattgttagaccatcttctgcaatggttgaactaatttacactgcctccaacagtgtaaaaatgttgctttttctccataaccttgccagcacctgttttttaatatttttattagtaaccattctgactggtgtgagatggtatctcattgtggttttgatttgaatttctctaatgatcagtgatactaagcttttttcctatgtttgttggccgcatgtatgtcttcttttgagaattgtctgtttatgtcctttgcccactttttcatggggttatgtttttcttgcacatttgcttgagttccttgtacactctggatattagacctttgtcagatggatagattgcgaacattgtctgccattctgtgggttgtctgttcactctggtagtttctttttctgcacagaagctctttagtttaattagatcccatttatcaattttcgcttttgcagcaattgcttttggcattttcgttatgaatccttgcccgtacctgtgtcctgaatggtattgcctaggttttttttttctagtgtttttagagttttgggttttacatttaactctttaatctttcttgagttaatttttgtgtattgtgtaaggaagaggtccagtttcaattttctgtgtatggccagacagttgtcccagcaccatttattaaatagagaatcctttccccattgcttgtttttgtcaggtttgtcaaagatcagatggatgggggtgtgcagtcttatttctgagttctgtgttctgttccgttggtcgttgtgtctgtttttgcaccagtgccatgctgttttggttattgtagccttgtaggtaatcttcttaaatcatacattttatcaggacactatcacttacgacccttcattggtttctcattctacaaagagaaaatttcagagatctcaccagaacgttccaggccttgcttctctgacacagacccatgtacctccttcctgacccccatacacaactcacactggtcttttatcagatcctcaaacaagtaaggctctttcatattttagagactttgtacctcttccttacccctcttgggataatctcagtcccacttgtgtatggctattccttctgattctttatatctcactttaaatgtcattatcttaaaaaggcaaatctcaacctgccatggacagcagatgcttcttccttaggtgttactgataaaataatgcatcaatgcatctctgtaaaatgaacctgtgcatctgcttcaggccatatttctgtccctcaacaagcacatcacagttgtaatctgtgtccattcatatttctgtaccactaaaatataggtatagtctttgtttttcattcgtatatcagacttgttgcctagcccagagctgcttacacggtggcccatccaataaatatttgttgaagactgaggacttgggaagggtgtgtgcatgttttcagtctgtgtgatagcttcacctcctattacgtgaattggcccgaagatccccaattccgtgtcatcaagaaacatggacacatcacagactcactcaacatggacacatcaagactcacttaacgcagggtggcttcccaacagcaagctgtattgctgaaaagcaggccttttccagtaagaacatggacaaggacaaacaagagactgcactgtgttctataagaagacacctgggtcataatgagggagagaaaaataagaccacagcaaatgaaacaaaatgtgtaacataccagacaggggaggaatcaagggagctgttcggggagctgctgcaatgcgagattggagctacaaatgtggaaacgcacgaagacctttgcccctatgaatcatgtattgggaaaacagttgagcatctacagacgtcaaataaccaataaaatttcatgaatggtaacgttcgccagtatccgggagaataaggctgagctctcaacatgatctgctaacaaaattaggtcatttgtctttgataggagatggccactttcttattttttatttattcatttgtaagcagctgctttaataagcctacaggatcttggatggcatgctcataagttctagtaaagcctggaagaaaattacaaagggaaagactgcctctaaattaccctaggaaacaaaaaaaaaaagaggtgatggctacagttttaccatgtctttgggggcaaagtgatttccttctttctgtgttcttgttggggaaaaggggaaggtgttaaatcccacagctgcaaaatagattcatttctgcctctcttgtaaagtgaagcatctttccttcccagagaactttatcttgcctcagtcaaccctgctcagagatggttcatccactcctgtcttgcggccattaaacatagcaactcaagccctcacttccagggacttaatattggtcatttaatactgcataacaacatttcatgatatacaacatgtatctctcatgcctttctaggctggctggggtttggctggcccagactgtgctcatttggacagctctgcttcatgctatgggtccagccagacctgtgtcctcacaactgcaagggggtcttcaatctgccctatgtgtgcacattctggggccgggtctaggggaagcagccgtctagactgcttggtgctctgtcatcatcttcacagcaatggggagccacagggggtgggctggaatccttaccactgtggcccacgttttattggccaaagcatgatacgcaactgatggcacagtcaaggtgtagggaagtgtggtccatggtcagtcgctgaaaagttgcatggcaaagggagtgaatacaagggacgtgaagaatggaagaattgctgccagtaattcagtcgaccacagcataactacaagaggctgatacggttatttgacagtgatcgtcaggattagagcacccatcaacctgtgaatgcttacacatttttattctgttttaaaacagtcacgtgtggcttagaaattaaataaaatctggtaattttactatgaaaaaaattattcccaccaagacttccttttggtggtggttgttgttgaaatggagtcttggtctgtcagtcaggctggagagtactggcacaatcttggctcactgcaacctctgtatcaagcaattatcctgcctcagcctcccaaatagctaagactataggcacctgccaccatgcccggctaatttttttatttttaatagagacacggggtcttaccatgttggccaggctggtctccaactcctgacctcaagtgatccacccaccttggcctcacaaagtgctgggatttgcaggtgtgagtcattgtgcccgatccaagactgtctaatgctgtgttaccccacaaggaggctgatcacagcctccttgtggggtgatacagcaagtggcgacaccatggtgagctcgggcccatgaccattcaaagggagtcacttcacagctgcagctgattgtgaccatgtgggaaggtgggcatagtatggccaggctttctcatttctccagagaagtttggcatctgcattttttatgagtgaaatttatagtttttgaatgttagtcactaatacaaagttttatgaaaatgctttgcatgccaaacaaacacttctgttgaccacacatggccagcaggcacccgattgccagcccaccttagactgaaggcactatttgctattttcgacattattggtcaaatctaaatagctagatggatatatagaaaaagaaaagaagagatagaaaaaaaggtgatagaaccaaagaaagaatgaaagagaagatgtatgtgtatgtgtgtagagagagatgatggaaggaaggaaaggagggagggaaaaaagcaacctaggtagatagctgggcagatggatggaatgagagataatagatggataatctttaacgttcagtaacatatgacaagtcacattgccaagtagaagaaactcagcaggcagcatttaaagagaaagtttcacactcatggaggagcaggccagtgattagtgtcagggataatgacccaaattcactgattgtatttcctcaggtgtcaaagaggaacagaaaacgatagtgttgcaaagaaaaagaccagagaatgtctcaccctgggtaattctaccttgcttcatgcacgcttaactagcaacttgcctgtcctgattccaaagcacgtttaggtagtcccaccattggccaggcttacgtgtccctgaacctgcagatttaggaaaaagtaaacagctgtcctcaagagtgcatgagacgctccacatttctcctttgtgatttatatataatcatccccagagagtgaaacaaaggaaccaagtaacttgctgaacactcttgaatgtagaggaaaaattatccacctatcagagagtgtgttgacagtagtgagcttttaatactgaggaagtctttccgtggcacctaaaagttagctcctgcaatattctgctcattggcaaaaatcgtgttcatttttaagagaaatagattatgacaaaagtagaaaaaatatagtcttatactttagatagaactgaaaggcctggctgggtgtggtggctcacacctgtaatactaacacttgggaggctgaggctggtagatcacttgaggccaggggttcgagaccagcctcgccaatatggcaaaaccctatctctactaaacaatacaaaaattagctgggtatggtggtgcatgcctgtagtcccagctactccacaggctgagacaggagaattgcttgaatgcaggaggcggaggtttcagtgagctgagattgtaccactgtactgcagcctgggcaagaaagcaagactccatctcaaaaaaacaaaacaaaataaaacaaaaaaaactgaaaagtccatctgccatgactgtctacatcgcctacatcccacatatccctaagacccagtacaaatgccatctcctccaagaagccaccttgatttctacccactgaaaatcctctctccctcttttctttgtccgttgtgccttatttttcttcctaccctgccacttaactctccctgatttataattatttgtgtgtgtatatctcccagttgactaggaagatgacttggattagaaagctggagactttgtctttgaatcttgcaatactgttgattttggtagatgaacaaaagtgacaagtgacatcttttttctcaaagaaatacaccatgtactcctttgtgcatagataccttcttaaccgagtcgattgacatggactcttaagtatttagcttcttggattctaaagtaaacttacaagttcctgcaccctagggttcctttccctttatcatttagtccttcattcagtgaattcagttgttcctcaaatgaagcagaaatgattcctcttttggggcgtaaagtgtagtgtgaagctttaaaaaataaaagtaaataaataattgcatacttacaaatattgacaggtacgatgaaagaataaactacgttgttctacaaaataaaattaaggtgagtgtagttgggagagaaccctacttaggtaggttggtcctggagggcttctctgaggaggtgatgttcaagctgaggggtaaaggatgacaaatgaggtttgagttgagagcttatcaggagactgattgcctaaggtacaataagagaagagatgggagaggaagttggaggaagaaacaaggccagatctgtacccacacagctaagattatatccctactggccttaacaaattaaagcacttcttcccatgccttccacagatgactcctaatgtcattcttttgcaatatttctaccttctttcattttaacttccgttacatatagctatgcagaaaaaaaatcaatttgttggctaaaataaagaatagtgacaataccaaatgctgtcaaagatcactcaaatattgctggtgggaatgtcaaatgacttaatcactttggaaaatcatctctcattttcttgtagaactaagcatgcacctcccatataattgagcaattgcacacttgggcatttatcccagtaaaatgaaaacacatccacaaaacaacctgtatgcaaatgttcactgcagctttatttgtaataatagctaaagactgtaaatagcccgtatgttttcagtgcatgaatggttacactgtgataatccacactgtggaatactatgtagcaataaaaaagaacaaattattgatgatagacacacaacaactaggatgaaactccagggtgagtttcactcccttgtggtgagtggaaaaaaagcccatttctaaatcattttgtccagtctcagcaatcatttttatgtatctaaaggttacatacaaaatgataccgtgtatgtagcattcttgagtttaaaattctagatatagagaatcaatgcgtggttgccggggtcaggagtgagaggtgtggagtgacagtagggtgtggtcatagaaggcgtctttttgtctgtggactattttttgtcctggctgtgatatttatagttttgtcagatgttacccctggagcaataagagtagaggtcatgggctctctgtatattacttattaaattacatgtgaatctacagttatctcaaaaagtttaatttttaaaattccttcatataacaacttagagtttgaaagatattcacaacatattttacatattaaatttttatttaaatatttgtgttctcctctgccaaattgtaagagctttcccctaagagatcttgtcttaattatctttacatgcctcctctcaagcctcctgttgtcagggaaagaacaaggctctagggtcgagaagacatgggtgagataacaatttcaatgccaggcaaaggactttggcaaattcagagcatgatttgataaagactggaactcacaggcagaaggactggcaggtggcacccggacccttaactccttcctctgggcatcaaggcgcagacatggatgatgccctgtgtgcttgcattctagaacagggacaccactatcctttagctgtattttttggggggttggagagtacggtgtattagtttccattgggttttttttttttttctttttttgagatggaggttcgtcgcccaggctggagtccagtggtgtgatctcggctcactgcaagctccatctcccgggttcatgccattctcctgactcagtctcttgagtagctgagactacaggcacctgccaccacgtaactaccacagatgtggtggcttaaaatgatataaatttattatctaacagttttggtgatctgatgtctgaaatcagtgtcactggcctgcaaccaaggttttgatagggctctgctttctctggagtctattcttctagcttgtagtggctacatgactgcagtctctgcctctgtgttcttgctgtcttccgttctgtgtgtgcctctgcgtctttcttttaaggatgcttgaggttgcgtgtagggccctctggataatccaggttgatcacccattttgtgagcatcagttcagtcacatcagcaaggaaactatttccttacaaagtttataagtttcagggatttttgacctgagatatctgagtggctattatctggcttattagggtaagtgtgagaacagtcttacaagtagggaacaattccttgtgtctcagaaattaactttggcgagatacatggtggcaactagctgtccaggaaaggtgcatgttggaaactagctgtccagatgagatgcatgctgggaactagctgtctgggagaggtacatgctgggaactagctgtccaggtaaggtgcttgcctaggtgaggtgcatgccaggaaatagctgtgccagcgaggcgtgggctgggaactagctgtctaggtgagatgcatgctgggaactagctgtctgggagaggtacatgctgggaactagctgtccaggtgagatgcatactggaaactgctttccaggtgaggtgcatgctgggaactgctgtccaggtgaggtgcatgctgggaactagctgtccacacaaggtgcatgctgggaactagctgtccatgcaaggaggatgctgggactgtgttgatgacatcaagagaccatgtgagcccagcaccctatggatggacaatctcactggcagaattggaacagctggtcccagctggcttattgccaggcaacccagagacagcctctggtgttacccttcacacagttctatccctccctccatatatactacctaatgattgtgcgaacttgggaaagctgcttaacttctctgagcctgagtttcctcctttgtaaaaggagactaatactggtgtttacccttagggcttttgtgagcattaatgatagtatgtataaggtttgtagtaagtgccatataaatgttggctgtaattattatattcttgtttttgatattgtttctatgaggatggtggtggtagtggtggtggcatacctctgtgcattgtagcataccctaagggttggctgcataacgttgaattttagttcgcagagttactgatagtgcctgcccccagccattgggcttcctggtttaaaaggcaaatcatcctgatggaggatggtgcctacagtgtggtgctcgaggacaatccctgtctgcttgggactctgacagtggtagatgctttcagaatttgggttatgagtgattgagggaggttagcaaacggattcctacctccttgtactgtatgaagcagtttgatgggattaatttgcatggcccatagtaaatgctctcagcctgtatggaggctaatttgtgaacctgtagcaatttatcaccctggttggattcgtttaccagtagacaatgtgattgggataatgcgcctcactgtgcgtggagaggagctgcactctgacctcacttgaagaaaccaccgaggggtaatttcctccccaacggatgactgacattacagtgtggtgacaaatgatgagtatggtaaatggttaatatagccagggccaggatctatatgatttatgcaaataattagctcttcctgggtagtagcctgcatgtctaggtaacttttattttttcagacagtcatctccgtaatgagctattagtctgcaggccagaaagaaagaaaggtagaaggaaggacagacctcaggcagttaagtctttgttccttccagaaatcctatttatttaaagctgagtgtgataatgttttcttttacaaaactccattgctctgtattgtaaaagcaactcaaaatatgagtgtctgacgtttattagtttcaataacggtttctggggtttagacagagcttgcattcatcttcactgagttccattaacacggagggacatataccattagcaccatttcctagttagagaatgtaaggaaagatggaggatcaatatgactgtattaggaaggagtctttgggtacaaattatggaacctatgaagaggaaagggcttaaggggttaattattaaaaagcttatctaaggaatattttatataaatataggatgatctgggaagctaaattgatggaaattcaatggcatgttacaccttgagggctgccagaaataggaagtttagcgaagttgggactttctctcaggttacctgttttgcctggccaacgacatcttctgaacctcacgcattacctccctgccaactaggagaggtgaatttttttttttttttttttttttttgagactgagtctcgctgttttgcccaggctggagtgcagtggcgctatctgggctcactgcaagctccgcctcctgggttcaagtcgttctcctgcgtcagcctcccgagtagctggaactacaggcgcctgccattgcgcccggctaattttttgtatttttagtagagacggggtttcaccatgttagccaggatggtctgcatctcctgacctcgtgatccgcctgcctcggcctcccaaagtgctgggattacaggcgtgagccaccgcgcccagccgaggtgaataatttttttattctggtttctatatgacagaggagaactttgatcaccgagattagaatcccttgttaatgcttggactaatctttggtggcaaaggagtcagtgccacctaaggacaatgtttcactgttgggaggtgggtgggaggagtaggtcctgagaggagagagtgatgatcccaacagaagagaaggatgctatgtagggagttgacagattccagcactatactgtaaattccgtgagtgtgtagctatacgtgttctggtgagcatgatatccccagtacccaatatagtacctggcaaaatgataagcatgcagtgaacatatgcatgaggaagggagggagggagagggggaaggagggcagtcagcattctagtatacaggtctgagatagccaagaaaaagcaagcaaaattttcagcaggtagtcacacaaaacagaaataagaagagatcttggccgggcgcagtggctcacgcctgtaatcccagcactttgggagggtgaggcgggcggatcatgaggtcaggagatcgagaccatcctggctaacacagtgaaaccccgtctctactaaaaatacagaaaaaattagctgggggcgatggcaggtgcctgtagtcccagctactggggaggctgaggcaggagaatggcgtgaacccgagaggtggagcttgcagtgagcctggatcgcaccacttcactccagcctgggcaacagagtgagactccatctcaaaaaaaaaaaaaaaagatcttttaactctggagagttatctcagcgatcgaaaccttgattgcacttcctagatttattggattcatttaattgcgcagcccttggaagttttatcctctacctttagaggatttgagtgataaatttccttcttcccttccttcctccttccctccctccttccctccctctttccctcccttcctttcttccctgctttcttccctccttgtctccctccttacctcccttctttccttctttctttactcatgcacatattcacttcatgggctctgtcatttgtacccaaagactcctgcctaatacaggcctattgatcctccatcttcccttatattctctaactagggaatggtgctcatggtatatgtctctctgggttaatggacctcagtgaagatgaaatgaagacccttcccttcccttccctttcttccctttccttcccttccctttaccttcccttccctttaccttccttgcttcctttccttcccttcttcaaatgtgtattgagaaccagatactgtgccagccacgagaaacatctgaatcatcaaggcagcctccatctgctcagatctttttagtaggtgttttattgttgagtatgatgatgtaggagttctattcccaattcatattgttttgaagccacgtctgaattctgagtaactaggatgatgagtagactatgtctccttggagtccctgtttgaggctaggatttaggtgagcaatcctgatcccactcaggagacagcaggaccacctgagccactgacctttaaacccaggatataaaggttatcattgccctctagaaatatcaaattggtaagaaaggaaaatgctccctcatgaatgttcatcaaagagtgtttcccatcaggtgatattctgtcccttcaggccaccgtggaattcattaaagatgagaagacagtgataaaccacctcttgtgcaggaatatttatatattcctgtattcttcaagatgttacaaattccatttaataagtaaagtggttatctcaatcacaaactaccatgaggcaataatgatgatccatttgtcaaaaaccgccactcaagcactaaggagatgtgtgtaacagttggcattttaagcattgcgattgtcaaaccactgattgacagatcccttaattgtcaattcagataataataattctgctgcaaaatgttagagacagagaaagggaaaagaaagaaagagaaagagaaggaaagaaaacgaacggagggacatgagaagaaagggagggacaaagagaaggaggacttgagataaatattagacatgctttggagtttttcaatggcttactgcaaatcgtgttcaaccccacatcattgctggctggttgtctttcttatttgttgtgaagtgattgcttcaaaaaccctgacacaaatctctgtagagtgattttttgtgtggtcaagaattttgtgattttaaaaagactttcaggttcctgctgatttgggactttggctctctctacgctgatatataaatcatattacacaatattgataactccccaatctctaaataaatcgcaaacttattaggaagaatcccaaagaagaagtcaacacctttactgaagaactatttaaaaagatgtatgggtagcatctaagtgctcacgttattcttagtgaatcagaggtctccatcctacgaagcatgggagaggtcaaatcccatgtacgccagctgaaagagttaagccatttttctatttacatggtttatttcacaagggtctgactcattgggcataaccagcacagttaaatttcaaaattactatttggtcctttttttattgactacaattcaaggctgcttcaagcctcccaaatttaatcgccgtagctctttgccaagaacattatgttttattttcagtgttaaactgtgtaagatgcccctaaggctacatggaaacttactctctgtgatagcagctaacggagtgtatcagttgttcatgatttcccattctcctgtaaattgggagaggcagggagagcagtggaatgcgaattttgttctgtcagcactttcttgccccagctttagcccaagcagtgcctgttttggtaattaattatagtgtgtttgtagctcttcatgctcagttaccatttagcaacctgtcaaatcctgagctaatgagcctatcccacagaagtcattgcatttactttattttatttttaagcatcaagacaatactggtttttcgtaggtcagatgaagttgagagggagattctaaaccagcatatggaaaaggcaaggcttttctcttctactcacaaatgttcatcccaagaatggccttgcttaaagtttttcattgatgtttctctaactagaaattggagttattaaatacagttattaaaatacagttattaacgtgactgtaatttaatatttgaaggaagaaatagctcactcataagtgtccttttcaaagtgttgttggtaaacgaaggttgaatggttttgagatttatctcaaatgatgaactacactttgtagggaatgtttcagaggtcttccctctctgtgttgagagactagattaggatatctagcttaggattttcatctaaaatacaggaaaaagcagagcagattcgtgatactttcctctccttgttggttttgtgttgttctttcttctttaattgtggacttgaaggagttccacaatctcgttatgggaaggacttaggcatagcactttggtttccgggcagaggtagaacatactccttgaagctgcttttgtatcacgcttgcttgttttacttagaatcgtacggttacagctcaattaaaatagcagagttttctgagaatgatttcattctctttatgtgagactcagacgatttcatttagtttatatgagacatatcactaatctctactaaaaaatagaaacaataattttatggaattacatatcagaatatgagtgttcagctcagcctctttatggaacagtgtataccaaaaacacatctttattcttagttgaaagttttagaaaacccagaaattagagcagtggcattcgcctctgctggttagaagtataatcttcaattcaacatgcaaaactcagactcgtagctatttctgaagctcagctataactacagtatcatgtggtcagtaagttctgcatttctaaaggaagatattattttcactgtcaatcaaaggtaggtaaaaacacatgtacacattttagcttagctgaccaggtcacagggatgtgtacctgtttatgtataagtgccaggactgaggctggaaggaggaattaagttatgctcccttaataccatcagtgttgtattgtcctaaaaaaagtgtatatatatatatatatacatatatatacgtatatatatatgtatatatatacgtatatatatgtatatatatgtatatatatatgtatatatatatatacaaaaattagttcctcaatccaataagaacatgattctgactctttataaaaatgactcctcttgaatattatttgttcccatctcattcgttgataatatctattatatttttataagaaagagtcaaaaattctatgcaaaattctctgttctcctcaaacagatgacgcttttgcccatacttggctctaatatcataattgattttacttgtcagctctctgttcatcagagaacttgataagcagaagaacagttgctcactcttgttcaagtctactgccctaatgcccatggacctgcaaatttcccaaatgtgagtggtttttatgctgcctgtggaaatctgaatttagatgagccacactttgtagaaaatgcttcagagatcttcctgccgcctctctgtgtcgataacctccatggaactgtgtttgtgagatactcaataatggaaccatttaattcaaattttttaatcgactacggtatcagcaaaatgagaaatgtctttcacccttgatctttgacaatagcagacatgttaatatgaagttactgctaaggctccaaaaggcattgatacaagtatattttttctgccattcttgtttctttatagaatcacacttttgagtattcagagcttgcttttcctttgagttagaggaatgcattggagagaagtgttattgatgagggctgattaagcaaattaatgaattgagacagctgaatagtaagtgagaagaatttgaggagtggaattggtttttgctcattgactgtaaagtgtaggagttaacaccacaagggtacctgatggaacgagctataataccgaggtaagtgaagagagagcatttggaattgtgtactatttttcctcttccaatgaatagctgtgcgctagctgttcactgctttcctggcatatgtttttcttgcttcattttctgagtcatctgcaatagcggaaatgaattcattcaacaatatatattgaatgcccgttatgttccagacacaatgttaggcacttaatggtacttgtggaaatacattatttaatgtctgatgactaaatgttctcagttctgatggagtcaagtgtttttggctgggggtggtaatatttgggaagcatcttggaaagcatttgttatttcaaactcttcaaatctgcaagtcttacaaaacactacacgttggctaagacgcgggggcagcgggcgctctaccgtgctgctgatggaagagtatattgatgcacctgctttggcgctcactttagtaacatcatgggacattcaagatgcatgtagttttgagatatttcatccctaaatgcacacatgaaggagacacatagaagattcattgtggcatccaagcaaaacattaggaagacaacaatcaaccagacattaattgtccaccaatagggaaatagaagataaattgtagcaaaagtcatgtctggtgtgtcatgttaaaataaataaattagatctctgtgtgccagtgtggataaatctgaaaaccataatgttgaacaacaacaaaaagtaatttgcagcaggagacatacagtatgacatcatttatgtacagtttttggacacagtaaaatgttttcaaaaatatataaatgtattcaaaaatagatattccaaaatatacatttatatgtatttatatatgaatgtgcccaaaaatatatattctcttggggtctatgcatatatggtaaaacgagatagagctatgtgggaatgatacacagtaagttcagcagtatgcccaccactgttagggagtaggggagcggttgtaatctgcgagagtgactgacaaggattccattatatttgttatattttatgttgcaagctgcggggtggacatacggcatttgctccagcatcttccgtattttttatatgtctcatgtattgcataagaaaaaagagtgcatctgaacagctacagttaccgctgtgtctgtgtgtatttgcatgctgagttttttgagcaccacactctaaccatagtctttgcaaaagggttttatacaaaaacaaggtccctttcgagtgcattgtcttggtaagattgttaagggcagatgagtaaagagatgcagtaccctcaatctacaagacaaaagatggaccagtcaagcagttccctaatgtctttgatcaatgtaaactgctaattgcaaggcctgactctcttttccaaaaggaatgattcccctcccaaccccctccccccccgactcaattacaagaataattgcttcaactctcaatgttcctttaactgggcacgttcagtgttagcatcttaggctctcatttcatatgaaagtactaagttgttccagtaaacagcctctacattgggtctttatgttgcaatattacagacttggcatgcaacctcctctatttttcactgtgtataatgaggtcaaattcgttttggaaggcccggaagtcttcaggatttacagctatttgaaaaccctattgataataagtatttggccaaagtgtttccacgttcatacactccccctctttcctagccagcgtcccttggtttttttttttttttttttttggttttttttttggtctagcttgcactttctccctgcccagaaatgtcgttaacattaacaagagctctctctggcactggcagggggtctgcaaacagaactggtttggaatatgcaatgggaggcttgaatcaaagaaaagctgtgatacagactgtggagtgtgtaagacaaactcgataagctccagtcaatactgtcaggaaaaatcacagcaaaactgatttcgatgagaagatgtcattgggctgtgagggatacttggaaaggatgcttcagcaacaataacaacaaaagagtttttcatttagattgtgaagggcttgctgtgtgtgtcatgtttagggacataaataagtactgacccttactctagagagttattgcacataagaaacccagagtcctaggccacctccagagattttaattctgtaggtctggagtggagactgtttgccttgtgaacaagctcacaggcgatgctgatcgtgcaggttcctggaagcacattttgaacaccaaggccccagagcaggttcaatgaaatggaggaagagagtcaaataaaaatcctttcattcggtgctatggggatgcaatggcagagttattagcaatattacagttacctaggaaaaggagcaaacagctctgccttgcccaggcaaccagcagaatggaggtgatacttaaccagcatcttgaagagtgaagagatttccaggaagaaaagagagttcatgttacaggcagaggaagtgacatgaatgaagtacaggacacaaatggaaaatgaaagtggttttgtatgaacagagctggaggtagaattggaatcatcacagatgctgtttaagaattgtctgtggctcacacctgtaatcccggcgctttgtaaggccgaggctggtggatcacctgaggtcaggagttgaagatcagcctggccaaaatggtgaaacctcgtctctactaaaaatacaaaaattagccagtcatggtggccggcacctgtaatcccagctactcaggaggttgaggcaggagaatcacttgaacccaggaggcagaggttgcagtgagctgagatcacggcactgcactccagcctgggcgacagagggagactctgtctaaaaaaaaaaaaaggaagacaggccgcagctgatttttgaaggaatttgcagagtccttctaaggtgtttggtacattattctatgatgtatggtggagaacagtggaaggatttttacagattattggtgggagagtggatgaagagaaattaataagcaggggatcaaaagtctaggtgaaaaaacaggagggcttgcctgaattactttttggaatagagaaggacatggcacaaaacattccaacctaaaggcaagaccctcaaggttggagacgaagtatcttctggatgcagactgggaaaagtgattagcagcaaatggtcaagatgaatgggtagagacaaaacgtggctcaccaggagggtggtgactcactaatcttcaagaatgtatggctaaagattcaaagctccttactaaaatttagaaaaggcccataatggaaggaactaagcaagttttgccttctgctacctctgaattcattatgttgcctgtacaagtagaacacatagcaggaactgtgttttaatactaattacaattattttctggttacatagataaatgtaaataacattaaagatgtgatctgttcctggacgccatttttatcttctttgtcagaaggagggagagagaatggcatcaaaataccaaggttctgtttttttttttccttaaaaaaaaaaaaagaaaaaaagaaatgaccggaagcacaaattggatgcctgcgctttttttttttttttttttttttttttaccaaaaccaaatacaaccttacagaggtaataaaccttgtgatacagtctcaggaggatgtgctatgaaaggagccaaatcaggtaaccagaaacaaataccaagttctttactggtattttgaatgtttattaaacagttaccaatccattgccatttgtttccttcacactttgtgctccctccttcttccttctcttgcaaaatcctcacaacttcttctgtctttatgttcctttttttttttttttgttgagattatgccttgcaaaacctctaattaacctgcctagcaaaagctgaaccttcttcagactacagggagagtagcagaaaaaataaaagtgacaaagaagaaagcgaaggagtctctttagcaggaagaaggaggggtcatttcagggaaattattttaataattcttgtcccattacataaataattcacttttttcttctatgtcactgtattcctagggttcttctcaaagcataactcttccacatttagacacgttcaaaaataagaaattagagaacacacttcattctttccttatcctatccagttatttcaagacaaacatttgaaaaacaataataatttcagactgcaataaaggaaggctatttgttttacttttgcaggcacagaaattttgtgaaatcaccaacaattcagaaaagaaatgacatcatcatgcccgaaaaagtataaatgacataatctcaaattaacacataaaaacgttaattaaaaatttagttttaaacccccctattctctccttcctcttttttttttttttttaatcatggcctaatacatcaaaacaggctggatgtgtcaacggcaggatatttgagaatcaaggatctgattcaaatgttttatttgttcttgatggaaaattccaaactggcttttaaagcctttcaataatgcatggaatcctgaagaaaaagttgcttcctagaagatgttgctctgttcaacctgtatttttaagtgtctttttcctctaatgtgggtttaaaaacaataaggagagacatatgctacttgggtattttgttgaggccatttccctttttttatctgaggtcatgtgaatggatactcatcaaaacaagaggggcgtttttggtttctctttttgctgataaatcgaaaacacaaaggtcaaaaataagccctgttcctcaatcccagtgccaatgttggagtgggtttttctttttcttttttttttttttttttttttttgagatcgaattttgctcttgtcacccaggctggagtgcagtggcgcgatcttggctcactgcaacctccgcctcctgggttcaagcaattctccacccttagcctcccaagtagctgggattacaggtgcccaccaccactcctgggtaatttttgtacttttagtagagatggggttttgccatgttggccaggctggtctcgaactcctgacctcaggtgatccacccgccttggcctcccacagtactgggattacagacgtgagccaccgtgcccgacctggagtgggttttttaagtacttataataattacttgaataatatgtgttcattgtagataacatgaaaaatgcagaaaaacacaaagaagaaaaatcatttctaattttaccagtgtttatcattagtgtgtgccatggggatatttcctttctagccccacacacccaggcaccttcttgttttttaacatttatttaacacatggttaatgacttgctactatgctgcaggaattgtatcaggtggtagaaatacaatttgtattaattgtagataatattttgtgatacattattttttaatttaataagatactatggactgagatgtattcttcatgacgtgtgatgacaacgtagtaatccctaattcctttagttaataagttcattttaccttctcattttgcctctcatttgctattttatcacctttcacaaataggtttatttgttgttattttttcctgctttatttgtaagcagtattagataacagttgcacacggagaattttcaggtacaattaacttctctcttttttgcgtgtaggcttatttcttcctgacaagtcttttgccttctaagtaacttagtgttgaaacattacatgaaaaagccacctcatttggttcttgcacagtaatgtctaaatcacataagaaatgcattgaaaaaaacaatcggggaaaaaagagggagtaatattggctagcacatctttgaatgcatctggaaagaaaagagtaaatcaggattgaaatagaagccaaaagatgatatttttatggaaaataattcccctctccttttctttccccagctctttttctatctaatatgcatttttctttatattataaaacagctttgctcaccttatctctggtagttctttattacttcagtgtcttctcatcattttttaaggttctggaaatgtaaactactttcctaccacttttcatttttgtggatagggtggctgatgggctttaagtttcaagctatgatgaaacaaggaaatagatcacttcttacagtgtaataatggaactctgttgatgggtctaataaagaagaaaaaaaatcaaaccttatccatcatctccatgacttctagtgtctttcccatctgcatcttcatgttaagcaaaaaatatataatgcaaaaagtgtgtttcacaaaggactttttttaaaaaaaaaaataaggttagggctttctttccttctattttttttttttttttttgagttggagtctcgctctgtcccccaggctggagtgcagtggtgcgatctcggctcactgcaagctccgcctccccggttcacgccattctcctgcctcagccttccgagtagctgggactacaggcgcctgccaccacgcctggctgatttttttgtatttttagtagagaaggggtttcaccgtgttagccaggatggtctcgatctcctgacctcgtgatctgcctgccttggcctcccaaactgctgggattacaggcaggagccaccgcgcccagctaaaggttagggttttctaaggttgtaacttttgcatgtgtattacttgccacacaaagcatcaagataaggaaaccagcccttatgggtccttagcttcatgacaatatctaaaggtcatactgttttaagcatacagaaaaccctctagtcagagtctgtgttagctgttctttaaaaaaaaaaaaaaaaacttccatgtcttgctattattatgagtttgtatttaaaaatttcattctaaccagcaagaacacttccagtgggaatttctgataaagcagtcaggttttagcttggagatgtactaagtgcagaagttttgtgagttttcttcttggtcttgcaaagaaaagcatgaagctatataagtctttctgtaggggaaaaaaaaatactttttttcttccttttttttcctttctgatgagcatggatggaggagagatccatccatattctggatcattattggctctgatgatggttttgtacaaggaataacctctcttggggtagtgattctttttaatgacctttataaaccagaatttttgttcatctgagaaactaatgaggattaagggaagaaagggggccgggtgtgggggctcactcatgtaattccagcactttggggggccgagacaggcggatcacttgaggtcaggagttcgagatcagcctggccaacatggcaaaacctcatctctactaaaaatacaaaaattagccaggcgtggtggtaccggcctgtaatcccagctacttgggaggctcaggcagcaggatcgcttgaacccgggaggcagaggttgcagtgagtgccgagattgcctgggtgacagagcacaagactctgtctcagaaggacaaaaagaaagggatccaacagatatttatcagttaatgtgtgaattacccatggcatcattacctttaggtttgctcagaacaagtcctgtttatcccttgatcctggtgtaattattgacatccccctttctgctgacaggtgtcccagtttcaacgatgtattatatagtcattccatactcttaaacaagagagtaatcaaatatagaagccaagcgtccagaactatggctcagacaaattggcagttgaattttgatttctgtacttgattttttctgagaagctgaaactactatacttcagttaacttatttgcgaaatataggtattatagtaatgtttttgccgtatgggtgttgagaaaattaatatgtgaaattttgatcaaagtacctgataaatagtaaatactcatttgaaattagcaaataattattcctatattttttttcattgaagtctttcagtgctacatgttacagcctccaagtcatttaatttatagaaacagaaatacttcgtggtctgcagcagtggacacaggaagtggcttataagaagatggacacagaaagtggtttgctgaagtaagaggatggtaaaacagagtggattcatctatgataagtgtctataaagggattatggatctagagaaatttctgtaagttttcttttgggttagtgttcaaattggtaaagttgccagggcgaggtaggaaagtcacattcaagccagtgtttcatatttattggtttatgatttttttttgagacagtctcactctgtcacccaggctggagtgcggtagtatgataacggctcactgcaacctctgcttcctgggttcaagcaattctcctgctttagcgtcctgagtagctgggattataggcacacaccaccacgcccagctaatttttgtatttttcctagagatagggtttcaccatgttggccaggctggtcagaacttctgatctcaggtgacccacttgctttggcctctgaaagtgctgagattataggcatgagccattgcacccggccagtatttcttaaagataggtaataaggttgcatctttttgctcctcgaaagatgggctttgccatatgacttactttgactaatgaaatatgcagggaggtgatgtgactttctcataggtggatgcttgaagtgacattttgtgagttaccacattttctagcccttgccttagagattttggatacatgaggtgagagaaaccgtctgtcagctcatgtccctgagtgactacaaaaaacaaaagttccagccaacctgtattgagcacatggtacgaatgagaaataaacttccattgctataagccactaacttcaggggctgtttattacagcagcattgtgttgcccatactggcttatgcatcttgcctcttgcttacctgtcatatcttctgctgctttgcacgctcatctcttccttcccccacttgccattatcagcaacacttgctgaccacctatatgtgcaaagtgcttggtgtcaatatgtttctcataagaaccttatcaagtaaatacttattatatcttgccactgccagatgaagaaatgggctcagagggtcactgttcacaaatcccatagttgtaggtagagaaagagtcaaacatgggtctttcaagctccaaattctgttattaaccactgtggtatctgtcttgtattaggaaggagttcccttactgtcttttgaggttttttttttttaatgtaaatgccctgagtttttcaacacatataaaagggttttatgaatcctttttgttcataaaaggagattaacattaatttctgtgcagagtaggatgaaatagagaaagaaagaacaggaaaaatataattggaatctgttttcaactctgacgtgttagaactaggatttttacccttctcaaaacaaattctaggacacacattcatgcagttggcaaagccatgtgactctagagaaccgtgttgactgattggaaatgggtaaaattctaaacagcatcagcttgatgtggaatttccaattacttaattctggttggttttgaagacacatgagctgactgcttcacgggaatcaggaatgaaggggaatctgttcagaacgtatatgtctccccgcagtaaaagcaattcaaagccataaattacttatatcatctcagcgtcttggggactgcttactaatcttaggacctataaaataagggatcaaaggtaacattttctacgttgatgctgtgagatctatgcatatctatctctcagctggccctacgagtttaaaaattgttaaactgacaatttactaatccttctttttggatgatgataataatgatgattttttgcataaggctcttggaccacctagttttcacaggatggtgatgaatgagtttagggtttggcccgaaaaccttatttcatctagaattttgcaggcagagccaagagagttagcagcctggggtggggcaatggagagagcattccctttggtcgcttgaaaaaatccgtgcctttttgtttgtcagcactactgaaattcagcactgctaggaaacagaaatctgatattccaagatgctcctattggattttcacatatctcatttgcatttggattgtttcagcaagtcttacctcacttctgatacctataaatatctaaggttttagttgacacacgtctggctagcttcacaacaaggatttaagagcttcatgatattatttgccatgaataattgctagtggaacatactggatcaccttgtataacttttgcaggctggttttaatttcaggtttgactgttacattgtagctttgcaaagcaataacaaatcataatgtagatgagcagaaacaaaacaaacgatgatgggaatattaccataaccataattttacagcacagtttaattatttggttcagtaatgttgaataattatttcaccaccaaaactcctccccaccccagcccctcaacaaactaaacaactgtttcactactagcaactaatttatgaggcaatttcagattcttatgacttcttgtcgctctgagatttacagtcactaataaaaggccctaactttgagagacttgaattaaaactcatttataaagagaataaaaaatcagactttttccatttctatccgtaagtgtccatattcctgtagacctggatgtaagtggatgaagcccactatccagtgaataacagatgctcattaaatattggaaagcaaatgaagtcataaatgcgtataaagtaggcagagtcttaggaatggacaagatgacttatctttcttcttacattctttaggatggaatttgatgaaggttcctttcttttgtttttgaataaaccaactgaagtttaattccatgtttcagaaaatcacccctgctttttttggagatggagtgttgctctgtcccccaggctggagtgcattggcatgatctcggctcactctaacctccccctcctgggttaaagtgattttcctgcatcaacttcctgagtagctgggattacaggcatgtgccatcacgcctggctaatttttgtatttttagtagacatagggtttcagtatgttggccaggctggtctcaaactcctgaggtcaaatgatctgctcacctcagcctcccaaattgctgggattacaggtgtgagccaccgtgcccggcctcaaaatcactcttgactctttcctctcccttatccctcatgcccagagatcaactccagtggtttatcccctcttaattactgactgaaactttttgcttctctccattctccttctattctcctggccaaagccactcttccctcctgcctggagtgctgtcaacacttctaaactggcctttcttcctccactcttgtccccattaatctattctccatataccagaaagagtgattttctgttacatgatcgccatcattcttgctgaaatttctactctaccttccgctgattttaggatcaagtctggaaatgttgtcagtggccctcaaagtgcagttgctgcttagcctatcgtgtcctaaatccgcatctgatggcactttgtcacaatccaggctctttgagagagggagagagtctgtgtgtgtgtgtgtgtgtgtgtgtgtgtgtgtgtgtgtgtgtgtgtgtgtttccctcggtagagtatggggatctctgaaaccctttgtatactcaatcctattgttcattatgattgtgtgtaggtatcgtttctggaaagcctctcagttacatacccttctttgtcttttcacagcataattgtaatggtacctgttatgttttaatatgatacgctttcttttccaccaaatggaaaactgtgagagcagtactacgtctgtcttagtcaccaacttgtgctcagcacctagcatggagaccagcacatagtagagatttaataattgttgtgtaaatgaataaaacacatctatccagttggataacttggggtagtttgcttctctgcagtctgtctccctctcttccttcctcccttctctctgtttctctctttttctctttctcgtagtaataatagctttactatgaccatagctctttttttaatcgatcaccttttaacactttaagaactatttctaaaaactcaacttaggaaacagctgaattagccccttgctttaggtttcaggcttccctgaattccctatgattttcttatttgaaagtctggttcctgtttatattggaaacattctttaaaaaaagataagaacgtttggaacggcaacaaaacacccaattaatgtgcaactactttgaatattcctgcagtggcaacggttaaagtagaatgattggacactgtcactgctagcaaaattataatccagggtaagctagatttagagttgtgtctcaaaacctgtgttttttgtccttcaggagttaaaagtgcaaaaaaataaaataactgagataagagttgaattgatgccttcgaacaaaatggttaaattctgtttgggtctttaaaagagttaacagaatataacaattcaaagactccatgttccataaaaattgtgctattaggaagaaagccatacttctcagtaacctccctgacacttgctctgttttacttccccggccgcagctggtcttgagtataatgccattgattttgagagatcttataaagataattagatatactgcagtgtgttctatattctcagcatttctgaggctatgcaaagccacccaaacttctgaaatatgtaccttgtatttcttacttgagaaacttttagtttctatgcattggaaaaaaaaaaaaaagctctatagcagactttcctcctgaagcgtgaagaaggaataaacgaggagtagagatttttgcctcctttttcatttatgtaaataaacgtatgaaatggatttttaatttatacattagttatcttggtcccaaagcataactcttttaacaccttgagcttccttatgttggagggggaaaaagagtgcaaaatcattagagacatgattatgctttaatttaggtctttgagttatgtaagcagaatgcaattaaagaagaagtgctcactatgactacctatttcaaataggctttcaatttttcagttttatgtgtatcttctgcaattgcataaaacttcctcaaggctatgacagtggattatggctgtgttcttgtaattattttcagcttaaaaaaaagaacaactttgctgcataaactattgagttaaacatattacacgtctagtttttactgggattgtgtaagattttacaccagccatgagattctctgcattcataggtttagaaggaaaatgtgagtatttatggcatcatgattgtcactgtcactatcatcctctcattgtcgtcatcaccatgaaaatcagatccacaagtgttatcttgcttaattattgcagcaactctgtgatctttattattgccattttccagataaggaaaccgagactttgaaacattaagtaacttgcataaagtcagacagctaggaagcatagtatctgaaataggaaaccattgctcactttggcagcacatatactaacattggaatgatacagagaagattagcgtgacccctgcacaacgatgacatgggaatttgtgaagcgtttcatatttttagtaaaagtagaaatacctgttgatccattatctaccaaaaggaaaagaagtcattatatgaaaaagacacttgcacatgcatgtttatagcagcacaattcacaatttcagaaatatggaaccagccgaaatgcccatcagtgaataagtggataaagaaactatggtgtgtgcatacacacacaaacacatgctactcagccataaaaaggaatgaaataggtcaggcaaagtggttcacacttgtaatcccagcacttcgggaggctgaggcaggtggataatctgaggtcaggagttttgagaccagcctggccaacatgatgaaactgcatctccactaaaaatacaaaattagccaggcatattggcaggtgcctgtagtcccagctacttaggaggctgaggcaggagaactgcttgaatccaggagatggaggttgcagttagtggaagatcatgccactgcactccaggctgggcgacagagcaagactccatctaaaaaaaaaaaaaaaaaaaaaaaaaaaaatgaaataatggcattcgcaacaacctggatggagtgagaggccgttattgtaagtgaagtaactcaggaatggaaaccaaacatctcatggcttatctcccacttacaatggttttccattcccgagttccttaacattgtgttaatatactaacatattctcgcttataagtgggagctaagctataaggacacaaaagcataaaaaatgacataatgtactcttgggacttgaggggaagggtgggaggtgggtgagggataaaagactacatactgattgggtgatgggtgcatcaaaatctcagaaatgacacccaatgaacttacccatgtaaggaacattacctgttcccacaaaactattgaaataataataaaagaaaaacattgttgaaaagataaaattagaaaccaagaagcttggcttcataacccatgttactaatcttaaaaatgattccaagttgggcagaaaatggggagaagttgtgagtgggagcaagtgtggtcaagaacagggcgaaaaaaatgtaaggactcaaaatgtaggttgtaatcttatcaattgactgtgttaccctaagttgcttataccatttaatcatataatgcctacagtgcttgtgcacataatcatcttctttgtattattatagtgctacggttgatgatgatgatattatcactattgtaattcaggaaatttcagtatctctgaagactcttcggttgtctaaacaatacaactcgttatggtgggggtgcgttttttagagaaacatttatattttaatctgtcctttatacacagctttgacctctcctgtccaatatgacctacttctctgaagctggtagtggtttttgaggtttcatttgcaatgtgtggcttcttcccaggactcacacaagattcgctgagagtcttcgaattttttgaatcacccttaagtgcagtatacatcaattcagtgctctggcaaagactatgaattatgtttatgtctgaagcaaggccgtggttaaggaaaatagtagatgtgttaagaccttgtttatttcagcagagaaggttagagttgatccacatctggataaaaataattttaacctaggagaagttatattttctttataccataagctccccttctctggtagcctaaatgaatcagcgccacatctgggcatggtggcccatgcctgtaacagcagcactttgggaggccatgacagcaggattatttgaggccaggagttcaagaccagtctggggaacatggtgaaacctcatctctacaaaaaaattagccagtcatggtggtccatgcgtggaatccaggctacttgaagggctgaggtgggaggatcacttgagccggggaggtggaggttgcagtgagctgcaattatgtcactgcacttcagcctgggcaacacagtggaacttgtctcaaaaaataataattccatttaaaaaaaataagcaggcatagtaacacacgtctatagtcctagcatctcggggggctgaggtaggagggtcacttgatccagaaggaaccccggagattgaggctgcagtgagccatgattgcaccattgcactccagcctgggcaacagagggtgaaggaccctctcaaaaaaaacaaagcaaagcaaaacaaaaagcatcagcaacacaatccatcttagattcctgacatccagtctttctattcttgggaattgtcctagaatcacccagttgcttcctggtcagcatattcaatggacaatgaatgacttgttgactattccaccatcaaagaaaaataatattaataccatccaacccctgaaatgagcctatgttctatgaagtaaattagctgaaacaaagtcactcttaaaaatgaagtgatatcaaaaatcaccaccttggtttttgtcactattttatcttcatcacatagcgctgtacctagcacacagtaggcatttaatatttgtttgcaaaaaattaagtcacttctataaaaattaatagtgtgagaaaccttggactttatgatgcaccatactagagtaaaagacttgtatctattttttttttctaagagtacatttctcacctagggttctatttcttaatcttggctggaaccaaagaagttgttatctgccgtctgatcaagagagaacccatagtccctgcattgtaatttgtgtgctttttcttatttatatttgcattacaagaaaacatgaaataactgtatctgctaaaactgaccgaaagatggatttcagatgtgagcaatggaagtgggattggcattcatcatagtgtaaatgcaaaagtgcttttagcccaccaagtactgggtacactattctgaccttttttcaagtttctcagtatttatggaagaataatttgtagaataatgaatatagttttccagtggagcaacaaatgcatactatatttctgctattgtttcttattaaatattcatatgtatattttgtgtttgcttcataactggccatttactggtgcttaacaagcataggcagtcccgctgaagagaaataacaccaaacaacagtaaacaaaaaagcagacgaatgaaaaaagatatcttatttctgcagccgttacatttaaaaagtgcatttaacatttttaatacagtccatatttcataaatcccacatgttgacatgtcctagagaaagatggatgggttgacttggaggtatgcttctatctagttttatgtgtgcatctggcagagctaatctttacttccctttagcagaacacaaaaatgtaattctctaataactgacataactgcatcattttccaatatggactgcattattaaatcacagagacaagcaaaaccagagtagtggggaagcttgacttctgcttgatatcagaccataaaatgcctacttactgtggccgaaaggaaaaagagcatcgactctcagtgcttggaattcggaacaacttctgaattcacagccccagagtcttgtgtgtgtgcaacaataaccgtgtctttgcatttgcatattgctttagagttcacaaagcatttttacggacaagcccatactgagaatcagagcaaggattgctattctctgtgtatagtgagaaaatagaggctcaaagaagtttccaatatagtaagaattatttctgtaggacttttaaattgtataaattgctttaacgcatgcagttacattttgcttgtgtaactaggagaataagtcatctaacagtcttcttcctatccccaaaatacccattcaaagagaatagggaaaggattgcttccagactaagaacttaggatcttgcgaatggtagttgcaaaacatacacagagtcttggattagcaaaaagtaggggataagggtttcagagagccgagtcattgtgcttaagcatataggaggaatttaaggatgttgttgcctctaagagggatggagctgaaagacacacaagggtaggacagatagaagagagaatggctgagatatatggtggcgtgtatgcaaggacttctaagagaagtgatagctaatgtttgtgttgctacaatgtaaatacttccacttccccaagcaatatattgtatggtcaccatgcaggctcatcaacaaagattccgtttcttccctgctgagcactgcttgaagttcttgtgatttgagtgaggccatgagagcagttctggctaatgaactataaatgaaagtgacaggtgctggaacattttattgctgatgcaagagtttctagaaatttcttatctctctgatatggtggctagaaatatttcagatgatggattttccttcatccaagattgctgagagtctttgagaagcaacaccaccctgtctcttaccaccaaatccatgatggacatgtgatatgagcaagaaataaacttttgttattcctggaccttttagattttggagtcatttgttgccacagcatcacatggcgcatcctgactgacacatgcagtgtcctcatgtgaacattttgtttgtgtgttgtcaaggaaagtcactgtggttcgtgttagcgtcagtttaattcaaaggtaactcaacagcaagaaacagaaagtaacagaaattcagcaagggcaagaaatggaaacctgatatatcccatgagagtttaaggaccctgacaatctgcagaaattttaaaaagtgctttgggcttttcacaaagtatagaaaggggttttggaaaaacctatttgaagttttaaggatcagagagaaattaacagctaatctttgatagttctcccagtaccatcttcaagttaaagaaaagggtaggattttttttcccctatgttaggggaggaaattaaaactgagataaataaaatgacttgtataaggtcatgcaaatgctaataagcaaagcccagattactaaaccatttgaccacacgtgtagtagtgtttcagcccactcttttaagaagttttcagaaagccaatgagctaatagcttgaatatattacagtttgaccttcatttcagcaggacagacaaatcattgacaaaacggctgcaagaatatcagcccttttaataagttgtccagtaatatgatatttttatgattattcaatgaattgatttttatggaattggctttcagtgaatttatttatcagccagttttctgaagggcagcccaacactatatgccataaattttctttgctataattaacttcagacactctgtctcctatctttcctaatttcatctctctctctgccctgtttatatttattggatgctctggtatgtaattattagaattttccctttactttaaaaactgttctttcatctttgtgtgtatcattgattgatgaccccatcatgaccttaattgcaatttacaaacttacttgctacaaagttaggttaatgagattattcactatacaggtagattcaacataagtttccattatcatttttaaagccagtatcatccactaaacatcaatatgtcatgcgatgttttaggagcttcaagtaaggtccagttgtgttatttcagttaactatgttgtacgtctctgtttaattgtaatattcttttctgtggaagtaaattctacctctggatcctacttaacagtgttcctggctgttactaacccttcctctgatttgacattggaatggaagcatttttgatgttctatttatgatgttaaatttacaaagaggtttgagacattttgaattatctcataaatgtgcaatcttgcctcacagttaaatctgatcatttcttttaaaatattatttaaattttcattgcatcatttcttctatctgttcagtggcatttctacttctttatttgttaatcttctgaaatagtcttaatctttcatacttgaagcgcctctgtttcctccatccatgcaagtaaattttcctccagattcaactcctttctccttagggatgttcctgagagtcccctgacctttcgagttacttcttgtcagtggctggtgttagatgcacagttctctaatcatgggatattccacctcaatctgtgtactcctttaaggtataaaagagcaaaattttccaccggggggtagcaacatgacaagaagggaaagagcagagttaaccttggggaaaaaaatgagacataaggttggctgggtagacgaggcagccagagagacagcctctgttgttcctgaccactgccttggtttttagtattatactttccacttcagtcactgcaacccaccgccctgttgcaggaatgaacatgtgacccaggtgcagccaatcagggtttgctcttcccctgtgttggtcattggtccaaggtggacaaatgatgcaaaagctgggccaggtagagagatttcctggaaccttgctagtcaggttagacagcttcagacacgtgaactcggagaaggccagaatctgtttttctttctggactgtctgaaatgtgaactggaagaggcagggtggggaaaaaatcaacccaaataaaattagcagtaaagaaatctagataaaaagagcactgagctgtatgatgttccagagtcagtttgacttcttggacgatgattattttatgattgtatttgattgcgttgtattaaaattattgttatatttttattacagtatttcttatattattgaaagaataaatcaatatataaatgtgttggaattgctggacagcaaactatatacattttatgtggttgacagaaataagctacttgaagctgttgagcttgagcagagtgacaaaaagatgtaaatgctacattaggagattcaatctaataacagtttttcaagatgaatacacagtgagagcctaggcagggctgaaaaatacgtggcccataccctccaccttcccctcctatgcctgtggcagacattgctaatcaatcatggcacttttacccactgagtctgagctggtcttaccatgcttctcagtgaagcgctccaggcagtgactatagatgatcagagctggcacacaaaatgaaacccatttgctctcccaagctcacaggcaaggagaatagccaggagtctgagcatgaattagatataaggttcccaagattggacctaggtggggagagagcaaaggaaggggtaaaacctatcgttgacaatattagtttgcttggactgccataacacagtgccacaggttgggtggctaaaacaacaaacagttactctcacagttctgcagactagaagtccagaatgaaggtgttggcaagattggttccttctgagggctgtgagcaaagggtctgctgcaggcctatccgtggcttgtagagggtcagctacatagagagcctgtgtatctttacatcatcttccgtctatgcatgtctgtgtccaaacatgcatactcctcttcctgtaaacactccagtcatactggcttacagcccactctgaggacctgactttaacttgattccctctgcaaatattccatcttcaaataaagtcacattcttagatgttggcagttaagacttcaacgtcttaacgttgaatttgcggggacaatttaacacatcacactgggtgcctaccatgagccaggcatgagcttatataccattatccactggagcctcaatgcaacctacatactgggtacttttattctccctattttacagagcaggaaactgaggctgaaaaatcttaagaactgtagtaaaagtttcacagctggagttgctgtatagcaggatttagatgtaggctcctgctggctaattgacatagtgtaaaaagaagggaacttggttatgggttagacataaaggagaaatttttttaaaaaaactaaaatcaccaaagactctagacttcatttctggaaaaatggtgatgtcagtcttcctgcttaatatttcagtggccccctattccctgcaggttaagatgtaaattatttagcaggaaagtcaaggctgctgatggtcttagatgcctcattaattctgtctctagcttctctcttcctggcccctttggtccagcaacactgggcaatttatttgcagtctccaccttagagagatggagagggagaaggcttggagagaacagaggatgatggggaggaacaacctgtgcactgggtctcatccttgttgtttgcaattctggctacttttagcagtgagcagtataattacagtttagtcacctaacctctctgattctctctcttcccagcctggccaacatgatgaaaccccatcttcactaaaaatacaaaattatctgggcatggtggtacgtgcttgtaatcccagctactccggagggtgaggcaggagaatcacctgaacttaggaggcagggaggttgcagtgagctgagatcgcaccactgcactgcagcctcggtggcagagttaaactctgaaaataaataaatataaataaataaataagatcatgtttgcagagtcctcagtgcagtgtctagcacttggcaggtacccattggctgtatggataacaaccattcagtttgggatatttggagtctgacataaccaacggcaaccaaagagacgagttccttaccaagccagaaacgcaagaccaggatgcaagtggcattcctggggggtatcaattctctgtttctttgccccttttcagaggctttatgttcacccccaggagtgaacaaccatcttcctgctctgttcctattttccattatacttaccaggagttatgaattgaatcaggatgtcttaggcggcttcccctcctgctttagcaatcaataaattgccatttctaaaggtgagattgtgaattgttaagtccaatctgcagatattctagataacccatatgtctcctgacattgctgtattcatagatggcttctcaaaccattattaatgatgtaattagtatgaatggctacagtatatatcaagcagatcattaaggcagaggtggggaggtagccatttatattaaagatacgtttaatgttctgaacctaagcaatagaaagaaagtacttagcttagaaatctcgctttgctacactatgggttttcttttttaaagttgtcctagaccttctttttgcttgcttaatgctactttttgttggagcccctgggaatttgaatgagttaataaggcagatctgtttgtaaaagagtataatcaagtaaatcacagcctttaaaatcacagatttcaaaatccaatcaacttaattaatgtgttggttcatagacattgtacaagattttatttgattgcactagccgctttctcttagacacccatctgcaagaatatttacttataacttgttgtgtaaagggatcttcctaaacggcacactgccatatgtaactgctcagcttacctttaagagaaaatattgaagtaacaccctcaagctgttctactctgtgttcagaacttttcaaagctagatttctatctttgtagtaagtattgaaaccttgcctcccacatccaggctgttcaaatatgagataaaatagtttctaagaatgatagagtccaaaagttttctacagttcttatagatgttgtgagctgaaaatacatgggttagtgaagaggtttttttttttcttttctctattattatctcttttttccccctaggaattaatgtcctttgtagtagccaaaatgttaaatgtttttaataaaagctgagacttaagttagaggggaacatctttaccccaggtacaaatgacgttgctacttgccacggtccaaagcgcagaggagatggggagattgtgaaaactggggagtcacacacaaggagggggtgttttttgttcttctgacaaactgatcctgttaagcatccactgcagagcggtggctgctgtgttatgcaagcacctgcgatgcgctgcagaagaagagaggcatctgatgctcgaccgagcagagctactgcagacagaagctgcttccgaggccccttctgctcacagggcatgcttcctggctcatgtgcagtcagccatgctgcagaggccagggacccagggagcgtggcaataagtatgtgtccagctttccaaactctgggtactgtgaagcaactgcagctctgagccttgcttaaccagggctggggacctggcagcttcttccaaagtcacttgacaacagttgctctgccctcagtcaatgcaagcaaccacttgtctacaaaaggagtgaggacagtaaagtctctgccttcaaggatcgtactgtattcttattattagtggctacaaactgttaagtacctaccatttgcaaggaactgtgttgatgacatgttacatgtacatcatctgttacattatcataagacctcaaatatgttttattacccccattttgaagagattaaaaaacaaaaaaaactaaattggccaggtgtggtggctcacacctgtaatcccagcactaggggaggctgaggtggtggatcacttgaggccaggggttccagaccagcttgggcaacatgacgaaaccccatctgtactaaaaatacaaaaattagctaggtgtgatggcacatacctgcagtcccagctacttgggaggctgaggcaggagaatctcttgaactcaggaggtggaggtggcagtcagcccagagtgctccactgcactccagcctgcatggcagagcaaggctctctttcaaacaaacaaacaaaacaaaaaaaccctgcaaatattaagtgttaaatcgtaaaactgagaccgcaacccagatctatcttattctaaagctttggttgttttcatttcaataattactgtcatgttttagaaaagcagcaaaacgtttatttaatatgaaatctcctgcagaaactgatacagagacagatcaaaccaggactgctctgactgaaacggaaggaggaaagtctcaagctctgactggaccgcctcctccttccctaattcccaggtagtaattcccaatgactgagccatcacttcagaaaactagaactgtggtttttcagatgtggtctccagtccagcagcgtcagcatcacctggaaacttgctacagacgcgtgttctctatcctcgctgcaggcaaactgagtcagaagctctagggtttgggtgtctctgatttaaacaagccttcggggggttgccgaagcatgctcatgagtcaaaaccaagaatttacaaaacccattttaataacagctgagttctatagtacctttcagtattcgtaacagtgattcctggagactttcttgacaaagtccaggatggtgcattaaatctacttctgcattttatttttttattttttttattttttttgaaatggagtcttgctctgtcatccaggctggagtgtaatggcacagtctcggctcactgccacctctgcctcctgagttcaagtgattatcctgccttagcctccctagtagctgggattacaggcccctgccaccacactcagctaatttttctatctttagtagagactgggtttcaccaggttggacaggctggtctcgaactcatgcctcaggtgattcacctgccttggcctcccaaaatgctgggattacgggcatgaatcactgcacccggccttagtcatgcaatttttattttagagaaattctagaaatggatactgtttactcaatgcagcattggagaatgaacgttgactttattaacccaataataaaataaaatgatttctcttgatttgtttgctgtcaagaatcacaaaccacatggacttgagaaaagtgaaagttattaacgagatttcatgcatcaaggatactgttgactgtccagtgaaagtattttttttttcttttttttttttttgagacggagtctcgctctgtcaccaggctggagtgcagtgacgtgatctcggctcactgcatcctccgcccccagggttcaagtgactctcctgcctcagcctcctgagtagctgggattacaggcgtgtgctaccacgcttagctaatttttgtatttttagtagagacgaggtctcaccatgttggccaggatagtctcgatctcttgacctcacgtgatctgcccacctcgacctcccaaagtgctgggattactggcgtgagtcactgcgcccggcccagtgaagcaccttacgtgtgtgtcaccattgagaagaaaggttaccaaataaattttgtcccgctattgattgcaaaggcattccaatttccaagatatgaaaatgtaggcccagcgcggtggctcacacctgtaatcccagcactttgagaggccaaggcaggtagatcacctgagttcaggagtttgagactagcctggtctacatggtgaaaccatgtctctactaaaaatagaaaaaaattagctgggcgtggtggtgctcacctgtaatcctagctgctcaggaggctgaggcacaagaatcgcttgaacccagcaggcagaggttgcactaaactgagatcgcaccaccgcactccagcgtgggcaagcaagtgagactctatctgaaaaaaacaaaaacaaaacaaaacaaaacaaaaaaaaaaccagaaaaaaaaagaatgaaaatgtgaagaaacgtttgctttagaatcagtgaaatatggcaaaaataaaagagatgcttccgaaattttgttgcattaggtcacttagccaatgaggtcaggtgtctgtggaagcaaaaccgtgtctttgtaatcaatttaaaataacacaaaatgaaaaaaaatgctcttgttcatgataattttttccactttctggtttgattatcttccatatactggtgagtctccatacttggttgtattgtccaagttggattttccctgcagcttcaaaatcatcatgtccctcaccaaactcatgaagttcctttacattgttattgttgactctgctgttcttcttgttattgttggtatactctttagcacttcttcctcctctatctctaattctagtacttggaaggagactatagagtagtgattacctgtattttgagaactgtgttatctgcgaagatgtttcaaagtgtggtggggttataaagggctttgatggtgggacaggatggcattgagtaaagtaagttgagaagttgacagttctccctggccttatgggttcattgtgatttcaagaagccgaaaggatatggttgtatcatctgtgggctccatgaaaactaatgatcattttctaaacttcgcatcatgttttctggctttttctatccctggaatcattaatcatgtatattaggtgatttccctatatctgtttatagacacaaaaacacatatacttttttttttcctttcgaattctgccatatcaccatagaggtcttcaggaagttagtaaccctagttttagaagggtttggttgtttttgctgtctttccatagtcatttttttttttttgaggcagagtctcactctgtcacccaggttggagtgccctggtgcaatcttggcttactgcaacctctgcctcccaggttcaagtgattctccagcctcagcctcctgagtagctgggtttacaggcactcgtcaccacacctggctaatttttatatttttagtagaggtggggtttgccatgttggccaggctggtctcgaactccagacttcaagtgatccacccgtcatggcctcccaaagtgctgggattataggtgtgagccaccacgcctgtcccatcctcatcatttttattactgcatcttattctgtttggggtttttgtttgggtgattgatttgaggtgtttgcttgtgtgtctgatttggggaagacgttcccaggtaattagtgtaaaatttttaataagcctcataagctttacaattatttccctggaggacaggttttatttaggatttaagaacagtaggcagtagttgtgacattttgaacattttatttctttacccaaaaaataactaacttttgtaaaaccaatgaaaagaaatgaaaagaaaatgaaggaccacaatgctttatgggtttgtgtttctgacagcttaagtcctgctcttgaaagtagttacacagttggcaatatacaatgaatcactgaagctgtttgaaaactttttcgtttttttgtgaaaatccaaacttggaggagaaagagcttactgatgtcaacacttagaaagcagtgttctctttatatagtcacttactgtcttgggtttcattttcggttcagggggaaattaaattcccttgcaattgcactctctgtctaccgagaaattttatctccacattgtttttacttgctgtttgtcctctgggtaaaatattgtgtccgtagggttagaagtgcattttagaggtcttttggttcatcaggctgttccttgcaggtcagtatttatactatttctgacccagatgtctcctgtattctaagatcctagtaaaaaagctgggggaagggagaccattgtaagtacacagcagccttactttgtgagctcatgccttagttaaaagattaaccgaagaattttatttcaccctattgtgttaccaaacattagatcttattgcttctaactatatttttatgtcctttattcatccctctttatcccctcctccccaaaaaagaattattttagcatctgaattcattctcctgccaagcagatagaaacctttaatcacttacttactgtaggtatgggcagacacagcttttctgtttcttaagcctgtccttccacttagattgcaaataagtcttcagggaattgcatgtgttctcaaatttgattgtattttttcccttatagacacgggttggttagagggatatcacagtggacaagaattccaaaaaacctggcttcaaatctccaatctattactgtaacattcagtagatcccattgttactgaaaatactgagttcattgtgagccacccctgtctttgagcctttccatgaaagtgagtcttctcccaccccattcttgcccccgttagccccatggcttgctttgaccagtgaactgtgagcataggtgatggatgtcactttcaagtggaaaatttacgagtatgcatgtgcctcattttgctctcttttccctctgcagtaaggccagtgatatcttacatatgacggctctgtcaacttggatttccagaaaaaggagaacgtggaacagataactttgagaaatgggcttttagcaagtgggaaaataggcatgtattttgagctgtgtgttgggttcttcgtgactgcagtgttactcaccctgtcttgaatgatgatggttagtatttgcaacatatacatgtcgaattcccgactagtttgtggaggaagggaagagtgccaatccatatccgtaagcccatcctcaatccaccagcttccaccatgtagtccagcacctaatggttgtttaataaattcttgaagagctatattgaaattggtttgtgtaatcttggaatagacccttcagtggtaaaaaccagcatttttccaaaggttgggtgagattttaggagttctataagtttcttttaggtggttcacagacacagcaggaaacaagattgaatcatagggtggagaaagttttcctttttgagttttcttttaacacattgtatagcattcaaaacaaaatttctcatagccacgtatttcagtggttacctgtgataactagaattccaggagaccaatgtgtttatatttgtacagttgcttaccatttatggttaataatagtagtgtcccacttatactagaagttgattttatagattttcttttaaagtaaaatgtgtttagcacaaagagtacaataaaggaaaataaataatataggtggtaaggtgaaaatgtgaaagcctaaaggtatggtatatgattgaagttgggagaaacactgctgtaagccttttggtaccctaaaatattgttatgaaaacctaaggagggtgggcatggtagctcatgcctgtaatcctggcactttgggaggccgaggcaggtggattgcttgaggtcaggagttcaagaccagcctggcctacaaggtgaaaccccgtctctactaaaaatacgaaaattagctgggcgtggtggtgggcacctgtagtcccagccacttggaaggctgaggctggaggatcacttaaacccagatggcagagatttcggtgaactgagatagcaccatggcactccagcctgggcaacagagcgagactccatctcaaaacaaacaaacaaaaccaaacccaaagaatgtttgaatgggttgtgaggatggtaaagtgatagatttaaggaatcattgctttggttatcgtttattgtgttggtgtttgtaacagtctttccttcctatctagggatttatctccatcttgtctgtccccagtttcctgggatttccgtatgaatagcatattccaagtggagaagaaggagagtgcctaaattcactgtcaccttctgatttaagcttttttaacctacgtacccactctctgttctgtgtgaaaagtaactggaaccatttgtgtaggtgaaaatagcacttagcagactcagtagaactctaaataaaagggatgaagtcaggggtatgaagtgagcatgaagtgagaaacttgaacagactcttgcttgcttgtgactgtaagtgttccctagaattcgtgtggagtcacctggttctttgtgtctcagacccttcaacactgtgaacgttttgaggacaggagttacgtctgattccccttcatgttccccgtcccttcacaattgtttgttgacaccaggcgttcttccaatatccatccattcattcattagtgactttcagttaaagcctactcatgtcttccattacaggtgccaatgcatccatttttattatcagtagtggctacaataatatttgtagcagctacaaattatagaatatgaatcatgaatcctgctagcactttataagaacaactgcttgaagcaacttagcaaggtggcagtattatctctaaagaggaaaatgaaacttagagtagttaatctacttgcccatcgatataagatacagacactaaatttgggtctacccagttctgaaaacccagaaacccgtttgccttttctacctaatagtaccttgttgatgaagacacatacacacacacactagagagagagagagagagaggagaggagaggggaagatatatcagctacataaacttcccagtcctgccttatttattagtctgtgatggttagttttttccagtgctccaggcatagcattcctcagcaccattgttccaaatcactgaagctggcagcattcctttccttgcttaatctctgcaagtttcaacaaattgttaatgtaatgttttccttgaacatacttaacatttacttttattcatctgaacgtggaacgcagcactccatgaaggtgcaatctgtcttcaatccaatgtctcatcaaattcctgctgcccaaaatagagcaaaggttgagccagcctaatgtagggttggcatatgataccattatagctacttagtggacagcaaggccagcactgcttttaaaacaatccctgctcattcttttcttccctttctttccagcaagtcggttttctgagaaggagctgtggctggttgtattaacatttgcattttgatcctgcttactgatgcactgcaaaaaagaatcttctgtgttgcctacttagaattttctgttgtagtcgtgtgaagttgccaggtggatgacatagatcccatttcttagtttcctttacagcacgttgactcttacccaagtccccaaaccccctggttggtgattgcagaccctctttgcaccccttcccttggcgattttatgcaaagttaatgccctttggccaagcagaacttccccagagctccttcaattcttcacatttttgacagtaacactttgtaacgaatgtattttagacaagactcttcgaccgtaaagtactggatctctctaaaaataactcatttgaaaagggggttattttaaggagactcagaaaatatcttaaaatatccaaagtctgagaccaggcatggtggctcacacctataattccagcactttaggaggccgaagtgggtggatcccttgaggtcagacgtttgagaccagcctggccaacacggtgaaaccctgattctactaaaaatacaaaaattagctgcgcatggtggcacacacctgtaatctctgctactcaggagcctgaggcagaaggatcacttgaacctgggaaatggaagttgcagtaaggcaagattgcaccactgtactccagcctgggcaacagagcagggctgtctcgaaacaaacaaacaaaaaagcctgagagtgaagtacagtgctatttgtaggggtttgttaggaagcagaagtatcagaaatgcatattctcaaagcctccctgtctccctctctctctctctctctctctctctctctctctctctctctctctctctctattctgcttcagggtgttctgtgcccccctcccctgtctgatttctgtctctgctcatttctcaccactcactctcagtctttgctcctcagctattcttgcgtgtgtggcgctggctcctgctctgcttttgccttgatctagttttacttttaattgcaaaaactacaattacttttcattgcaaacactgcagttacctttgcaccaaccgaatacatgatctttctcttcagaacttgtaaaagactgcccacctcacctgaccctcctagattccattcacaggagctcactgtctgcagaatgaattgccattgaaacagctctttcacctcattttgcaggcagtggagtgagtttacaggaaatggacaagctcacagggaagcagagactgtggagggaacacagcttctcccagaagaacaccgtgggaagtttggtttcttgtcttagattactgggagtcgggaaagaaagcccctagagatcaaactcatataggtcatctaaaaatacacgatcaagtcacaaaagcacaagataaaaagaaggctttctttatccctgtaccatgcctttacagaaactacctcattcatcaaaagatctttcttttaaacctgaactctagtagctgtgcgatagagaggtcccttgtcagtatcaacagctggggctctatgctgagctcagaaagtggagttctgaatcaaaccaagtccatgagccccaaagtaaatttagaccacaaagaatctcctctccagtttttatataaggagaaaaggagaacaaaagccctgttcctccaatagagcattggccagagaagcccagaactgtactttatcaatgtggaaactaaaatatcttttcagtgtaatttgtgatgaattttcatttgcatttatcatgaagaccaaaacacatgtatcatctggtgagaagtattctttcaaggtatctaaaacttataatcactaataaaaatatgcttaatacttcagggccaatggaatgaattgtatggggaatagtttaggttgtctgatagggtcagctgtcacacatagagggagcaagctgacctggagaatgaacatagagagaacatgataattaaccaagtgctatgatgtcttctaatatcccaaagacagtgctatgatgtcttctaatatcccaaagacagctctttatatgggttttcttcctttgcataatactggatcaatagatagatactggatcgattgatagatagacgaacagatacaaacatacatagattatggacagagatagaatgatctataattgctacctatctcttgtctgtctgtctgtcctttttattcaaagtaagcttcacttccatcacttctgcattttctgtcacagatggcattggtcattggtcatttcagcacagtttcataatatgtctctatttccaaggggtggtctgttgtgcgtttgaaatcccccagatagctctgtgttctgtgtgactttgacagtcagtctcatggatgggtgaaatgaagttttctcttttgttccattcagcccaagtggcagcacttctctaattctgtgagaatgccttcccgaatttgtgcctttattatcttttggttggactcctgggaatctgtctcatgtttctgttcacacctgctctccatcccaactagaggtactcccaaagtgtacccccaaaacaagaagtatttctgaaaacacttgccccatttggggttctcagtgcaatttcgtgacagttttaaactgacactttctctcactttataacagcaggctagagaaaaataagaaactgatagcctcgacctcactaaaacattcatgaattaaaattttgtaaaaaggttaccaacagattgtatcagtttagttcatttttttctattatcttaaaaagccattttccctgtgtttgtaattgtattttatcattttaggtagtagtccagaataagacatgttgggtttaattctctgccacagttctcaaatggatgtttcataagtagcatgtggctttctcagctaaaattaaatgtctcactgtctccaaatgttttctatctagaatttgcaacatacacccttccagaactaacagagactctgaaaattaccactaaacaacgtcagtctagttcatccttcttaccagcttcaaatgctggctgtagataaatacatctttaataaataatctaatgacttaaagaaataaagtctggtcctcttttccatagaagttcagttcagagaagcaccaaatcaaaaaagatgatctatattaacaaaatcctctagttttgtgatgttctaggaattaaagaacaagtccaaacctcagagaccaaatgtatatcccaaatgtatatccccagtggttcctgattcccagaatcccctggatagctctaaaaaatatataaaactggttccattcatgatgatttactaaatatggaatggaactaagcagataggagaactaactggtttaccctcttcgtctgcctcagccactagttgttagtaatatatgtgtgtgtgtgtgtgtgtgtgtgtgtgtgtatatatatatatatatatatatatatatatatatatatttattcccctattggataacaagctgtcgattcctctcatgacctctacaaggcagctgcacatgattgatgagaggaaggatctatgttcagaaaatttttttaaaggaggaagtggaggagaagaaaaaaatggagagtcatagatccttgacaatgccaatgttttgtggaaaggaggcaaaagtacctgatggaagaaataaaggaagagtaaaggatactcatgtgattgcacaaaagtggactacatctcaacagtgaggaatgagccctaagacaggttgaaatcccagctctgccacttcccgaatgtgagacttgagcaatttgtttaaacctcttgggatcagtgttaccatgtgtaaaatgaagatcatcatagtactcatcctcttatgtcatctttttgtaaaatgtttttttaattatggtgggtacatagtaggtatatatatatatttgtggggtaccaaagatgttttgatacaggcatgctgtgtgaaataatcaaatcatgaagaatgggatatccattgggttgggaggccgaggtgggcagatcatctgagcttaggagtttgggaccaacctggccaacatggtgaaaccccatctctattaaaactacaaatattagctggcattggtggtgggtgtctgtaatcccagctactcaggaggctgaggcaggagaatcacttgaacctggcaggcgaaggttgtagtgagcagagatcatgccactgcactgtgcagtttgagactgtctcaaaacaaaacataaaacagtttatcctttttggtactaacaatccaagtacactcttttagttatttttaaatataaaattactactgagtatagtaatcaaataatatgtatgtctttttctttctttttttctttaaactcatcaaccatccctactttcccctctttcagccctggtaactatccttctactgtctatgtacatgagttcaattgttttgacttttagatcccactaataagtgagaatatatgatgtctgtttttctgtgcctgggtaatttcagttaacataataatctccagttccatctttgtcattgcaaatgagaggatctcatcctctgctatgtaatctgcggacggtatttcaaacgcacttagaacagtgcttgggcatcatcaacgccatataagtgctgctgtggtcattgtgttagaaaagtgcccggtaaattatgctctatgaatgcgaggtctgtggattgctcccaagagcgtgaagacccacaaatgtacatgagaggtgggagcatttgagatcatagatgagtttataggatagaaagaagattgcaggtaatataaaaatcagtggaagagtggtgagaaatgattagggaatttaggtgacatttttaaaaaaaatgcatttggtgaaagaaagcaaagaaactctgccacaactcagaatgcagctgacaggccgtctaaggaaatgtcgtggctaacagcagcaggggacgcacctgtgcagagctccctgtgcccagacctgagctctccacaccttcctgaatgctggcagcacctgaggaagggagcaatggatggggctatttatatttggcacataagaaaaccattgctgacaaataacttgcccaagctgacacagcggctgtagagtagagatttaaacacaggttgttttccagaaccctacttcataacttctaagatagagtagaaaatatttgcattccccgtctttactaaaaatacaaaaattagcttgtaagcccagctactcaggaggctgaggagggagaatcgcttgaacccaggaggcagaggttgcagtgagccgaggtcgtgccattgcactccagccggggtgacagagcgagactccgtcacacacacacaaaaggaaacatttgcattgactggggcatgtcctgacacagattaaaacgtgatgtggcttcccactgtatttaagaaaatggtcaagtccagaagtccaggttgggtgcagtggctcacgcctgtaatcccaacactttgggagtccaaggcgggcggatcacttgaggtcaggagtttgaccagtctggccaacatggtgaaaccccatctctattaaaacaaaaaaaaattagctgggcttggtggcacgtgtctgtaatcacagccagttgggagcctgaggcaggacagttgcttgaacccgggaggcagaggttgcagtgtgctgagatcatgctgttacactccagccttggatgacagagcgagattccgtctcaaaaaataaaaaaaggctaagtccttaacatggattacagagccctgcagtttctgagcttatcatccatctgtcccttcataccctatatccccaattccctggagctctttctgtgtctcagacacgagctaccctctgtgtctcaccaggtcggatccctgtgttataggtaacttaaggtctgtaactctgctaaactacaggctccacatggacaagagaccaggtcaggtttttccttttcctcggtgtttatataatgcctgatacttggcagttatttcaaagaaatgaggtgaaccgagtaaattccacaccatattcaggaccaatctctattttgccaaatcatgcatcataattgaggtcgtagccaacggcattaagaatgcttacagtccattgtggagtttgcacccatggccgcccctttggcatcaagctctgactccagctgtgatcacctgccatcctcaagctgccatctgacccctgcccctccacgacctctcagagcatagcttccccttggatggaggggggtgaggagagcagtcagaggtgaaggctaaagaatgtggagggtattgagtgcaccccagcccctgacatttcagcttgttatgtggctgtggtagtaagcatttggaatcagctctatcaattatttaagtctcataattcagtccatagtaaagatttattgcaacaaactgaaaaacaaagtacagacgcaaaggaaacagaacatggattctgctgtgttacacggtacataaacttctcatgtccgtgggagtaacataaaaggaagtaggttatttttaaaatactggagtgtttctgaaagagataattcagctctgagtttctgtgtgtgtacatgtgtatatacgtgtgtatgtgtctataatatatgtgtgtatgtgtatgatacatgtgtatgtgtccatatatataatacgtgtatgcacatgcatctgtgtgtatgcatgtgcgtgtctgtataacgtgcatgtgtataatacatgtgtgtatgtgtgtgcatgtgtatgtgtaatatattacacacatgtacacgtgtataatacgtgtgtgcatctcgtatgtgtttgtgcatatgtgtatatgtgtgtatgtgtgtatatgtgtataatacattgtgtatgtgtatgatgtgtgtatgtgtgcatatatataatgcgtgtatgcatgcgcgtctctgtgtgtgtgtataatgtgtgtatgcatgtgtatgtataatacatgtattacacacatgtacacgtgtataatgtgtgtacatctgtgtatacgtgtttatgcatatgtgtatatgtgtgtatggacacacgtgtatgtaacatgtgtatgtgtgtgtataatatgtgtgtgagtgcatatgtgtgtatatgtgtgtgtatgtgtggatgcgtgtccatgtgtatgtttgcgtgcatgtgtgtataacgtgtgcatgtatgtgtgtataatacatatgtgtatgcatgtgtatgtttcagggtttccttgcattccattttctatttagcatcaggcattttcttcttccctaggcattaaggccctcttggctcaaaattttcatgaagcatggatacattacaatttttacatttttagttggttgtttacggccattggttggtctgtcaagagcaccgagtcatctgcttactataccatcttgagtggaaaggaatgagtttatatttagagacacctggatgtagattacaactccatctctcaccatctgtgagattttgagcacagctccagaatgctgtcagccttagttttctcatctttgaaatgggaagaataaacgtccatacctcctcaagcaagtgtcaattggaattatctctacagattttctcgcccatggaggcttcatgcatgatggtttcatcttgtgctgtccctcaacatttacatgaatgaagtacatcatacttacatatttgaagtatggacaccttttcattgcaagaggaaagcaaaagcaggcaggagcatttcgttagtaaataatagtagggccatgtccaggtgtgaagttaacaatgagagagatttttttgcccatgttctgaccataaccatttgaactatgtttagtcttaatagctgggtggccttggacaaggttaatttgcctttctgtgcttctgtttccttatttataacaggaggatgctcatagcatcaacttctagggttgtcgggaggattaaatgagttaatactcataaaatgcttagaacagttcctggcacatgaaacaaaggtttatttgagtttttctttagttattgctggtggtggtggtggtggtattgttcatgttcttatgctgagcctgtgtggtgaattggaatgtatctgtgaataattcacttgctatttaagcacgttcaaacatcccatcataatattcaaagtcaatatgtgtatttctctgtagttcatccacgaatatcctgttccaagttgccatcatctccccctggagctaccacaaaatcctttagggatccttctgtaacctctatccatgctcccatcaaggaaaaagattttgaaacatctaatcatgctaccactatctgctctcccacttaaaactgtttattgatttcccgttgctcttaggatgaaagcaaacacgattgcatggccttggatggtctggccctgcccttctctcaacactcatctgcttctccccttactcattatttcagagcctttttagtcttttccagttttagcaatgtgctgagtgtcacagcagatgctattccctctgcctggaattctacccttcttgacctcgtcccaccaacatcactattcattcttctggtctcagaatctgtattgctttctccatgatgccgttcctatctttcgtctaaactgggatcttctgtctacgtgtaagaccctctcctcttccttcacagcacacaatgccattcctaatattccacttaacatgttatggttgttgagtgtttgtctttgtgtgagctccatgaatgcagggagctacatatgtcttgtgaactgctagatccccagcattttgcacatggtaaatgctaatgaaaacatttgtagaaggtgtgaatgccatttaagatgttcccataacgttcattagaactagaaagacttcctgatatccctcccattcaccgacattatgtataccgggtgctgtgttcacagcttggccactggatacttctcagttgtgcctctcaccctgtattgtaaatttcctatcgacaggctttgtgtttcctgttagactgtctctttcatgtctcccatcctagtgtctaacataggtattcaataaatatatacagaaggaagataagaagaaagagaggaaagatcagacttcattccagtgaggacagaattgcttgttcatctcttctgtctaagcccatccctctccgtgggctcattttagcaacacggcaagtcaacagaagtttcaacctggaaatgtcccacctagcaaggccaggggtgcaaaatcaaagtgaacaggacgttcctactacctttggggaagacaataacacagagtccaagaggtcaaagggtgcctggcctatgtctgcccctacgactcttccttagcccatgactctcgacctggaatgacagcaagttcatgtctagttaagcaaatccagagaagatttttgtttatgtagtggaatgttcaactcctcaattatgctgtgagaggctgagggggaaaaatagacatttttgcaaaatctgtttctggtaaccttcaacaaactaaaacagttgagcatacagaattttctgttgtttctgcagagataatttgttacatggaagctcatttgcttatttgaagtaaatactgcttcagacccagtagagattaacactcatagatgagatggattgagaaggaagagacataatacttcactgttatatttactgtgttaaatataaagtgggaattgatgaaaaatgttctggagttccccatgtgagcctaagtgatgaactggggtttatttgccatctggcttttaagcagggattttttttcatgtcagaaaaatggcaccttcagaaatattgcgttacagacatctgtttatcagaactttgcctgaatgaattattcagaatgtgcttaaggttgcactttacctgacatatggaaatataaagttgcatacttgatgtcggcatatatttgtctacataaaatcaggtgtcttacttgaaaccaggagtgctggaacttggtaggtggtgcttttcgtacctgggatattcattgttctacctcatgtggttcttgatgtcttcattttttggaaatcattgtgtggaattacatgtaactcacagtttctgtattgaagccccgtttttgtttccactgtgttccttacaactgaaatggaaagctactcttacttgatatgggtttcatggcaaaactctgttagtaatttcaagttggtgaaacaagtgaatatctggagctatcaagaggaaagtcttccaggccatactcagaagacccaagaggaaaaggtggttttgccaggtgcaaaaccatgcttgtaatcctagcactttgagaggcagggtggggagaatcacttgagggcaggagttcaagaccagcctaaccaacatggtaatgccctgtcactactaaaaatacaaaaattggccaagtatggtggcacacacctgtaatcccagctattcaggaggctcagaaaggagaattgcttgaacccaggaggcagaggctgtagtgagctgagattgtgccactgcactccggtcagggtgacaagtcaagactccatgtagagaacaggaagaagtggtttccatacacatcaagttttaaaggaacccttcaactcatcatgtcatcagaaccaaataaagctttaacattatccatgattgtacactgttttccatctgttcatttatttatttatagattgtttcatcagacattgactaagctcctactttaggccaagtattgaagatgtagattctactctttacttgttcggggcttacaagggagcagagaagatggacataaacaaaatagttacacatcagtcaccatgattgatgtgtaacttcaaatgagatgactgctcctgtgaagtgaaacaaggttttgtgagcatctgttggagcaacctgactcaggacttcaagggaaacttcttggaggacgcgattctgaagccatcataagtgacttcacttgttgaagaaggggaggagcctttcagatggcaggacagccatatacaaagatctgggggctagagagctcatgcagcattgcacaagctatttagaggccattgtagctgccgccaggggagctcatatggccaggagggctgaccgttcctagagaggtcagcagcccttacagcctggagtaaggaaggcggtgcttataaagcaagaatgatgggaaaccattgcacagattctaacatagaggccagttctgcgctccaattaaaattgacgaaagatccgtgaagtctgccatcattgcttatctgtctttgaattctctagtgtctagtgttcagcaagtgctggtaaaataaatacatgatgtgggggaagcacttcaataggatgtgagctcggagtgagttccagaaaggtgccccgcaatcacttatcccagaaactggtggggaggtttcagtcaacctgtataaatgctcctggggactgtcctttggataagcaggtgttctctttacctaaaaagagatgcctttcagaaagtctttaagggcagcagagcaagcactgggagggactaataggacctcaaaagaaagaggtgagaggcagagggctgagggcctttcggagctgccgctgcttagccagaggagggaagcaattgcatccccaacaggcgggctgtaaagggaatgcacgtcattacttggaaagggtggtgaagctgggagcaaacagcttctagatcaagctgccagggaggatgtttagtaattaaaggaggctggcaccatttggaggtacaaatctgcaaatccaaggttcacatcccagggagtgaccacgtggtcacaaaacacagcctacaaatgcccccacctgaggtcatacagagataagctacccccatgggggctgtgcgggtacagcaagtcggatgctcttattcaccacccctatacctaatagtgcagttcgttctcagatcatttttaaaggagaaatgaaagctctgtgtctgtgtgtgtatgtaaacaccatcttaacacattgcatgcacttttgatgcacatgtgtgttctaaactgtcatttgcagggacttctgttgttgaacctgttctctgtgaggcacgagtggtaggcttatgaaacccatccatctttaggccaggtgggctggctcatgcctgtaatcccagcaccttggaaggcccaggtgggaggataagttgaggtcaggagtttgagaccagtctggccaacatggtgaatcctcctgtccactgaaagtacaaaaatgagctaggtgtggtggtgggtgcctgtaatcccagctactcgggaggccgaggcaggaga[132 bp omitted]aaattcatacatcttgtacctgaggactgtttggggaagcagctgctttttcccgtcagtttctccttggttttctctactcacagggaccctcgccttgcacctgctgggaaggccagttcacctgcccgggctacttgtgttacacaaagctggaggagaatgaagtcaaagtggctgattttgttagagaagaattgttttgttctgcgttgggtgaagtttctctctattacacttttctacaaattcccctgttcccaattccctcagacaacaaaactacaatttgctgggtaaacaaaagcagtggggatgaagcctccctggcagccagtctgtcagaggtgctgtgcttgttagcatggtaaaagagttagaggaatttttcaagttgtacaaaattgaattacttaataaacttcgtttaactttcttccctgggagtcagtgttgttaaaaaatccaaaaagactgttttgcagcattagcattttacagttggtcagggttttcaaatcctttattctttatccattttttttctcaataacacttgttccttagccctttcttcctagctaacagtctctgtaactgtttaaaaaaaaaattaaaaaaaagaatggctggcctcagtaggtcattcctgtaatcctagaactttgggaggcagaggcaggtggatcccctgaggttgggagttcgagactcccaggccaacaaggcaaaaccccacctctactaaaaatacaaaaattaactgagcatggtggcacactcctataatcccagctacttgggagtctgaggcaggagaatggcttgaacccgggaggcataggttgcagtgagccaagctgatgccactgcactctagcctaggggacagagttagactccatctcaaaaaaaaaaaaaagtgtagatgtttggttaccccttcaaatcatctagctagtaggttggactttgtgtttattccaattttccccgtttagcaacattgcccccaccatcaccaccaaaaggggaaaaaaagacagtgggttaatcatccctgttagaaagaatttctctccaatgcctgaggcaagtttgcatgccatggatggaaatggtattttcaagagacagactgagccggtcctgcctaggaaacctgctgccttggcacggtggtattagtggctgagggctgtatgtttattccctggccctctgctgatccctggaagcaaagtgagtgtccacaggctttctctgtagtgacattgacttccttctgcccttgtgtttccaaggtgagctttgttaggtgccaggctgcagggtccttctgcagcattctgaagaaatcctctgccttcctctggttgggcagaatgcccagtagaatcaggaacagtgagctcatctccacctgatactttgtcttcgatggaacgctttgctttatcattaaaaaaaaattataatgcctcacttagggctgcaaacagtgttgatgtattcaatagcgcattagagaaaacgtcgaagcagatttgtagaaggtgcccatcctatgggcaaccccaaaaagcaatttattacccccccccaaaatatacattgtcatgtggagcggaaggattaaatatttatgtctgttggctggggtaataaaattgtattcaattgtgtctcaggcactacctaatgattgttgaaaactcggtaataacaccgaaactcataaaaaatacaggataaacaatgctggaagaaaattatgggaaaatagcctctggcctgtggaaatgcgactttattttgaaataatttgaaataagagtgtatgcattaaaaaaaagtgagtttatataaccgcaatctaatctctagaaacttttctttatggttttgttctttgtcaagttaaaaacaaggggtacatcagtagtgtttccagtaaatcctgataggtttggatttccttgaggacaggaacagcgttttcttcatctctgaactcttgggacttaaaaagagcctagttcagagcagactgggtgctccataaatatttgcagaactattttttttttttttttgagacagagtcttgctctgttgctgaggctggagtacagtggtgaaatttcagctcactgcaacctctacctcctgggttcaagcaattctcctgcctcagcctcctgagtagctgagattacaggcacctgccaccccacctggttaattttttgtatttttagtagagatggggtttcaccatgttggccaggctggtcttgaactcctgaccttaagtgatcagcccacctcagcttcccaaagtgctaggattacaggcatgagccaccgcacccagcttgcagaactaaatttaaaacataataattgtttatgatctccatgtcatctccgtattccaaggattctcaaccagagtgatttttgttccccagtaggcatttcacaatatctgtagacatttctgtgttttacaacttggcaggggagtatgtcctcctggcatctgtagggcaggggccagggatgttgttaaatatcctacagtgcgcaggatggcccccgaagcaaagcgtttgtagtgctgacagtgagagtcatctttaccgatgtgcctccttcagtattcccagtgcccagagcttcactcagagaaacagtgtatcgagctgtccttgagagaatggcggtatccatgtattggttttctagggcttctttaagaaagaactaaagacttggtggtttcaataacaggaattgatcgtcttgtgttctgaaggctagaagtgtgagatcaagatgccagcaggggtggttccttctgaaaactgggagagagaatcggtcctatgcctctctcttagcttctgtttttgtttgtatgtttgtttgtttctgtttttgatggagtctcactctggttgcccaggctggattgcagtggcacgatcttggctcactgcagcctctgcctcctgggttcaagcaattctcctggctcagcctcctgagtagctgggattacaggcatgcaccaccatgcttggcttatttttttgcattttttagtagagatagggtttcaccattttggccaggctggtctcaaactcctgacctcaggtgaaccacccgcctcggcctcccaaagtgctgggattacaggcatgagcccccatgcccggccagcttctgtggttggctggcagtcatgggtgctccttgcttgtagatatgtcacctgaatctccacctgcatgtttacatagagttctccccgtgagcatggatgtctctgtgtctctattttcccttttagtgaggacatggtcatattggattagggcctatccaaatcatctttacttgatcttctgcagagaccccatttccaataaggtcacattcacagctactgggggttaggacatccacatgttttggagggaaacaattcagctcctaacaatctacttctctgcatccctacatccgtgcagttcagattattacctctgctcagcattgtgttgcctgagatctggcatttcatcttctctcctccagcctttcgggtgtcctctcctgcggctctgggcaggcctgcacccccagcctctgaccatggcttgggcctgtcttgttcatccaagttactctgcctttgcacccttctaaccccgatgtgtgtctgtctgcctgccttctctttcctcccaggaacctttgacttttccactgatacctctggcctctggtgtgacctcttctagactttctccccagcatgcccaatcctctaggaaggtatttccgggttatagctgacaactcacttatcaggttcacctcccaaactacttttcagagtgccaagcatgtcttatccatgtgcctggcacagtgctgaacccccgtgatttaggtggaaatggttaatgaatcctatcctatttcttccagaatatggccctctaattatccatgcagggtccagttgggatgacgagggcaggctccagggtcagaatgccttgtcctcaatccttgttcacctcattgactcactgtgcaatctgggaccaagtgcttactgtctctctgcccagttacctcattgataaatggaggtgaggttgtgccagcctcacaaggctattgtggggactaaattagtttatataataattttgaacaatgctaggcacatcctaagcattcatgactgcagctgctaggataatttggcataatctgtgcttccccccaacacgctctctctgggggctccgttcttctgcttctgaacatgcttagacttccatttctgtaggaggttcttattgttgctataactaaatgatcaccaatttaggtgtaatttaaaacaacacaaatgtattttcttgcagttctggaggtcagaagtccaaaatgggtcttgctggagtaaaatcaaacgtcaacagtgttgcatttcttctggaggttctttgggagaatgtagtttcctccctttgccggtttctagaggccacccagattacatggctcatggcccttttcatcttcaaagccagcattgtggccttcagactccagccctggcttccagcatcacatacctccttctctggtcttcctcttgtaaggaactttgtgattactttgggtccacctggataatcctggcaactcttccatttcaagatcctttattacatctgccaaggttcttttgccaggcaaggtgacgtattcacacctttcagagattacgatgcaggcatctttggcatgagacaagattctgtctatcacactctctaaaggcgttccacctgtgtgatggctttatctccagcaaacatgcattcatattcaggctcagctacctagaagcgagggacatgtaatctccccaagcctgttctctcttttacaaaatcagacaaagaaattatcaagtgaggatagagaagtcggaatcctatgtgcctaacacgtggtacatgcatgctaagtcgtggcagtcacaatgactgttgttggtttcactttttttggtgttattttctcccgagtgtggttcttcccttattacctgcagccatcggtcttctgttgatctaaagcaaggtgtgcagttgggggtgtctgctcggaccaccctcgtgtgactgaatttgcctgcatatcggttcctttgctaattctgttcgggcaggatttgcttttttttgcttagcaaacttcatgagccatttctgatttccaatattgctcctcaggcagatctctcttgaaaggtgttgtttgtttggtttgtttacctcttgttcattactcttacctctacaggctacaagtctcctaggaagggatattgtgcctgtacgtcccaccctggaccacggaaaaccttggtagcgtgcaaagagattgggcattctagcggggctttgatggaactctaggaagtagaaaaagcagactcaagcagaaaatgggaaaagagaaatcctaagaggagtctcatgagatgattacttcacatttgcagttcaggcattttctccatacttccagaatcgtgtagggagttgggcacagagaatctttttaggggcaaagaaagtgagtgtcttttccactccccgtctccacacccatcttcctatttcccttccacacacacaaagaggagagctttaactttatctcaggaattctgtccccaggttcaatgctggagtaaaatcaaggacttggctctgtgcctgagtgggtgattccccacttgtgttaatcactcaaacaacctacatgcttttccttgtagttctggaggtcagaagtccaaaacggcccctattggggtaaaatcaaagcctcagcagggctgcatttcttccggaggttttatgggagaaggcagtttcccatctttgtcagtttctagaggccacctggattacgaggctcgtggcccttctcagcttcaaagccagcagtgtgactctaaagcaacatcatttcctaaagtagcggagaggaggcctgggaagattacacagcaaaaccatcagatcctacgtctgagaatgagaaggttgtttccttttcagttgactggtatatctaagcttatatccagaagaatgcctccatttcatgctggtctttatacctttgccttccttgctaatctctgttagtaaagaggaaggagggtcaggtgcagaggctcacacctgtaatcccagcactttgggaggccgagacaggcggatcacttgaggtcaggagtttgagataagcctggtcaacgtggtgaaaccccgtctctaccaaaaatacaaaaattagccgagcgtggtggcaggcacctgtaatcccagctactcgggaggctgaggcaggacaatcgctggaacctgggaagtggaagttggagtgagccgataatcgcaccattgcactccaacctgggcaacaagagtaaaattgtgtctcaaaaaaaaaaaaaaaagcaaactgaagacttgaaccttgggtagtgcgttagtttcccaggactgctataacaaagttccacaaactaggaggcttcggcaacagaaatgttttgccttacacttgtggaggccagaagtccaagatcaaggtgtcaggagggttggtttcttctaagggctgggaggaggaatctgttccatgcccctccctgtggttgctggcaacgcatggtgctgcttgggttttaactctgtcagtgtgatctctgccttcacctgcatgtgttctccccataagcatgtctgtctccctgtccaaatttcccctttttatgatgacatcagtcatattgaactatgacccataatgacttaattttgttacctctgtaaagaccctgcttccaaatcacgtctcacagatcctaaggggttgggcttcaacatcttttggtgggaacaaagttcaatccatagcagacaggcaattctttttacctgctatttaataacacttttatttgtattgtgtttattttaccatgcatacctacagcaaataattttgtttccacttatagaagagatctattttttcttctttttcagtaaatgaatttactttttaaaaatctcagtaaagtgattttaagaaaagacgttaactatatcatagtacaggtggtcttcagatgtggccaaatatagaagacacagtgtaagatttgggcaatacttggttcaccaatcctttgaggcttgggagtagaaagaacaagaataaagatgttaagtagagtaagatgcattcttcaaagattcctttttgtggaccatttctttgagagagaagttttcttcctgtgaataaatatgctgttgctttttttagctctatcatttatacttactagtatttcagaactttacgtttgagttctattttcatgccataaagaatgaggtaaataatctgaaacttaaattcccacgtggagtaatttctctaatgtggagtttctcaaacttgagggtacgtcagaagcacctgctggcattgttaaaatgaaggttgctgtgctcagccccagattttctgactgaatagctctggggtggagctctgtaatttacacttctagcaagttcccaggtgatgtggatctcggagtggggacggtacattttgcgaaccacggggctactgaaatgaggtgtctgttctctgtgagtaaagatttttcaggatcctttccagccctgcggctcagatagatcagattgaagtattctgggtgggctaagataactaaactaaagaccttctgagatttaggtttaaattcttttctctttgtttcttttactttttctttcttgctttcttgctttcttttcttgtgtgtgtgtgttattactattttttttttttgcaaggtctcactgtgtcatccaggctggagtacagtggcatgatcatagctcactgtagcgccccaacctcctgggctcaagcaagcctactacctcagcctactgagtagctgggactataggcacatgccaccacacgtgcccgcctaatttttttttttaagacagactttgtcccactgtgttgcccaggctagactcaaactcctgagctcaagtgatcctcttgccttgacctcccaaagtgctgggattacaggcatgagccaccaagcccagcctagagctccttgtttttggtcctcaggggatcttgggcaatatctcacctcatctggctgttacccaacactgtgctttatattctacttcctatttctgctgggtgaggatgggcttctgatgggtggaaaagaacttggaaagggccccaggcaggaaaaccattatggaagcaacgtctgtccacccaccaggccgctgggaggctgaagaagacacgtttttttgttttgttttgtttttttgtttttcctgtgggttacttgaaaaacatttttttaaatgcaaaaacagggtatcggaaattattatctgtccacctatttaactgttataaagtagcacttttaattcatttccataattacagcctgtgtcatgctgttcaaaagattcaactggggataaggagaatggtcccattttaacccccttatgagcgtgttagctcaggccaagagcagctgctgtctcttccggcaagccacggcattgtttgagaacatctttcctctcatatcccccaccagaccctgagcatgttgccatcggccttcttcacacccccacaaccctcggccccatcatctgcagtgcccgatgcccagcactgagcccagtgcctggtgttcagggtgtcttttgaaggagaagttataagtcggtagcatccccaagcttttcccagagcaactcaagccctgaggccaccagattgtttgggcagcaagttggtctcctagaagcccttggtagacctggctccttgcctagctgggccaggctctgtcctcccctgcgtaccctcctagccaagcgtctgggcagccagcggttaagtccactgtgggaagctattgagtctgaaacacacagtgacagcaggcatgctaaactacttcccagccctgcatgtggcgtaattgtattttcagggagggccaatctattagcaaggtgccagtctcaactgtgtaacttttataaagcaaacactaaaggcctcttggggtgaaggatattataattatggatgatttatactccccacctcatgtatacattgcacttgatgagaatgttctacttgacgtagccagaaacattaagcaaaaaatagtgttgcattctgggttagaaacccatcttttgttttatgtctaatctatccagtgctaaaacatttggaatgatacctctgcatgctgctgtgaaggaaatacgaacataatgagtgcatttctgatttcagaccagatcatcatttccttctaaaatacctcactgagtttagcatatttattccttggtggaatgtttgctgtgtattgcagtacgaaagcaaaagaaaataatcattataattataatttccgggctaggagggaccttagtgatatatctagtccggggtgtctgggcttaaattacagggtcggctgataagtattctacttttcatgattcagaatctacaagttaaaagaggaagagagaagagaaaagacagtagtaaaggaggtacttttgcattaataagaacacagacctaggtgtctcacctccacctcctacctgagccacctttgataagtgagaatctctctggacatcagttttcagctccagaagaaaacaaaaataaaaaaaaaaacccaaaacagggatcaaggccaggagcagtggctcacgcctctaatcgcagcactttgggaggctgaggcaggaggattgcttgaggccacgagttcaagatcagcctggccaacatagcaagatcccatctgtaccaataagctgaaaattaacctggcatggtggtgtgcacctgtagtcccagctactttgaaggctgaagcaaggaggcagaaacaacaagatcgctgaagcccaggagttcaaggctgcactgagccaagatcgcaacattgtgttccaagctgggcaacagagcaagaccctctcaaaaacaaaacacagatggataggtttgagacagccctcactcacataacttttagagaagtaaatcggatagtgcctgcgtactattattattacagcactattgccaggcagcaagcaggcccagggtggtgtaagtcggctttgctcatccgtagatgaaggatgcagaacattcctcagttgactaatgtgtgaactgcacactgagaactggcctgcggtcctccagctaatcagtggcggagccatgctctccagactcggggtcaaggcactggggctgagctgctgctttccccaggctcccggagacccactcccttgttctcctagcagctggatgaagcctgtggtcctcagcatttctactaattccctccaagaagggcctgggattgtttccattctctgtgttgcggactagggagctaactgcggttcctttctgcagggaggaagcttgctctacagattagaaaggaaacacgcagcttcccaagcatgtcacttctgaactgtttaataaatccacgtagcccgttttcttatttccttgataacttttcaaaaattattccttaaacaaatgacttcctactatagcctaaatctaaaatctaaacaataactattttttctaagtcctcacccccacaccccccttttttttttttttttttgacacagtgtcttgctctgtcacccaggctggagtgcagtgccatgatctcaggtcactgcaacctctgcctctcgggttcaagtgatcctcctgcctcagccttcagagtagctgtgagtacaggtgcgcaccaccatgcctgactaaatttttctactttttgtagagacagggttttgccatgttgcccatgctgccctcaagcacctgtactcaggtgatctgcctgccctggcctcgcaaagtcctgtaattagaggtgtgagccgctatgcccagccttcattcctttttatagttgaataattctcctgaagtggacatgttccgtgaaagggccgtatttgcaaagtggtccccaaatgctgaagttgctgagaaaccaaagtacaaggcagaaaaatccagtttgacattaaaagctgttttactgggaaaacttaaagacagctgtcttgactggcaggaagacagagctccacactgctactccccagacccagggcttatataccttagggaaagggcataagcgctgtgtacaagacaactgaaggcaaccctccaggagaggcaagaatgatcaaagttgacacgttgttatgctaaggactggaaataaagtaggaatcaggaggcattcacggagctgggactgatcagaagtcaatatggcagattagcatccaagatggagtcactgttgtttccacaggataccatagtttgttcatccgttgatggacagttgggttgtttttacctttttgctattatggctaatgctgctttggacctctgtgcatggggtttggatgtaggttttcatttctcttgaatatatccctaggtgtggaattgctgggtaatgtggtctaatacacctttggttaacgaaataaatagcattttagttgtttttttttttttaattgtcattctacgaccatctccaggaccattagtggcacagataccacagtttaagaaatcccataaatcatcgtgacctacacacttgtaaggccttccatcttgcaacgctattggccgttctggcttgtgtttttctggatggtcatcacgaccttcccaggtcgtccttttacctctcattggccgcagttatgcccattcctacttaaaaactcttgcataagctcggattacttccagcttttttctaccacccacttaaacttttcccatctttgaaggctgagttcaaacttcgaagtttgaatttgtaccttgatcttgtttttttatttgtttgtttttgtttttttgtgtgtataagatggagtctctctctgttgcccaggctagagtgcagtgacataatctcggctcactgcaacctccaccttccaggttcaagcggttttcctgcctcagcctcccaagtaggtaggattacacatgcatgccatcacatcaggctaattttgtatttttagtagagatgggtttcaccatgttgttggacaggctagtcctgaactcatgatctgaggttatccacctgccttggcctcccagagtgctggggttacaggtgtgagccactgtacccagcctgcaaatgattttgtccacagagcagactgagtttctgttcttaatttgtatttaaaatagaaaatctcagtggccaccttggtccccgctctcactgcaaagagtctgtcccagctactgttagggactcatttgtaaccaaacactgaacagaggatgtcacagttagtgactaatcccatctggtgaaatcagtatatgggattgcacatgaaatgaagagtttctgaacttgagtgtagctctatatcttataaagaaatctacaagtgcttttgtccttgatgtgtttcatttggggaatacatccatttctgtctccgccttctttaaacctgaaaggaagagagttggtagaaacactctgtccaaaggaagatcaatgctaacaatgttcatttttctaagtgtctccttcttctgaaataaaagttaggaagctctgacaccggctcccttcctgccttctacaccgaagtgggagttaagatgttccagataccatttgctgttttgaaggagggtctgtgtgctgtgtgatgagtagactcttcccctttgcttcgatgggaacctcggcattccaagtggacatatttcatatcctcagggcttgttctcctcctctgtggatctcagtagcagaccttcagctgcctcttagagaacagggccctgggggagacatcatcctttgtcagaaatcctggaaaaataccaagaaactgacacaagtcgaaagagggacaatggagacctgggtattatccctttagggtgttcttactcaacctaagtctcagggtagcctacaggagagccacttacgaatttgttaaaaatgtacatttgtggccaggtacattagctcacgcctgtaatcccagcactttgggaggtcgaggcgggtggatcgcttgaggtcaggagttcgagaccagcctggacaacatggtgaaacccctgtctctactaaaaatgcagaaattagctgggtatgctagcctgtagtcccagctactagagaagctgaggcaggagaatcacttgaacctgggaggtggaggttgcagtgagctgagattgtaccattgcaatccagcctgggtgacagagcaagactccatctcaaaaaaaaaaaaaaaggaaacacacatttggggactccaccccaggcctaccgaatcagaccactgggcttggtgccattgtttatgaatttttaacaagctacccgggtgattctggggcccactaatatttttgaactgtagctataggaagacttcatacatgcagagtaaaaccatcttaaatccaatcaaattaattgttaattaaattaatgtctgcctgggccctaattcataactttcatgttgcaattccctcctgatatccagaggcatcatttaaagaataagtaaccagggacataaaaatgaattatttatcttacccaaatctcatacccttctcagtgaaaatgtggttgcttgtcactgagtgtcctacccaatgggcatatctctggtcgtttcagagaaagaaatcattctctgccttccgaatgcagacaacatgaagcggcagtctcacgttgatattatggttaattaatcttgggcataggagtatgcaggagcattgagcagaagcgcactcgttaataaacaagtattttcagtgcaacacattgcaggcttggcccttacctgatgtaacagatggaggagaaagtgggggtggggaggaaagtggctgtgatctagttacgcagggtcctatttcaaacaccatttctccatttaataacaacagctaatgatttttgtttgtttgtttttgaggcagagtgttgctcattcatccaggctggagtgcacaggtaggatctcagctcactgcaacctccgttcttgggtttaagccattctcctgtctcagcctactgagtagctgggattacaggcacctgccatcgtgcctggctagttttttgtattgtttttttggagatggggtttcaccatgttggccaggctggtcttgaactcctgacctcaggtgatccgcccgcctcagcttcccaaagtgctgggctgggattacaggtgtgagccatggcgcctggcccaagaggtaatgtttcttgaccaattcctatttatcctgtttacatgtattaatttctccaaattaattcctcacaacagcccagcagtttaggttctcttattagctccattttatagaccaaaaaataaaataaagctcccccaaactggaacatagagggtttttttttttaagtaaacttctcagcatcacacactaataaagagtagacctgggatttgaaccatgaaatcccaagagagatccagaacctactctcttagacatttctccacttcctatggcttgaaatttgttttaaaggaaaccctggtatcttcgaacaagtatctggaaattccgtcctttttgttgatggagagataaaaatccagattgaatccagatccataagacattgtcatcagcactgatatattgtatgttatagataaggagaaaaatttccaggaggctgagtgacctggctaagatcattctttttttttttttttttcattattattatttcaatagttctgggagaacaagtggtttttgttaaatggttaagttgctgagtggtgatttctgagattttggtgcacccatcacctgagcagtgtacactgtacccagtgtgtcatcttttatcctttaccccctcccacttttcccctctgagtccccaaagtccattacatcattcttgcccctttgcatcctcaaagcttagctctcccttataagacggaaaatatgatatttgtttttccgttcctgagttacttcacttagaataatggcatccaactccatccaagttgctgcataggccattattttgttccattttatggctgagtcatattctatggtgtaggtgtattttctttatccactcattggttgatgggcattgagtttggttccttatttttgcaattgcaaattgtgctgctataaacatgggtatgcacatgtgtttttttatatgacttctttcctttggtagatatccagtagtgggattgctggatcaaacggtagttctgctcttaatgaagttcactcctgatattgtcatgatacaatctctctcttctgcatgaaaccagagtcctttctactgtttctcttgcttcctcagcttataaatggcttgtttaagttgatacgaaaaagttagatgtgtcctagacattaagggagcaccgagtccacagaggctcttgtaattgccaagggctaccataacaaatgaccagctagtggcaggcttgaaacaacagaaatttattccattactgtttggggaattagaagtctgaaatcaagatgtggagatattagctccttctggaagctttgagggagaatacatttcatacctcttccctagtttcttttggttccaagcaatcattggcaccccttggcttgtggctgcatcactccagtctttacttcatctgcagtgggctttccctctgtctctgtgtgtgtcttctcctcctcttaggagaacatccaccctgaatccaggatgattccatcttgagatccttaacttagttacaccacctgcaaaagctttatttccaaatagggtcacattcactgatatcagggattaggacttggacataggtttttgcaggacactatctggctagtctgtaatgactatcagagaatggattctatagttactggataagtttgcccttgtttgactggaacacagtatctcaagtggttgtggtgaagcccacagactatggggctcagcaggtgttggtttgagctcctgcaccattcgttagctttgtgaccattgataagtttcctaaactcccccaggctgccatctcttcatttaggaaatggtgatattcatcttaactaaatgcatgagttttctattctgtgttacaaattacccacacacatttagcaatttaaaacagcacacatttgttttctcacaatgtctatgggttaaaattttgatacaatttagctgtgtcctttgttcatgctctcacatgactccagtgaacctgtcaggtgggttgtgttcacatttggaggctcaaatggggatggatatgcttcgaagatcacccaggttgttggcacaatttatttcctgtgaccgtaagtctgagattggtggattcttgctgactgttggccataaaccatgtttaccttccagaggctgcattcagctttctgaggtcacccatagttccttcctacatggcctttgccataggtcctctcataacatggcagcttgcttcttcaagcagtggagaaagaataatttatgtatatacataaattactgtatatatatatatatatatatttttttttttcttagggttgctttcaatcaatagacagtatggcaggcagaggtgatggaaagttataccgtgataatgttcatatatatgagcatatgtatgtgtgtgtgtatatatatgaagatgtatgttgtatatgcacacacacatgaacataatcaccatgtaactttccatcacttctgctgcattctgttggttggaagcaagtcccaggtctacccataatgaagaggaggagattatgcaagggtgagaacacaggaagtcagggatcattggcagtcaccttagcttctgcacaccactgaaatattgtatgaattagaatatacacagaactagcacaatgcctaacaccttgtggctatttaatgtatataactgctgttaccaactggcagctggtattactattcaggttaatcactgcccagattttagcatctacaactttcttcacacaggctgttccctgtgcaacttcaggagcaccttacacacaggggaggatgtgaaatggatcctggggggtaggtgcaattcagtggttcttgctacaatggagaggtctgaggcattggcatcgatctcagaaagacctgagcatcctacattgatataaactgtaacttattcagatattggaaagcactggttttcagttccgagtgtccggtggtaatggcaagtttcgcatgctgcagccccttgcaagcccactaaagaacatctgccacccggcacagcagtggctgctggtttttgctctctgcagtgagcacttccaggctgtcttgcctcttcctgaatttgtgggtggttgctaatcttttagctcattttctttgctgtgtttttccacatttaaaatcttttattttcctgcgtctgtgttttcatttccaggagacagttggcttttttcgtgtgtgtggaataaatgaacatgtgattcttttacttgctgactgttgaatgtgaaatgtgcagccacctgtaagccaggtgagggtggagtaaacttaggccatgttttgggcctcactgcatccaccactccaaaaactggaaagccttctgagattttaaacattttccagtaatttccttattgtatggtgactgtgagtaataaatcaggaggtcagcgttcatcacaggtgggattgtgtgatgatggtgtcacagagcacatcatagtgagcatttccatttctaggtgtaccttgggaagtcttaaacaagggggtctatatgtctgtatttccttttggccatttttgataatgaccaaccagaacatatccaaatcagatgatgtaaggtgcctttaatacacaaactacttataaatctataggcagtgtataagcaaaccatagacagtgcagtaccgtcggctgtttatacaagagctgttattacccctaagcccagaaggcaatgagagaaagtgatttgtagaattccaaaggagataggaaagcagctggtccagtgtgagtctgagaataaataccctggtccctgctcctggtcttcagttgcctgcctgagctctccatcagcccagccccacaggctgctagatgtggtatcctggccaggtgtggtggctcatgcctataatcccagaactttgggatgccaaggcgggaggatcatgtgaggtcaggagttcaagaccagcctggccaacatggtgaaaccccatctctactaacaatacacaaattagcaggcatggtggggaacacttgtaattccagctacttggaaggctgaggaaggagagttgctggaaaccgggaggtggaggaggcagtgagccaatatcacaacactgcactccagcctggatgatggagaaagactccatctcaaaaataaataaataaaaagatgtggtattctgttaatcatggctgaccattttccagggcagagagcagggtggaatgggatggagagtgaatcagcaggggagcatggaagatgcatcagatatacccacacaccctttactctttaccccttgactgccattttctagcctttaaagcagtagaaggccagcaaagtggtcaggaacacagatatcaaagcttaattaatagttagtctattttggagtccaataaaggatttgccaccttctagccatgaaacttcaggcaagtgactgaacctctttgagtgtattagtccatgctgcattgctataaagaaatacctgaaggtcagttgtggtggctgacacctgtaatcccagcactttggaggctgagtcaggcagatcacctgaagttaggagtttgagaccatcctggccaacatggtgaaaccctgtctctactaaaaatacaaacattagtcaggtatggtggtacgtacctgtagtcccagcttctcgggagactgaggcatgagagtcgcttgaacccggaggtggaggttgcagtgagctgagattgtaccactgcactccagcctgggtgacaggaagactctgtctcaaaaataataataataataataataatagcaataatgccacctgaaactgggtaatttataaagaaaagaggtttatttgactcacagttctgctggctgtgcagttatggctccagcatctgctctgcttctggtgaggcctcagggaggttccactcatcatgggaggcatgttgggcagggaagaggaacacgcaagagagaggggaggaggtgccagcctcctttaaacaaccagatctcgtgtgaactaacagagtgagtgctcactcatcactaaggggatggcaggcaccaagccattcttgaggaagccacccccataactcaaatatttccctccaggcccacctccaacattggggatcacatttcaacatgagatttagagaggacacatatccaaactgtatcaccgagcctccatttcttcacctgcaaaataatgaggtgcaagtacctacctcttgtccttactgtgataaaatatttctacctttattcttttttttttaattttattattattatactttaagttttagggtacatgtgcacaacgtgcaggtttgttacatatttatacatgtgccatgttggtgtgctgcacccattaacttgtcatttagcattaggtatatctcctaatgctatccctcccccctccccctccccctaccccacaacagtccctggtgtgtgatgttccccttcctgtgtccatgtgttctcattgttcaattcctacctatgagtgagaacatgcggtgtttggttttttgcccttgcgatagtttgctgagaatgatggtttccagtttcatccatgtccgtacaaaggacatgaactcatcattttttatggctgcataatattccatggtgtatatgtgccacattttcttaatccagtctatcgttgttggacatctaggttgttggttttttttttttttttttttttttttttttttttttttttttgagatggagttttgctctcttgcctagactggagtgcagtggtatgatctcagctcactgaagcctctgcctcccgggctcaagcaattgtcgtacctcagtctcccaagtagctgggattacaggtgcaaatcaccatgcccatttaacttttgtagagatagggtttcgtcctgttggccaggctggtcttgaactcctgacctcaggcgatctacctgccttggtctccgaacgtgccgggattataggagtgagccactgcacccagcctatcctttttaatgcgactaatggactccacatttatttatttatttatttatttattgtcctatccaccctattccactgtgaatgtaaatttccgggggggcagggattttgatctattttattcactgacatagctctagcattaagactagttggtggcatagaggaggcaatccataaatatttgggggcatcagtaaataagatagtggctacaaagggcttagggtagggcctggaatgcgttaacagcttgatatttgagcaagtatttggtagtaaatacatcaaagttgattttaaacacccaaacacagacaagcaaagaacgggaaatcccccaggtagggatgatatttagaaataggaataaaataagcctggcgaaattacctttggtgagttccttgcaaggttatgtgatttaaaaaaaaaatctgtaattacatttctctatgtaattttgttttatcatctatttatttatttacttttgcaattaatttattttagtaacctaaactcatcgttaagtctgtagtcctggaaaccatgtcaaccgtcagatctctgtctatgctcaaaaacctcaacttgctggctgggcttggtggctcgtgttagtcccagcactttgggaggccgaggtgggttgatcacttgaggtcaggagttcaagaccagcctggccaacatgatgaaaccctgtctctactaaaaatacaaaaaactagctgggcatggtggtgtgcatctgtaatctcagctaatccagaggctgaggcaggagactcccttgaacctgggagggggaggttgcagtgagctgagatcacaccactgcgctacagcctgggcaacagagcaagactccatctcaaagaaaaaacaaaaacaaaaacccttatttggcagtgactgggtacacagagttgtgcaacaggagacccgcctgcagaaagtacccactgggatcctcaccacacagcaggcctcagaatttcccctgcctcctgatcggtgttcagatgtagatagtaggttcagtgggttgattaagttaatgacatttgtagcggtgttataggctgcaggccagggagaggctttctggaaaattgcagggagaaatcctgcaggctctgcctttgaaagataatgctagttgcatgctggggctgtctcctccctttgtcttgaaggtgtagaagacacagctttgcgggctgagtaaacatatgtgcatggttaaggtaaaaatgctacttagctcttcttcccgttaattcgttcaagaactggtgaaagagagcacacttcttggagactgaacttttaaatgcttctgctgggtctcttgagttcttaaaattatcgttttgatctttctgtcccgtgcagatacaaaatacataaacatccacgtgactctttttatttttcacttagaacctgcgcattgtcctagcaggtactccctcagggcctgggttttgttgtcactgctggaatgcagttgctcctccttgccttactcaggcctctgccagcttctcagacagctttgtcaagcaattgctactcaaccagcgattactattaacccttcgttacctaaatccacccaccatttttcttttcctataccgatgggcctcaagcttgagtttgcattagcttcccccagagggtttgatcccctagagacttagagggtccccaccctcagaagttctgaattgttaggtctgggtggggctcagggatttcattttttaacgaaaccctaggtcctgctgaagctgccagttcccatctctactaaaaatagagaaatttgccaggtgtggtgacacacacctgtagtatcagctacttgggaggttgaggcacgagaatcgctggaacccgggaggcagaggttgcagtgagctgagatcgcaccgctccactccagcctgggcaacagagtgagacgctttctcacaaaaaaaaaaaaaaaaaaaaaaaaatccgaacgtctcgtgttaacaggctgatcattattttcaaaaatgtttcctctctttctttccacatggaagctccatgtgagcagatatttctttgttttgttttgttttgtttttcgtttttgcatcattcactgctgtgtcctgtgtgcctggaaaagtacctgacatttagcaggggcttaatagacatctgctgcatgttgaataatagtgaggatgtcagcatcacctgctgccctttgggggagcagattttagggcactgtagcaaggctgattataagtcagtgccctatgtaaggcctggaacctaaaatctccaatcattgtttttgttctgttgaattaagccaccaccctaaagagccagaagcctaacactgaaggaaatagaaaatgtggatctcacaacacatcatttcaagtgtgtacatatactaatagcatacgctaaacatcatctaaacactaaatataatgatataatggcattggtcataatcttgaaggtagttgcatctccgtaaagtttcccattgagctgctgttccgctgctgctggcttccacccccagcacccacccctctagatttataatttccccaacttgggttgaagccccagatgactgggagctgcttctttactttggttcccttcagtcccttcggcagatggcacaattcttagtgtgtgtgattggggttttcagcattggctgtgcattggcattgcatggggagtgttagaaaagattgatgtctgggtactgcccccgaagattctgatttaattggtctgaggatccctgggcatccagatttttaaaagcttacagccaaggttgtgaaccatcagatcagggacaaaggcgatctggaggaagacggggcggggaaagaaaagaggaaaagagaatcctgatttctggagccaacaaagggccctgtgggagcagaggttgttgtaggataatgaaggggtgagctggcagccaagagctcaggacatgcttgaggaaagaacgttcaactcagaaataagactgctttcatgcgttaattatgcacctcttgtcttctctaatcgttttatccagggtaaccttgttggcccaaggaaattataaattccttgggatcagcaatgtgtcttacagttaccctgtagctcccaaggtctctagcagccttgcattcatgtgggattcttcaaaagtagccctcaaattactgaagaactgtgaggtcagagtggtaagtaaaagattaaaatgtctgccaatcaatcacggttgcatatgtgtgtgtttcatcatttcacattgtttgatttctttccgctatgaaaagacatatgcacacagaaaaagaacagtaacacacacaaaaaaatcagccagttaaaaccaccaccaccaccatcatcaccacagaaacttagaaatggagcccagtagagcatcagttgtcagatatgggggcttcaagtccccaaagcagatgtcatctcatgtcattgggaagtaaagatgttcacggtgcaagcgtcattcacagacacgcatgcttgagttccaagggagcagatgtgagccagttaggaagacgccaggaaaacaccatgcttgccccactccccagtctagtgtttaattcacaggcccacattgcaactcttcaatactttattaaacacatctcttctcctggataccctactaccttcagagcaaacacattctactctttgaaggcaagtgtgttcttaactgcttggatcctaccctttatgacagagaagaagaagatattgctaagggttggattagaggtaggaaactggggaagctctggtaaatggaagaggggtttaccttgttttttcattcataatgtgaatataggcaaggttagaatcccggtgcacgtcaccattgtcaaaatgacatccacaagcagtattgatgcctccaccaggtaaacagcagttccctggtatatatcagaagcgtgcttttctgtattctaagcagtttttgacacagtgctttgctttattgcaagccacaatattttcagaaggcttaaaaatccagttatgactgtagctgtgagggaagaggtctgcatggggccggggaaatttaatttttagcttaaaaaaagtcccaccaaattcaatttttctcacctttagggattctcagagttatatccagcttgcataactagtgtgttagagaatgtgttactacggggttattttttttaacacatttattatttatgaaatgcagaggaaaatagaaatgatcgtttcagggaatatcctgtagctttttttattgtattcaaagaagttgctcatgctgttttaattcaaatattaaaagttaaatctcttttcatcctgacctacatttaaaaaacactgctttagcccttatggaggacagaaaatgtgtggaaggaaaacatccactatgcattccttaccccatagttcgtcaggaatcagaatgactggcaaacctgtccaggaagtaataggaaaaacagagcgagatctctctcttctctccacatccttgcttatcccctctctcccatagcaaaccagccctgctggttatgctggtttactcggcctgctcttgaatgttgagaagctccatgtgagcccctcaatctgtgctagggaaataaagagaagagagatattatcccatctttgataagggattaatattgagaatatattgagaactcctaaaactcaacaacagaaaagcaaacaagctgactcaaaaccgagcagaggatttgaatagacgtgtctccaaaagatatatacaaatggccaatatgcacataagaagatacctaacatcactaatctctagagaaatgcaaatcaaagtcacaatgagataccacctcacacccatcaggatggctatttttgttattgttgttattgttgagaaacagtctcactctgtcacccaggctggagcgcagtggtgtgatctcggctcactacaacctctgccttctgggttcaggtgattctcctgcctcagcctcccaagcagttgggattacaggtaccccccaccatgcctggctaattttggtacttttagtagagatggagttttaccatgttggccaggctggtcttgagctcctcaccttaggtgatccgcctgccttggcctcccaagttgctgggattacaggtgttagcccctgtgcctggcctaattccccgtttttaaaatgggtttaacatctttttatatgtttattggccacttgatcctccctcagagagctatacagttttctcactttattcagtctatgagcaaatgtcatcttgtaagagaatgttctggatcaatcttaactgtaatagcatgttcctatccaatacccctgccccctcaccatagccgagtcttctgtgtatttgtatgtatattcatatatatatatatagtatcccacccccctacacacatacatatgtacttatttcctatcttctcctttctggattgtaaattttttggatgtagaaatcaggttttgttggtttgtttttcattgctgtatgcctaacatttagaatagcagatattgaataaatacttattgatttatattataaaggttgtagttttaagaaaaattcagaacacattgacctttctttactagtaatgcgctgtgtagatatggcataatatttttaacctcttctctctactgatgggaattaaggggttgtttgctctttggtgctaccaaaaaaaaaaaatctatctatctgtctgtctgtctgtctatctatctatctatctatctatctatctatctatctatctctacacacacacacacacacacacatacatacacatatatacatacatatatgtgtatgtttatgtgtgcatgaaccactaaaggcataataaacgtctgctgccttggaccagcatctctgcagggtataatcccagaagtagaacctactacatcaatgagaacactcattttaaggctggggacatcttgccaatttgttcacccaagggctttgtcaattcacactcttgccaccctacaatggacaacatatcccaccccacaaccaccacaatgctttgtctttgccagcttctatccctatttgagagatgagaaaactaatgaaaggctcacagactcaaagtcagacagtttctagttggtgggtctaaccctccctgttgcttgtgcagatctctttgttgtgatctgtttcctgtggtctgccacaaactgggtaatttataaagaaaaataagtttactcagttatgattttggaggtcggaaagtccaagagcatggcactggtatctgacgagggcgtggtataaggcatcacatggcaagagcgcatgtgagagggaggaggcgaggagtaagcaagagaaccagggggctgaagtcatccttttaatcaggaatcaactcccaagataactaacccactccagtgaaaactaactgacacctgcagtagctaacctcctgcaacaatccattcttgagggcagagccttcatgacctgatcatcttggtttttgttgttgttgttttttgttgctgtttttgttttttcagatggcatcccatctgtcacccagcctggagtgcagtggcatgatcttggctcactgcaacctccacctcctgtgcttgagtgatttccctgcctcggcctcccaagtagctgggattacaggcatgcaccaccacacctggctaattttttttgaattttcagtagagacggggtttcaccctgttggccaagctggtctcaaactcctgacctcaggtgatccacctgcctcaggctccctaagtgctgggattacatgcatgagccaccatgcccagcccagatcatctcctaaaggtctcacctcacaataccattacattggcagttacatttcaaccttggaggaaacattaaaaccatagcccttcttgatggattacatccttaggaggatctgcttccaagtgtctcacctatatggtaggtgagttagtgctggctgtaggtcgtaggcctcacttcctcatcccacgggcctgtccacaggctgcccaaacatctagccccaggcatctttcatggagagttgcaccagattctgaagtgctcaaacacatgtctctactttcactaatctctttctgttaaatttgtttttgagttgtgtgaaataaatacaatgtaaaatttaccattttaactttttattgcacagtttggaggcattaaatatagtcacactgttgtgtaaccatggccactgtacatctctagaacattattcatcttgtaaaactgaaactctatatccattaaacattaactcccattatgtcttcccccagcccctggcaactactattctcctttctgtctttatgaacttgactgctctagtatctcatgtaagtggaatcattcagtatttgtctttttgttactggtttatttcacttagcataatatccttaaggttcatctgtgtcatcacatttgacaagatttcttccctgtctaaggatgaattacattccattgtatgtgtaaaccacatttctcttatccctccattcatctgtagacgcttgggttccttccacacttgagttactgtgaatgatgctatgaacgggagtgtacaatacctttcagagtccctgctttcagttgtcttgggtgtatagctgcaagtgaaattgatgaatcatagagtaatttatttatttattttttagtaaccgacatactcttttccgtagcactgcatcattttgcatttccgtcagcagtgcacaagggttccaatctgtccacatcattgccaacacttatattcaattttcagaaataatggccatcctggccaggtgcagtggctcatgcctgtaatcccggctctttgggaagccaaggcaggcagatcacctgaggtcaggagttccagaccagcctgaccagcatggtgaaatctcttctctactaaaaatgcaaaaattatccaggtgtggtggcaagcacctgtcatcccagctactccggaggctgaagcagaagaattacttgaacctgggagggagaggttgcagtgagtcaagatcgtatgactgcacactccagcctgggggacagcacgagactgcgtctcattaaaacaaaaacaaattggaagaatttaaaagggagtggggaagaagtatggtcagaacattttccaaactagtgttcattttctatatccaaaattttcatgcagtgtttacctctctttatcttaagaaatcaataattgggatttcattattttgttttgtcaaaacaaagttattgaacaacaaaataccagtgtttgagtgattaaaaaacaacaacatggtattgaaaaatcaaagtacttatcactaaagttaatgctcatcctctcagcccaccagccaggggtcagggaggggacacgattgcacactgggctagagctgctgtccgagaggccttgagggtaggcgtacgacagcagcatttcagaggtagttggcaatgctcctctgccacccatagtgagacagggaacttcctgggcttctggtacagagttttcctaacagtatgtgcatacctagctgcagttcctggtctagggattcttgctatagaactacagagcggtaacttgagtcactgtgaaagcagctcttcagtctggactgaagttgctgcgcttgggattttctttttcatgatgttttcctttatttcttttatcaatacagaatacgtatttatgtaataaatatgtgagtatttttttacatgcagagaatatgtcatgatcagtatttgaaagggagacctgcctttacatgtttattgcagcactacttaaaatagccaagacatggaatcaacctaactgtccatcagtgggctaatggacaaagaacatgtggtatatgtatgcagtggagtactatttggacataaaaagaaggaattttttaaaaagataacaaagtcatgtcatttgcagcagcacagatggaactggaggtcattgtgttgtgaaattactcaagcacagaaagacaagtaccatattctcactcatatgtgggagttaaaaaatatgatctcgagatttttttctttaaaggaaaaagctgtgaggccctttgcttagtttggaggatctcagagggaaaggggccacgctttgtgtatcacttgaatggtcaatttaagccaggtgcggtggctcctgcaggtaatcccagcactttggaaggccgaggctggcagatgacttgagctcaggagtttgagactagcctaggcaacatggtgaaaccctgtctctaccaaaaatagaaaaaaattagcttggcctggtggcatttgcctgtggttccagcaagtcgggaggctgagataggaggactgcttgagcccaggaggcaggggttgttgcagtgagacaagatcgttccactgcactccagcctgcgtgacagtgagacccccatctcggaaaaaaaaaagaaaaagaaaaaacagcttatttaacctattcgagtgaccttgagctatatgcctatctggcctaattttcccatcatcgaagtgagataataatacatagctcagagtgtatggtcagaattaggggaggcagcagaagtaatgtgtttagtgtggttcctggcatgtagcagatgttcagagtggtagtttcagacgatctctccaagtctttgatagtttcccttcataaagtagagcctcatctccctccccatgaatagaatagaatgtagcagacacaataccatgtgacttccaacagtagatcataaaaaggaaatctttttctctctcttcttgtcaattttcttttgcaataatgaatgattactgttgtcttaagccattacatttcagggtaatttgtctcatggcaatagataactcacactttcagtagtatttgcagccaagatctgttatccttgaatattcaaaaatctgtgacctatccccattgtgcatgtacacacaagcacacgctcccctacatactttgctgacatcttattcttaaatgtaatgtgccttattcaaagggtgattaggaggtttgagaatcagtgtggcagctaagcgagacatcttccttgttttaatcagaagaatggaaagtgctttgtagaggcgaggtggactgtcaagcacagagcatgcatgtctctaaggcatgccacagagtttatccggggccaggatacctgtggtctagatcctagaaaggagggatgctagcctgcacatcggttgctaatggaacccttgggtttgtgtgactggggaccaatctgtgccgatgtgtgaatatgtctgctttgcttacactcaggcagtgattgcatatctgggggctaatgagctaagtttggataatggcaagagggtttcttctcaatgcgcaagagtattttgcctgcgtcaggctgactgcgggcatttccttagatctgaggttcactttttgctccgggggttcagcttctgtacacttgatggatgctggtcttaatttggtgtgttgcagtcattgcgagttgtgcaaggatattaccttaaggatattcttttgaatattaaattagaataaattaagggatgctggatattaagcctaaatcagagatgagtaattgccttccgttttatgccgttaagtttgttggaaatgcaagatatttgttttaattaccaagttgttgaaccaactctcaatgagcataggcacaaacagaaacaaataaaaacttcttggtgagtttgtgaaatgtagataacacctaattggatgcattttgttagtgcctgtcctattatcattactttcttccttcatccaacattgagtaattgactcccgactatgtatccagaaacgtaaaatgctctggggaggatattaagggctacatttttttcattgcttaattgtttcctgtatatgccagcctaagcacttgacatccctataaaatattcacagaagcactataaggtaattatgactatgaccgctatttcacagatacaaaactaaggctgagagaggatagcattagattaatattaaaacaaaaactcatacagctagaggtagggtaattccatactgtattggtaattcaaagcagataaaattgttgcctcttgaaagcctgtgcccaaaacgctttaaagaggttctttccgaatgctcaaaaacagtgtattttaaaagctgctctctgaaatttttaagatccatcagccagagtgtgatgttccccttcctgtgtccatgtgatctcattgggactgttgtggggtggggggaggggggagggatagcattgggagatatacctaatgctagatgacgagttagtgggggtagcacaccagcattgcacatgtatacgtatgtaactaacctgcacaatgtgcacatgtaccctaaaacttaaagtatgataataaaaaaataaataaaaaaagatccatcagccagtaattttacctttaaaatgttatcaaaaatgatatttttttccaaatttttattctggaaaattcaactatgtctgtaagaaatcaaaatagtataatgaatccctgggtactcagatacccagattcaacaattgccaactcacgaccaacactgtttcctttttaccttcattcccacatcccccgaacaaccaccccacatgcacaatgtatcttttgaagtagatacttttctttgttggtattttaggaaagtcttattaatgtagactttttttttatagttttctatgtgttggccattcagatgtcaatgaaaagagtcaaactctgtaaaacggtgaagatatttattctgagtgacataggagtgacacagacatcaggagatcctgagaacacacacccatagtggtcaaggcacagcctagtttcacacattttagggagatgtgaggcattaatcaaatacatgtgagatttacattggttcggtctggaaaggtgggacaactggaagcaagggtatggtgcgatgggcttccacgttattggcaattggttaaaagagttattatcgatagaaaagaatgtctgggttaggataaggggttgtggagaccaaagttttatcgtgtggatgtagcctccaggtagcaggctgtggagagattagattgcaaatgtttcttttcagacttaaggtctgtgttgatgaaatgctggctggcttttcctgaattccaaaagggagatgggtatcatgaggcattcctatcatggtctgaatcagtttttcagctcaactttggaatgccctggctgagaggagaggtccatttagatgggtgggggtggggggtgggcttacaattttatttttggtttacgcaagtctgtagaaatgggagctaattgtgatatggatatccctcagtttctgcttgctttttagaagaaactgcaatcacataccttaaaaaaggaatctacatatagaaattttgaactattcaagttcattgtttaaaaacaaatttctggatttactttcctagtgtagaatataatctgtcattgtccagattagatcattgtcctataaatatcaggtaggttgcagatacaataatgctgcgcagatctttagcctttgtattttttggtatcgtcacaaggaaagtaaaaatagtaattgaaaccgaagcctattgttggcaagaaggttaagttagcacagcacatagagcattacctggaaaatagtaagggtcggaaaaatgtaactgttacactgttgctgttgttatttttgttgttcttgccatcacttttcttgtctgagaaatttctaagtctcatccataatattaataaggattaaataaggtaaatgcctaacattctagcattaccagacactgaattactgtattttttctcttcatttttttttcctctggctatgtgtggtggatttagttggactgtttataggaggacaatctaggttaaagggcagaaaattgtatttttggtagaattggggctttgccatgttggccaggctggtctcgaatcacttgagatcagaagtttgaaaccagtttggctgtcagggtgaaaccctgtctgtactaaaaatccaaaaattagctgggtgtggtgggttgtgcctgtaatcccagctactcggtaggctgaggcaggagaatcacttgaacctgagaggcagaggtagcagtgagccgagattgcaccactgcactccagcctgggtgacatagtgagagtccatctcaaaaaagaaagtaaaataaaaaatggagaatggagattttgcccaggaatgcactgtaactgttcttgtagtcactttccttagagatctgccttgacatgtgacgaactctggaatatcaatgctaccatggggtttgttcttttcctgtcattttactcttgaagaaacagtggcccagaaaaatttagcaacctgccaaggtcacaccactaactaatggcatagctggaattagaactcaggccaatgaagagaaaaataatttattaggttttgaaatttgatatataaaaaccataaaggtttccccacttctcaaatattgcagacatgagtgtaatatgagtcattattttgggccaattttgcttgaaataacaataaattacctagagtcacaaataatatataaattggtccaaagttttaggtagctttatatatgtgtatgtgtgtgtgtgtgtgtgtatatatatatatgtagctatatatagtagacatctgtttttatctgggttaatgaatgtgctctgctttgcacagaatttaaatagtttcagaatttttctttctttttttttttttcttttttttgagatggtgtcttgttctgtcatgcaggctggagttcagtgggagtgatttcagctcactgcaacctctccctcccaagttcacttgattctcatgcctcaaccacctgagtagctgcgattacagccgtgtgctaccatacccagctaatttttgtatctttggtagagttgaggcttcactatgttggccgggctggtctcagactcctggcctcaaatgatcagcctgccttggcctaccatagtgctgggattacagatgtcagccatcatgctggaccagaatttttcactaagagggtatcatatagctggtggaagatacatgtcaaggctctttgtaatttactgcatattattcaatttcactccataaatgcataatttaatcacaactctggtttaaatgatatagcaggaatgacatgggtggaatttaaagtttgtataatttatatcatccatagcactttgaaaaggcacaggtcagcctggcctacagggcaaaaccctgtctctactgaaaatacaaaaaatagtaatcccagttacttgggaggctgaggcaggagaatcacttgaacccaggaggcggaggttgcagtgagccaagatcacgctgctccactccagtctgggcaacagagtgagactccatctcaaaaataaaaataaataaataaataaataggtacaggtaggttacctctggctatcagaggggcttgggcatgagtccttgttgctgcccatataggaaggggctgctgtgagttgctctgaccaagctaggttttgggagatgcttaaaagcaaaagctcaaactacattgctcacttcccatccgacaattccaggaacttaacaattcaggagcagctaaagctcctttaatcttctctctgtccacacagcaaaaactgacgagtgagtgatgacaatgataatttaggtaaatattgatgaagggaagaataattctctatactttgaatgaaattcctctaaatctaattcatcctcttggagagaagcaaaaaattgggtattcaggggtcttatttgtacacttcttttcttttttgaggcggagtcttactctgtcacccaggctggagtggagcgacgcgatctcagctcactgcaagctccgcctcccgggttcacgccattctcctgcctcagcctcccgagtagctgggactacaggcgcccgccaccatgtcccgctagtgtgtgtgtgtgtgtgtgtgtgtgtgtgtgtgtgtgtgtgtgtgtgtagctgggagtacaggcgcctgccaccatgtccggctagtctgtgtgtgtgtgtgtgtgtgtgtgtgtgtgtgtgtgtgttagagatggggtttcactgctttagccaggatggtttcgatctcctgacctcgtgatccatccgtcttggcctctcaaagtgctgggattacaggcatgagccaccacacccggccccccttatcgtatacttctatatgtgtatggacgcctatgtgcgtgtacgtaagtgtggagggagaaatggaggtgggtagttaaacaggaaagagtcttagttggaatttcatttcaagtctactgggatatggaggcaagaatcctcaggaaatccatcagcagactctcattccatgcatacatatatatatattcccttccttccctcccattacctccctccctccatcccctcccattccctccctcccatttcctctctccctcccttccctccttccctccctccctccttccttccttccttccttccttccttccttccttccttccttccttccttccttctctatggcttccagcaagtagattagccgtgtggaaactcagttttctcatttggaatattaggaaatccctaatttaaaataaacaccaaagtcctctaacatactgtaaaagtgccgtaaacttttgatctattctttcttcccagtaaggggaccctgctggtgggtttcctgaaggttctcacacctgtccaccaagagacttgaaattccaacagggaatctcctctacctactaaattatgcccctcctctgcccttcatacctgttgaatattataagaatgggtttatctataaagcaggtcagtcatagtaatagagctgatggttaggaaaggtggatagacagagagagattggatttggcttctgagaatgtggtaactataccaagcaagaggtagaaggcaggtgaactcatactcaccctattggaggacctaacaaataagaatgagctgcttttttttccccctaactctttcccatctggagtgcagtaagtgcaatcataactcactgtagcttcaaatgcctgtgctcaagcagtcctcccgcttcagtctcccaagtagctgggaaaggatgggcacaatggctcacacctgtaatcccagcactttaccaggcggaggtgggcagataatttgaaattaggagtttgagagcagcctggccaaaatggtgaaaccccatctttactaaaaataataataataataaaaattagccacgtgcagtggtgcacacctgtaatcccagctacttgggaggctgaggcaggagaattgcttgaacttgggagatggaggttgcagtgagccaagatggcaccactgtgctccaacctgggtgacagtgaaccaggatcccaccactgcacttcagcctgactgaccgagtgagactccatctcacaaacaaaaaacaagttgctgagaccactggcacacaccaccacgctcagctaattttttgatttttttttgtgacattttgttgcccaggctgatctcgaacccttgggttcaaaccaccctctccgtcagcctcccaaaatgctgggattacagttttgagccattgtgcccagccaggatgagctttaagaatgttgacaacatctccatctcctgggagatgaagcttcctagtgagactatcagttagagcattttcctgtggaagcatcaagaagacaagagtagactaaggcaagtgattgggtgatcaagacagagtggacttttcagtgcaggagacggtgctaggcagagttgagtggacagcgagaaggataagatggtgtctgacttggatgtgaacttgacactggggcatctctttggacaagtgaccatttagagactctcttgagagacagactcacaagcaggtaaaaaataagggcaaatggtttttatatattgtctccaagtcattctcagaaaagatggctgaccctgaacaggttttgaggaggacagtccttctacatgggtgtagtgtgatgctcgcagtttgcagtatacaaagtacacagttgtggtaccgacagggctcgcattggagattcgacatcaccatgtgcttttgtgacttgtttcgtggttgaaaaaagcaaaatggatcccccaaggctcttcctacccagacccaaatgggcaagcggggagaaagctccctgaatgcctttacgttagatgctgttgggattcagagcaggtccccaggagggagccaatctgggtattcattccttagctgctgtaatactggcttgctaatggctaccagctctccactctccacagacctgagcttggccaaatgggaactgctttgcctataaggttatagagccctcaagagaaagccagcagtcaatgactgatcaaggtgcaaaaagaatagcccatttgtcttaaagagggtgttaaagcaaaccaaatatggcttgaaaaggactgcatacttctatatttgagttcttgtggatgagctgtcagctagcttaatagacagacaagactgaaaatctaacttaagagtatgggcctgtgggccgggcgtggtggctcacacctgtaatctcagtactttgggagtctgaggcaggcggatcacaaggtcaggagattgagaccatcctgactaacatggtgaaaccccatctctactaaaaatacaaaaaattagccaggcgcggtggcgggtgcctgtagtcccagctacttgggaggctgaggcaggagaatggcgtgaacccgggaggcggagcttgcagtgagccaagattgcgtcactgcactccagcctgggcgagagagtgagactctgtctttaaaaaaaaaaaaaaaaaaagtattcgcctgtaacaatagctgagtcttggccaatcccagcagctgaacttcaaccactcatagactgttaagtgttcaaaaactgtgttcaaataaggcaaacgctgagctgtaaccattctagctttttctgtacctcactgctgatttctatacatcacttcccttttttcgtctataaatttgttctgaccatgacatatccctggagtctctctgaatctgctgggattctgggggctgcccaactcacgaactgttcattgctcaaactcctttaagtttaatttggctgaagtttttattttaacagggacaaccaacactgcaaagcctgaaacctgtggctcaggcccaggctagactctacttaagaccacaccctggccaggcacagtggctcttgcctgtaatcccagcattttgggaggctgaggtgggtggattatgaggtcaggagttcaagatcagcctgcccaacacagtgaaaccctttctctactaaaaatacaaaaataagccaggcatggtggtgggcgcctgtaatcccagctagtcaggaggctgaggcaggagaatcgcttgaaccgaagaggcggaggttgcagtgtgccaagattgcgccgttgtactccagcctggcaacagagcaagactccatctcagagaaaaaaaaaaaaaaaaaagaaagaaaagaaaaaagaagaccacacccttgcttggccacttccctgccttacatgacttatctccacataggtgacagtgactttggatcagagtgatagtaaccagaagtggtcacgatctggtatattttgtagacctcttaggaaatgtgtacattaagagactgggtctcgtagatctcaggtggaatcttcagcctctgtctagtttttgtgggggtctggccatgcatcacagcctagaaagtgcaggaacctgggctgatttcatggttcagtacatggtttcctgggcaacctttctgccccttgacatacatggataaagtcctgttgccatagtaccctcatatgggtgtatctcatctatgccaactagagaataacctgaggactggagggctttgggtatgatttgtcagaatccaattagcaactccaattgattgatgatggctgattcgtgggtagctatgaatttgcagctcttagctattctgtctgtaaggatgaagacagtctgaaaagtggctgactgctgtatggagtactctttgctcctcctgggtgaaaagggtcgtgacttttagcagctcttcttcttatcttaacattctgaatcccgtgttctaatgcattattgagggtttgtgaagacagagcaggggccagctctgcacccaacgtccctttgctagggtcacgcagaggtaggggcacagtacatagggatgagagtatggggaaaaaagggctgtgacctcagactgcttaggaaagcaaattggcagcaaagttccagctcagccacttaatcttcacgtgtccttgggcaagtcatgtgacctctgttagcgtgttatgatggtgagaatgtgtacactaggggtctcaaacgcagatgcttacctagggccagacagttaatgttatcagtcaaacatggcccattgctggtctgaacaacctgtgccatttctagatggccatgcaggaatgtagatccaatggtgccagattttatcgttttaaagaaaatatggatattttgatttttttttttgtaaaatgggaaatctaattctcatttttggaaaacactacctgaccatgtaaagccacatctgtgactcatgggcaaccagtttgcatctttgatgtttatttttgtatcagaatccgctggtgctggctaggctcggtggctcacgcctgtaatcccagcactttgggaggacgaggtgggtggattacctgaggtcaggagttcaagaccagcctggccaacatggtgaaaacccgtctctactaaaaatatacaaattagctgagggtggtggcaggcacctgtaatcccagctacttcggaggccgagacgggagaatcgcctgaacccaggaggcggaggttgcagtgtgctgagatcaaatcactgcactccccactgggtgacagagcaagactctcgtcccccacaaaaaaggaatctgctggtgctaaccctaagcccccaggggcgtttaccatttcaaggcattctgcctcaatttccacaagtgtcttttggcctgaggtctttctggagcctctggagccccctttgcctacacagatgcttcactggaaatgtgagggaattaaagcaccctttccccagcaaccttcaatgggtaactcaggatttgctttataaataacccagttttccttgcttctcaagtgggataactcatgattaggggttggcaagtgtttacagtaaaggaccagatacagagaatattttaggatttgggtgccatatggtttctgtgataactgctccactacatccttgtagtacaacaatagccatagacaataacatatgggtgtggctgtgttccaataaaactttatttacaaaaatagtcagtgggccaggtctggccagctggccctgtactgggcctatattgcttatctgtgccataaagcaagctctacgcttattgcctgagttctgtgatgaaaataagctgttacccactatggtaactggcttggtaatgggctttctgcatagcctgttttctcctccttgttttacatctcccatccctactgtgttttctaagaaccttctttcataaaagcttcttgcatttaaaacctgttctccaagaacctttttttcatttttttgagggggaaggtagtaggggttagggtctggttcagtcacccaggctggagtgcggtagtgagatcacagttcactgcaatctcaaactcctgggctcaagtgatcctcttgcctgagtctcccaaatagctgggactacagactcactccactctgcccaactaattatttttaaaattttttgcagagacagggtctcactgtattgcccaaggctggtctccagtttctgaatctcaagcaatcctcctgccttggcctccccaagtgctgggattataggtatgagtcaccacatccagcccagaaacctttcaaacgttgttatttggctttatgtttgggagccatttgaatgtgtatttgaatcccagcctgaccagtttcctagccctgttgggttgagcaagtcccttcacctctctcctggcctcaggctcctcatctgtaattgagagaaggtctgtgctttctcagagaatagttaagaggatttaatgggataagatctgttaaactcttagcacataacctggcccatgttcaaggtccaataaatcactggctgtgatttcaactctttatgtgaaggatgcagtttatggctgtcttttaggaattggccaaaatgatgagtcagaagctcttcttattttcctgtttttcaccttgattttggagtaaggtcacccttcccacaggtagggtgtgatttaacagtctttaagagataacattatgaagacacctgggtgcctgagccttttgcatcttaatcgctctccctggtttcctaagagaaggaacagatgggagaatggagactggcttcaactggccgtatttcatccggctgagaacatatgttcttgggaaggatgtaggaacaccctgaaatagagcgaaaaagagatgtgagatgagagaaatcctcctgaaacatgaatggacttgagttcctgttgcccttccttgcagcttgctgcctcctgccttgcgtagaaggaaaactgttcctggttccagacagaatggatttaagttctgttctatcgttatctccttgggaaagctatatgacttctctgagcctcagtttgctgaaatctatttataaacgtttacttaggtggctttcttttttagctattcatctgattacattttctcttgctctttttcattttttggagatggagtcttgctctgtcgctcaagctgcagtgcagtcgtgcaatcttggctcactgcaaagtccacctcatgggttcaagcgtttctcctgcctcagccccccaagtagctgggattacaggctcaacccaccatgcccagctaatttttgtattttttaaatagagacaggctcttatcacgtttgccaggttggtctcaaactcctgacctaaagcagtccagctgccttcacctcccaaaatgttgggattacaagcatcagccaccatggcctggcctacatattctcattttcttctgcggtttgagaaggagtagaaaacaatacaaaatagaaacatgcctttcagccaggcatggtggctcatacctgtaatcccagcactttgggaggctgaggtgagaggatggcttgagctgaggcattcaagaccagcctgggcaatattatgagaccatatctgaaagaaaaacataaaataaaaattttaatttaaaacaaacaaaataaagccaggtaatggaaacaaactctgacatctttctgctacatgtccttttctttctccctttctttttttttttttttttttttttttttttgaggctgagttttactctgttgcccaggctggagtgcagtttatctcggctcactacaacctttgcctccttggttcaagcgattctcctgcctcagcctcccaagtagcttggactagaggcgcccaccaccatgcccagctaatttttgatttttagtagagacagggtttcaccatgttggccagactggtcttgaactgctgacttcaaatgatctgctcgccttggcctcccaaagtgctgggattacaagcgtgagccaccacgcctggcgttgtgtcagtcttatcagaaactccctcctccatcatttgactatgttttgaaatgttcactactccattcaacaaaaaatgcccatacaatccagaagaggaagcgtcttttctgataattttagcctaaatcctagagagatgatttgatttgtgtcatcagtcttctgtccgtctataaaccgattacagtgaccagagggacagcatcctctgactgtcaatgaggaagggagagtgggttataccatcctacgttgtgtggacgagttgggttgctgtagaatgggatagtttgagacagtttctcaaaggaagggattctcgattaagaaaagaaattcgactctatggagtgtgattcgtaaaagggagagtaaggacaaagctattgtcaaggtttctttatcctctgaaatgtaattattgactttttttaaaacatggatagggatatgtaactgatgccttcccccacccccctgaaaagtctaaggtctagaataaaagctacaaaagctaaattccaggatatagaaacaagcctataaaaagcaccttcatcaacaagaaacaggctcaatttcacaaaacaaacccataaagggagaagaaagacatgtaccagttagttttcaatcttcgctcaccttttgttccttcccttcagtgaaacaggccttgctgatgggttttactcattccatggtgtattagctggctaggggcaccataacaaaataccacaggctgggttgcgtaagcaacacagatttgttttcttacccttctggaggctggaaatctaaagccagagcattggcagggtctgtttcttcttgggcctctctccctggtttactgatgacgatcttcggggtgtgtcctcacttggcctttttttttgtgcctacgtgcatcttggatatctctttctctttttctaaaaatggcagtcaaattggattaaatccccaaccttatgacctcctttgaccttaattacctccttctaggtcctacctccacatatagtcacgttaggagttaagacttcaactaggaattttgaagggacacaattcggttctgggaattgttcattttcttctgaattttttttttctgtgtgtgtatgagcagaacatctcttcacccggacagaatgcaattccaagcccctctgttgctgaactgttctccctttaaaactgtcttcatcctcagcgtaggtagctccttccctgagtacgtttttttgttgttgttgttgttgttttttggtacagagtcttgctctgttgcccaggctggagtgcagtggtgtgttctcggctcgctgcaacgtctgcctcctgggttcaagtgattgtcctgcctcagcctcccgagtagctaggattataggcatgcgccactacgcagaggtaatttttttttttttttttttttttaagtagccatggggtttcaccatgttggccaggctggtctcaaactcctgacctcaagtgatccacctgcctcagcctcccaaagcgccgggattacaggcatgagccaccatgtccggccagcacattctttgtctttgcagaaccatgctcccctctgcatctcacagcctcatgtacacacccattgctttatcccatagaatcacagttacttgtgtggatctctgtccctctgtccacccaccacccactacccactacaccagcatgcactgagaacagggtaatgattcagcagtttggtatcctagtgcctggcacagagtagatgtttgataaatgtttgatgacctgaattggattgaagctgaacaaatagaaattgcatttggccattatttccaggcttagaaatgaatgtgtgttaggagacttatttccatagcattaagataatacaatatatatgcaggtgctgtgtgccttatgtagaagctctaaatctctctcaaggatgcagaaagaggtgaggttcaggttgagttgaagaatgaaaaaagagttgcttaggagaacaatgctgggaaagggaggagatttgcggccatgtaatatgggtaggtgaatttcacttaatattgtggcagaatgctctatcacaacagatgctaaaggactacatttccttcctcagctctttcttttttctttctttctctgtttttgtctctctttctctctttctgtttcttttcactctttctttctttctctctttttttttgacataggatcttgctctgtttctcaggctggagtgcagtggcatgatcacagctcattgcagcctcaaacttctaggctccagcgatcctcccacctctgcctctcgagtaggtgggactacaggcacgtatcaccatgcccagcaattttatcttattttttgtagagacagggactccctatgttgcccaggctggtcttaaactcctggactcaacaaatcctccagcatcagcttcccaaagtgttgggattataggtgtgagccaacaggccctgcctaacttttttttcttaaccagttaagaaaaggcatgtgagtgaaagaaacgtaatagagtcacccatcttctgaggggtcagtttcagctgtctgtaggctggatactggagtcattgtcattattgtctgagggtattctggctaactctttctaccaaataaatcaccctagtataatggcttaaaacaataacgtacatttattttacttaagaatctcataatggagtcagctcacttaatcaggagcttttatatagttacatagtggctgagtctggggtggttttttactcataagtctggcctgggaagactcatagagtaggagcaggaatattggggactactaagatctctctttctctccttgtaccttgttctcatctctccatgtggttttttctcatggtgatttcagggtagtcagccttcgtaagtatagtatcacttttgcctcatggattcagtgagtcacacacaaatgtccacccagattcaaggagagactccacacttctctcttttttctctctctcttttgagatggagtctcgctctttcgcccagactggagtgcagtggcataatccaggctcactgcaacctccgcctcctgggttcaagcgattctcctgcctcagcctactgagtagctgggattacaggcatatgcaccaccatgcccagctaatttttgtatatttagtagagatggggtttcaccatgttggtcaggctggtctcgaacacctgatctcttgatgggggcatggcaacattaccaaaaagcatattaacaggaaagataattgtggccactgttgaaaaaagtggtttctcatacgtggttgatcagatacatgtacctttatctttctgaaaacgattgctttgttccttcatttaatatttccccacaagtgcttcgcagagcacatagtcgttgtgaaggctctatgtggcactctgagagaaggaatccttcactgctatcactgagatgaaagaaaaagagtaggacctttccctgctacgtttctgtagatttctggttctaaaagaacaaacttaaaggtaaagctcttgtgtgtgcaaaaaagtagaactccagttttgacaaagtagttaacttagacctgttagaaagtaaacttgttgggcatggtggttcacacctgtaatcccagcactttgtgaggccaaggcaggaggattgcttgagcccaggagtttgagaccagcctgggccacgtattaagaccctgtctctacaaaaaattagcaggtgtggtcatgcacacctgtagtcccacctacctgggaggctgaggtaggagaatcacttaggcctgggagatcaaggctgcagtgagccatgatcatgccactggactacagcctgggcaacagagcaagactctgtctccctcctccctccaaaaaaaagaaaagaaaaagaaatgaaaaaaaattatccttggtagggccgggcacggtggctcatgcctgtcagctcagcactttgggaatctgaagcgggcggatcacgaggtcaggagtttgacaccagcctggccaacatggtgaaaccccatctctactaaaatacaaaaattagctgggtatggtggtgcatgcctgtaatcccagctattggggaggctgaggcaggagaagggcttgaacccaggtggtggaggttgcagtgagcctattgccccattgcactccagcctgggggacagagcaaaattctgtctcataaagaaaaaaaaattgtcattgtttgaactatacatctttacctcacctggcaatgtatattaagcattattatttctatattgcaggtggcgaaaccaagccacaaatacaaaaacaaagaaggcttgaaggtctgcgactgagtagaacttaggtgtatgtatgcctctttccactgaaggaaaaataaccatgatcattcccttatattttgctaagctgggtatgtgtccggtgctctcagacctgttacctatggtactctttaatcaaataaaaccttaagttcaaacatatacaccgaaataaggcagaactactctgaaacagaagatttatggagtctctttcaccagcaacttaataacatagagatcacaatgtttcccatatacatgattttttttgttgttgttattgtttttttttgagatagagtcttgctttgtcgccaatgctgggtacagtggtgcagtctcagctcaccgcaacctccacctcctgggttcaagcgattcttctgcttcagcctcccgagtagctgggattacgggggtgtgtcaccacacctggctaatgtgttgtatctttagtagagatggggttttgccatgttggccagcgtggtctgaaactgctgacttgaagtgatccactcatctcggcctcccaaagcgctgggattatgggcatgagccacagtgcccagcctcacacgcacacgatatttacacatacatacatataaatatacatattttatatacataatgggtgttggtgcatttcataggcttgtctttgaatatcaagatttcaaactggtttgcaactgatagaaccgagaaaaataactcttggatacctgacttgaatctctctttgcccattggcggccaaagccagttgttgacgtaaagttttttttggttgttgttgctaattgcatctctttcctgacagaggagtaacctcttatttacaaaagtgtttacagttttacatacccgataggtcttacgcacatgtcaagacaaggtattgagccaggcgcatatacccctaatatggcaagagagagaacttctctgtcaacaaggcggtaataaagtgtaacagacaacacttaaggtgtcagtcacctttgcaggcgtattggaagttacaggttagatctagtggttttgatttattttgatgtcaaaaagttactcacatatttatgtaaaaagagagtggcaaatcaacggggtgttgattttgaaggtgctatgtaataaatcagggtagcgattctggtcatctcgccaattttgacagtgagacttgcttatttatggcgttttaaggtctgaggagttgatttatagttacaataacggtcttccatccattagtagttccggcatgcatagatgtgtccctcgtttgcatttaatgattggcatttttaaaattacacgactataaattgtcaagcaggaacaaaactcagtttaaaacgtaattttgttgaaacatttgttttaataaaaagggggtagttgggataaaatacatgccaactgtcctcacctgttgtccaccccaatgctatattaattatgatcctatatcctcctcattatgtagatggagaaactgaggcaaaaagaggcatgatttttctagggcagttctccaatatcaggtcattgcatttaggggctctcttaagtgcaggtgcccaagtctagccataggtgaggagatgagccccagagaacatgccctccagaggatcttaaatcatcacctgacttgagcacccagtttgaaggcaggtagaagggttcgaacctcatttctgtggattagcaactttataaccttgggcaagttgccttttttctatcaattcatgtgtcctcaaataaagaaaggtaattatcctaaacttattaggctattttaggcatcaaatttaatatgaaggctgggtgtggtggctcgtgcccataatctgagtactttgggagactgaggcaggaggattgcttgagcccgggagttcaagacaagcctgggcaacactgggaaaccccatctctacaaaaaaaaaaaaacacacaaaaaattagctgggcatggtggattatgcctgtagtcccagctacttgggaggttgaggcaggaggatcagttgagcctgggactgagatgtttcagtgaactgagatggcaccactgtactccagcctgcgcaacagagtgagaccttgtctgggaagaaaaaaagaaaaaaagaaatttaatctagaactccctagcgtacgattaagtaagttatcaataatttttttctctttcacctttaagccttccccacatatgcacacacacacacacacacacacacgtgcacatacacacactcaaaacccctgtgttctggacttactgattaattttatgagaacgttgttctgtgttccactggttagaagtacttaaaatgatcacattcaggcaagatatgaatctcacggaattaaattagctcattgcttgcttttttcaaagggcagttttactcttctctgtgaacatcttagtgtaatattggttttatatgctggtgcattgtattgcccatgtgacagcaatatgagagaaaattaatagtatttttcatcttttgctacaccaccactttatttatttaggtatgtatgtatttatttatttatttatttatttatttttgagagggagtttcactcttgttccccaagctggagtgcagtgccgctatcttggggctcactgcaacctccatttccctggttcaagtgattctcctgcctcagcctcctgagttgctgggattatagatgcatgccaccatgctcagctaaattttgtaattttagtagagatggggtttcaccatgttggtcaggctggtctcaaactcctgtccgcaggtgatccaaccaccttggcctcccgaagtgctgggattacagatgtgagccaccagacccggcctccatcactttttgtaatgagggtgaggacacatttttgattaagtgagttatcttccctttagtgagttaccttccctttgttttgcttatctgagtgagggccacagaggctggagttgtaaatgggacctggacagattgctaagtctgggaaaagatggaatgaggaaggatgagaatggagatgggagtaccacacaggagatcgtgcagagaggcagaggagaaggactttgctttgaagagtcaggcacaaagagctgggtgaagagagtttttagagagtcttgctaaggaatccccattcgtcatctcccacattaattattccccaaagtattttgctgctggagttcttcagtgtcaagactggactcaaggggaatgagcaggctccgctgtcttccagtgaatacttgaatttgtcaagagtaagctacatgctgggctttgtcatcgtcttctcaaagagatggtattgaagattttaatttcagagtaaacctggagtggggaaggagaattgaaacctaagggccagtgggggcagttgtacctcttgcctctggtcaggtgtgggagacagaggagtgagtggttcaaatccacagcccgtcttcccttcttgtgcctgctatttgtggctgatgttgctccagttatctattgcatcatatcaaaggcatttgctctgcttaatgcctttagaaaacaatttaatatcatcttcgatggtcttgtggtttgaccaggcacagatgggtagataccgcttggggtatctcatgtggttgcagacagagagcagctggggctggagctatccaaggatttggatgggctgggtattcaaggtgacttctttcctcatttgtctggcatctgggctagttgtgttaccaggaaggggtccagatccagaccccaagtgagagtttttggatttcacacaagaaagaattcagggcaagtctgcagagtaaagtgaaagcaagtttattaagaaaggaaagaaataaaagaataggcatattccatcggcagagcagcccaagggctgctggttgcccatgttttttggttatttattttatttttttatttttatttttatttatttatttatttatttatttatttttgagatggagtcttgctctgtcacccaggctgcagtgcagtggtgtgatctcggctcactgcaagctccgcctcccgggttcacgccattctcctgcctcagcctcccgagtagctgggactacaggtgcccaccactgcgccaggctaattttttgtatttttagtacagacggggtttcaccatgttagccaggatggtctcgatctcctgacttcgtgatctgcctcccaatgtgctgcgactcacgctcagccggttatttcttcatgatatgctaaacaaggggtggattattcatgcctccgcttgttagaccatatagggtaacttcctgacgttgccatggcatttataaactttcaccgtgctggggggagtgtagcagtggggacgatcagaggtgactctcatcaccatcttggttttggtgggttatggcatctttactgcaacctgttttatcagcaaggtctttatgacccgtatcttgtgccgacatcctgtctcatcttgtgacttagaatgccttaacctcaggggaaagtagcccagcaggtctcagcgtcattttacccagcccctattgaagatggagttgctctggttcaaacatctgtgactgttgggctgggataccttagggaaagccaggcatctctcttttcacacagcctctttgtgtagttagcctggacttcctcctagcgtgacagttgcagattagtcagagcccttaaatggcccctcccttttccatgcaggacatctgtgacctagcccgagaagtcacacagcatcacttccagcatattctcttggttacacaggaccagctcctgcatagggtgggaagggactactcaggggtgagaataccaggaggcatggttcatcgaggggccatctttggagactagctctcatggatgttaaaggcagcggcttgtgagctgcagaaatgggtgaccggattttgcacgttttttgagaagcaaggggaggggaaagttaacttaatatgggagggctgcaaaagttgaggcacagcattttttccagtaagcttggccgtctttgctgagccctgcacgatgcagccgttagcaggctgggcaatgctttgctttatgaggcaattattccaacacactctattcaaaatacacattagaacttaaccttctgaatcctcaagtagcatttttatcacccaccattagaaaagagatggagtcagcatatttccccccctttttatgatcgggtatcattaataaagcattgggcaaggaccttctcgcaattcctcgggataatttgtgacacaaaaggcgttctgtgatacaatggtctgttgacttattcaataacagaggaaacacatggattgttttaaaaaataaagccaaggaattaaacaaccaaacggaatatttcctttcaacaatgggaacgcacgctcagagtagggatgtgatgctattggctatgcataactagaaatgggaagttaatatggaatttctaattggggtcacatgctaatgaactccctcttcatgttagttttatgccgcttcagaaatcttttatcatatgcttaaaaatttatgggcagaaacattaatgaaaatgaggcgtgaattggaaatcgtgtcattatggagatgagggtggcccggcattgctgattttcaaggaggtatcttttattacctttttttgagaactgagaaatgatacaggtaaaattaatgacaaggcgtattctccatcctgacataggcagcatggttctatgtaaagttataaaagtttgattttaataagattttgaattaattataaggagaatattaatcataatggacagtcatttttcagaataaaacttcaccatctaagtaatattatagttcttaagtgcataaagataggcattttcttttttctatcggctttgtcttttcagaaattaaaatccactttttcagactacgatggattggaaagcctgggccttttcatctgtgaaatactcgctcgatttcagattgtacttaaaaagtacctctctttgctaagctcaggggacaggcagattttgtgaggccatgtttatgtggagggagccagtacagtcatattaaactttttctgtttttaatctctcagaaactattgttttcaatacatctgataaccgtcacatttgaatggattttcagaaagtcgttttgtggggtttctaagagttgtacttcacgcttatcacagcagggatgaaggcagaagttggaataaaatcttgtttctaggcctgatctcaagggagtatctttttttattttttattttttaccctctctcattctgtgtgcatttggacccaggtctcagtgagtctgtggcaaagcaggtctccctcaaggctgaacaggcaggcctctgtaacaactgttccagcactgactgagtggttacgttaaatattaaaagctgaggctgggcgtaatggctcacatctgtaatctctaaacttggggaggctgaggtaggcggatcacctgaggtcaggagttcgagaccagcctggccaacatggtgaaaccccgtttctaccaaaagtacaaaaattagccgggtgtgttggcaggcacctgtaattccagctactcgggaggctgaggcaggagaatcgcttgaacctaggaggcggacatgtagtgagctgagattgtgccattgcactctagcctgggcgacaagagcgaaactccatctcataaataaataaattaataaatgccaagaaagccagtgcccttaaacaaaggctgaaatgtaacaaaaaccccccaagagttttgcctaggcctttcctaggccttgaaacatgacaagataataaaggaattcttaacaggacccatttaggattaaacaagtgtattgggggtctgaagaaactccccaggtcttgagaaataagttttttgggtttctaaaggaactccccacacctccatgatttagcaggagacaagagaaggataatcatcccagcacctggacccatttagattaagtaaatttactgaggctgcagaggaaggtcttcaggcctcagatcttatagatgagaagttaatcacttacgtctttagacgaatgcacacttacaggtagacatatagcttagaagctgtataagctctggaaaactttctaattttaagttggtctggtgatatttcccaggccttctccctgtacccggttacaggaataaactcccttgtctcccagttctcgtgtatgttgttattgggccacgagaataagcagcctgaccctcagtttggtctgggaacaactcttcaggagtcacctctttcttgtatctgttcccctgtgcccttcttacctccttccaaactctgcagaggaggcccccgcctgccttttttcctgccttctctccttccttcctctgttctggagacaggacatactcttgcaggaccagcatctcctgtctctgacgggcccactctctgtactgtctctacctgtcaccactgcaagagggtacagaactcagactttgagctcttcaatcatcatatccctgactgtagggattggcccagggttgggtacctgacccaaacaaagtcaaagagattaaatgcctcaggtccgggtgcagtggctcacatctgtaatcccagcactttggaaggccaaggtgggcggatcacttgaggtcaggagaccagcctggccaacgtgatgaaactccatctctactgaaaatacaaaaaaaaaaaaaaaaaaaaattagctgggcatggtggccagcaactatagtccagctactcaggaggctgaggcaggagaatcacttgaatccgggaggcgggagttgcagtgagccgagatcatgccactgcattccagcctgggcaatagagactccatcacacacacccacacagacacacacacgcaaaagaaagaaagaaaaaagaaaagaaagattaaatgcatgggatagtaagctgataggatgtccctgagctgctgatggccattttctcagaacctggggagaccccaccagaggagaggagagctaagcaatgcagacagtcctggccatgcaagtggagcccctgggtccctgcgtccactccagaccgtgttcaaactgtagtaatttcccagcgctgctatagcaaatagccatgaacttggtgacttaaaacaacaaagattgttgcttttgttatcagaaaggggtcccgatcaagatcccaaaggagggttcttggaaattgcagaagaaagaatcagagcgagtccgtaaagtcaaagcaagtttattagacgagcgaagaaacaaacgaatggctactccataggcagagcagctctgagggctgctgattggctactattatggttatttcttgattatatgctaaacaaggggtgaattatgagttttctgggaaaggggtggggacttcctctggaggtgaggttccttcctcacctttagaccatatagggtagcttgtgattgtttcacggcgtttttaaattgtcatggcactagtgagagtgtcctttagcatgctaatgcgttataattaatgtataatgagcagtgagagcaaaccagaagtcactttccttgccatcctggtttgggtgggttttagctggcttcttcaccacatcctgttttatcagcagggtctttatgagctgtgtcttgtgcagaccttctgtctcatcctgtgactaagaatgtctaacctcatgggaatacagctcagtagctctcagcctcattttacccagcccctattcaagatggagttgctgtggttagaaggcctctgacactttcatgattctgaaggtcagaaatccaaaaatcaggctgtatccaggaccatatttcctctgaagtcttgataggagaatccctcctttctacttccaaatgctccttggtttatggcagaatgactccaactctgcttgtttgcacatggccttctttcctaggtgtgtgtcagacctccctctcctttctcttacaaaaagactagtcattggcccaccctaaattcaggacaatctcatcttgagatccttagcttaatgacatctgcaaagatcctacacattcataggtagcaagggttaggacttcgacttatctttttaggagataaattcaacctgctacaacctgtgcaactttttctgttacatatatgacatttcccctgataaagcagcctggtttaatatagccgcagtgtgtccctggcatcctttcttcttacttcagaagctcagaggtcaaaagcaccttaaagttcattcaattcaacctgttaacatgaggcttggagccaggagctcatgcctacctataatcccagggctttgggaggccgaggccggtagattggttgaactcaggagttcaagaccagcctgagcaacacagtgaaagtcagcctctacaaatagtaaaaaattagtcaggagcagtagcatgtgtgtgtagccccagctaccttagaaggctgaggtgaaaagatcacttgagcccaggagatggaggctgcagtgagctgtgatcatgccactgcactccagcctgggcggcagaatgagaccctgtctcatggaaaaagggaaaaaaagaaaagaaagtgagccttgggatggggtgatttgggtgggctggggtggggttgttggatcttgctttgatcgctcagcagtttgcatggcaaaggagaaaaagaatgctgactcccagccaagaatcagctctgtaaaccttggatttgaaacacagtcactgtgtgaactgcccaagtcaaatgctccaggcccaccttccctctcctttactgaggaagtccgagattcacctctgggtgcaggactctttggggttctggctggtagttgccacccaagcctagcactgctattttttttcggagtccgtcatgccataattttctgtaaagaggtagcatcaaaagcagcatttgtgttggcaaaaagctagcccatcttagggtctttcaacagtgacttttttttttgttgctcttgttgttttaaaataagtggggttctcagctttgagataatgggaatgaaatcgaacctctatttttagaattaaaacacacacacacacttgaaataaaaatgtgttgttggacttctaccaaatggttggtgacaacataagttatctcatgctgtctgaaccactggtcagtaatgagatacatgttagaggatctgatttgtttgcaaaggagtgaatgactcacttgcaatgtaaaatgtacattttggctgtgttctgtaggatttcaactataggccatcctagaaaagcaaaactgtggggatagtaaaaagatccaggggtgccagagattatgtgggagggagggatgaagaggcagagcatagaggatttatttatttattttattattattatttttttgagatggagtcttgctctgttgcccaggctggagtgcattggcgcgatctcggctcactgcaagctccacctcccgggttcatgccattctcctgcctcagcctctcgagtagctggggctacaggcgcacaccaccacgcctggctaattttttgtatttttagtagagatgggatttcactgtgttagccaagacggtgtcgatctcctgacatcatgatccacccgcctcggcctcccaaagtgctgggattacaggcgtgagccactgcgcccagccccggatttatttatttacctatttttattttcttttttcaacatgaagtcttgctctgtcacccaggctggagtgcagtggtgcattctcggctcactgcaacctccgcctcccgaatcaagcgattctcctgcctcagcctcccaagtaggtgagattacaggcatgtgccaacatgcctggctaatttttgtattttttagtagagatggggtttcaccttgttggccaggctggtctcgaactgctgatctcaagtgatgcacccccctcgacctcccaaagtggtgggattataggcatgagctgttgtgcctggcagcatagaggatttttagggcagtgaaaatactctatgtgacactgtaatggtggatctgtgtcgttatatattggtctcaacccacacaatatacaacatcaactgtgaactttaatggaaactctgctctttgggtgattgtgatgtgtcagtgtatatggttatcaactgtaacaaattgcacctctggtagggggttttgttaagggtgaagctatgcctgtgtggggccagtgagggtatatggggaatctctttatacttgctgaattttctgtgaacctaatactcctctaaaaaataacgttagtttgaagaaaataaaaatacattttgacaaactcattccttcccaggatttgcaaaagctgatatcacaaagggtgtctctgatgaggtaaggtccggaagcacttgtccctgcaattcctgttggagagcctttaagaacttctcagcagggctgtttgaaaagcttaaagctaagaaaggcctttgtctaaaagagcctggttgaaatccctgctcccagctccttgctgtgtgaccctgggcaagtcactccttaacctcctccctgacttaagccaggctaatccccatctctgcggattaaaggagataacagacgccaggcacttagcagcgagtgtggcctatcctacgtgcttcataaatgatggtggaaatgattatgattgttgctttattatctctaggttctcctccttccctggagtctgggggtggcagtgttatgtagcttcttcctaggtcatgaggtgggtttatctagactctgcctccatggttctcggggccaagggcaactgtactgctgcagattgctgtggtggtagattctgggagaggtgggtggtgtaaatcactaatgaaaaggaaagcattgctttgcactcatttgggtgtaaaaaatggagaattcaggactagaatgaccaaacataaacaaatccaatttcctttttcttttgttgtgtgtgtgtgtgtgtgtgtgtgtgtgtgtgtgtgtgtgtgtgtatgatggagtcttggtctgtttcccaggctgtagtgcagtggcgtgatctcagcttactgcagcctcccgggttcaattgattcttctgcctaaacctccccagtagctgggattacaggcgtgcgccaccatgcctggctaatttttgtatttttagtagaggcagggtttcaccatgttggccaggctggtgtcaaactccggacctcaagtgatctccccaacttggcttcccaaagtgctgagatgacaggcatgagccactgcgcctggctgacaaatccagttttcactgagttctggaaaatgtgagtccagtgactatattatctgaacttaaaaagtagatgtgattggctccaaatgggaatgataataatcatgtttattatcctggggtgctttctccatagcaagtactcacttaggtcctgttcattagtcagtcttttaatctgtactgaaataggtgctgtcgcatccatggggataaggaaactgaggcatggggggattaagttgtttgcccaaggaaatgccgggaaatagtagcagagttggcatttagcatcgggggatccagtgccaggtttttaatggattcacttagggctttggaatggggagtaaatgctcaaaatggagcgtatcatagaaaatcggagatacgttttcttatcttagaaataagaacctggactttgaaggtagtgatttttactctatcacggggttctcaaccatagactgggggcctaaaaagcacataaggcatggttccactaaaaggagacatttacgctcttgccagaggcttcctatctctctgagccagctgccttcccctctctgtcccagcttctcacatagggccacatccagggccaaggagggtaaaatgagcctcccgttgactgggcactcctgcaggcactgaggataaaatgggagtgaagggagagcaagttttggctctcagagcacacacagtctagtttgaaagaaataataagtcatggcaggacagccaggaggaaggggtacatgaccctggggggtcttccagaggtccctgggcgaggtggaggggtgagctcattctgccatccacggagcatgatcacagtagcttattaggtggcgagaggggcggacgggggaagactgagagagatggatcgagttatgcaatgtctttgagaaagaatggaagatacgttagttaaaaataaggccaatggactggagaacatggggtcacagagcaagaggcaaggtggaatgatgttgctgttaggcatgagatagtgcaagctgggctgaagtgaagcgaaattgatctaaattacacctgtgatgagaagtcactgtaactctgcctgcctctatctgtctgtctgtctatctatctatctatctatctatctatctgtctgtctgtctgtctgtctgtctgtctatctatctgtctatctatctatccatccatctatccacacatccatctatccatgtatccatctattcatctctccatccatccatccatccatccatccatccatccatccatccattggcctacctattatctatttgcctatatagacattcatccatcatctacttatacatccctcttttatttctgtatgtacctatctacttatctgtacgtgcatccaccctccatctatccatatatctatacattcatccacccatcattctatttgtctatacactcattcatccattacttatctatttaaacattcatccattcatcatctatccatgtgtttgtacattcacacatccattttctatctatacattgatccatctctccatccatcatccatttgtttatacattcatctaccatctgtctgtctgtacactcatcatttcatcatccattatccatccattatttatgtatggatctgtctatacatccatccatctaccagcagtggggttggctctcatgttccttgagcagggaagagattagagggagctgaagcctcatgggaaggccagttgaagccagttccaaaaagtaatgacatttggagctaggattaggatgggggcagtggataggataggagcagtggatagacgttatttcagaagaaaaacaggaaccctttcatttgctgaatagactgacttgcttatgtgtttctcctacacctctttacatgtcatcagcttctctagttcaccctgcccctcagtactcagtacacttcgctgttgaacagcgaagtgtgtgttcagtaattatattgctcttctaagggcctggttcaagacattgaacacggtaggtccttggtcaaatgggtcttctttaattgtttgtgcccatctgcccgtgcagctgtgggaccctggggaatgtgtgggaggcagcaggtgaccaagccctgaaactaagaatgtaaggggacagggtttagaagcaaccagacatacttcctgaagaattgggttgtcagtctgaaaaaagatgccccaaatcactgctccaattcctcccaccaactgttcagctgccccgggtgccagaaggataaaaacgctcggggagagaggttggcagttctgctgatgacagcgggaaggtgctgcctctgctcttgtaaggaagccatgtgggctcacagtgctgggaggtgcttgggtctgaccctcggatgcatgagagagccactggaatggatctgtggctctgaacttgcaaccccgcacagacaccaccgctagactcggcctcagggtgggaaccccctctccgtgggtgtcctttagctctcttttcagttcagagtgactgacaggcttttctctggttggtgcctttaactcagcaaagacccccaggcaagctgtcacttggagagaggatatttgaaaagcagcctggtgaaattagcagcgatggaaacaatgcaaacatttcatttcttttccttcttttttcttcacttatttttcctccttcatcaggcattttaatactgtctttttttcctggtctcatctcacgcagctgaaataaaagcatgctgcctgacgctatccggaccgaaaaactgaggcttctccctgctttggctgaagttctcccatagccgtttcctgagagcagtcttaaagatttagaagaggaagtctggcagggaaagtctcagaatgatgtgaaggtgtagatgatggattcctcccatcctgtcagtttcagtttgcatttacacaacgtgccaccatcccacaggactcgaggaagcccacaaggtgctggcctcccatcgagtacacatactaactcctgttctcatggcagctggcctcatctccctcctctccctcctctttgcctagtaccttgtaaagtagctgattaccttcattagctcagaatgtattaatccaggtttttttgtttttttttttttaaagaaaacctgcaggtcttctggcagctgaaggctactcttgactcttggctctgtgtcaggattcacataataagctcattagaggaaagttcccagtcccacagtgaccagattagtgggtgctcaggatgtgtactttgagggaaggaagatatctgagcaaagtcagaatgttagaatctcccactttttttctcctgtagttaatacagttcccatccgagaggtgtcaagagcacttacaggagagaccttctcctaatgcattggttaagagtactgcgtgtgaacttattcagtccacttttagctgtctgtccccaaaataggtaacttaacttctcttaactcctcactacattcccagtccttcacctgttatgtgagaatgataatgaagttcttgggaagaccttggagattatggattttaaaaatgcttaggcagttactcaacgaatcctatttagtgcggggtcaggattagggtgcattgagggaggcagtgtcatgcagtgattccatatttaacttaaaaatttggatattttgttcatgatgcatatttcacaatgaataattgtgattttgtacaacattacattcaaataaggtggccgggtgtggtggctcatgcctgtaatcccagcacttcaggaggccaacgtaggtggatcgattgagctcgggagtttgagaccacactgggcaacaaaatgagacctcgtctctacaaaaaataaaaataaaaaaaaaattagttgggcattatggtgcatgcctgtagtctcagctactcgggaggctgaggtgggaggatggcttgagtctgggaggcggaggttgcagtgagctgaaatagtgccacctcactccagcctgggtgacagagccagaccctgtctcaaataaataaaaataaggtaacgtatcttaattgctgagctctctggtgcccccttcagttgtgttgcctcatcctcgttctggccctaattctgagtgtcagccatgtgtgaaccattgtactaattgatgggtatgcaatgttgtgtcacttgagactctttcagtagtctgtcatagatttcccacatacagaaatgtcacacaataaggacacgtgttattttatgtaatataaagtccttacaagcctgggcagcatagcaagaccccatttaaaaaaaattagatgggcatggtggcatacacctgtagttccagctacttgggaggctgaggcaggaagatgatttgagcctaggggttcaagactgaagcgagctatgatggtgtcactgcattccagcctgggcaacagaacaagactctggggggaaaaaaataaaaaagaaagaaacaaaaaaccccaaaatcaaaaacccatgaaaaaccaaaaaaaaagtcttaacagaataagaaggcagggtactttcaatgacccaacaacatcatcacctagactatttctgtcctttcattttctcagtatagtggtttgacacttaggtttgtcttttctcagttgcaagacaggtagtgcagttcccttaatgtttcactgacttagtctgctcaggctgctacatcaagataccttagcctgggtaatgtatcaacaatgggagtacattgctcacagttctggaagctgggcattctaagatcagagacatcagtagattcagtgtccggtgagggctgagtctctgccttataactggtgccctggcgttgtgtcttcacatggtggaagggaaaaagcactccctcctgcctcttttggaagggcactaatcccatttgtgagggctatgacctcatgacgtaatcaccttctaaaaatcctagctcttaatactatcatgttggatattagatttcaccatatgaatttgtggggacatatacattcagaccatagccccctttaacctgaattgggtcttatgccctgtctacaaaggagactggcaaaagtgactacttggaatattcagcatcaatagaagaaagaaggctgtgctagtaagagacaactgcagtaaggctcaaagacctttgtgctgtgctgttccatttgtctgaaacacatgcacacaggtgcacgtgcatacctacccatttcctcctgcccttatttgatcatagaatgtttaacagtttccttcaacagatatttcttgagaaccatactatctaatctgtccaagacataatgatgaaaaggacacatgcgtttcctgattggatggtagttataatctagcggaggaagacagacatttgacaattgagtgggtctactaatacataggaaggaaattattgggaaaaagtatccgctatacagagattttaaaatatagaaagaggtgtgctaaaaggcagctgaattgttatggggatgggattcttctggaacaccttggggattcatatgtaagctgagataggaaagcgaggacatgtcagccacagaaacatccatggaagagcaatccaggcagcaggaacagatgactcagcctaaagtggggagtgtgtttgcttgtttggggagcagaaagggaagggtggtgtaagatgggtttggaggggttggcaggggtcccgcagtgcagagcttttcagattgcaatatgaagagagagagagagagagagttggtgtgtgtgtgtgtgtgtaccactggagaattttgagcaaaagaaatgtgttcccagtttacattattaaaagatcaccagctgttacatggaatatggtgtactgattgggggcggagaatggagtcaaacattccaattaggaagccattgcaatagtcctggatagagatgactgttgttggggttagggtgttgttagcagacctgtgggagtgtggacggattggggacatcgtggagatgtcacttaagtggagtgtccacagtcctgcttctgttgggtgtggagggcgagggaaataggattcaaggctaagagcagagaagtgtctgatggaagagtctaattccctgcagtgatccgctggtaccctttacatcagcagcctcagtggggtggtgagatgggaactggaccgacttgagatgcgggagaatgtgaatgagcatggagtccgtgccacaggcaatccctgcacgcaagttttactgtgaagtgatatagaaagaagaggggaacagagagggtcaaagacttttgtttccttaacaaagagatatattacagcatttttttcccattgtgctaaaaagcacacaacatctaaccatcttaaccatttgtaagaatatagttcagtagtgttcagtatattcacgttgttgtgatagagatcacgaaagctttttcatcctctaaatctgaaactctgtatctattaactctgtaactcccctttctccctctccccagcccctggtaactgtcattctactttttgtctctatgattgggctacgtttgctaccttgtatcggtggaattatacagcgtttctcctttcgtgactggcttatatcacttagcataatgtcctcagggttcatccatggtgtaggatgtttcttcgtttttcaaggctaagtaatattcccttatgtggaatggatacattgtatttatccattcatctgtcagtggacatttgggttgccgccacttgttggtgtctgaatagtgctgctttgaacatggggatacaaatatattgcagcagatttttatactgattggaatgttctgggagaagtggagacattgatgatgcaggagaacaagcagaaaatttcaagagcaaatgctttggggacagacaacctgagtggagggctggccttgatagagatggaggcagaggtggtctcatgcgaaagtataagtgggagactccaggggaaacacaagggaggctgggtagatttgatgtcgagtgggtaagaaaatttctgttcaaattcatatttttttcaataaaaccagagacaaggggccggatgcagtggttcatgcctgttatcacaacactttgggaggctgaagtgggtggatcacttgaggtcaggagttcgaggccaacttggccaacatggtgaaaccccatctcaactaaaaatacaaataaaaatagttagcccagcacggtggtaggcacctgtaatcccagctacttgggaggctgaggaagtagaatcagttgaacctgggaggtggaggctgcagtgagctgagattgcactactgcactccagcctgggtgacggagcaagactccattgtctaaataaattaaaaatttaaaaatagagacaaggccatcagctttgagagagtgtgtgtgtggtggtggggggcggggttggaggatatcaggggttcttccccattaatagcataaatgattaacagtaagtacttggaatcaagttgatgcattttcttatgtgccatgcagacaaaataaagctcagctttgttgtcagacaaaagcagcacttattacaatggttggcatttcagagataattcaactataagagataataacacatcagtcaatcaggaagcattcttcccagtgatatcaacagaattacatgcaagtaatagactgttgtggacccaactaggaattttcttttgctgaaatgctcctatttctaggagaagctcaacgttgatttttcagcttctgtttggagagtctgtttatttctttcttcccgaggggattgtaaatggtgaggactttttattgtttttgacagttatcaaagaaacattttttttaaagctggaccattgactgaaaaataaacccatttgggatttttcgagtaaagtgtgttgaatcatgtttgtgatactcacttttaagttttggcgagcataactgcactgtgttacccattaaccggtagtttttaatttttatttttttaagttccagggtacatgtgcaggatgtgtaggtttgttaaacaggtaaacgtgtgccatggtggtttactgtgcctgtcaagctgtcatcaacgtattaagcccagcatacattagcttttatccctaatgctcgtcccctccatctcccagcagaccccagtgtgtggtgttcccctccctgtgtccatgtgttctcattgttcagctctcacttttaagtaagaacatatagtatttggttttctgttcctgtgttagtttgctgaggataatggcttccagctgcatccatgtccctgcaaaggacatgatctcattcctttttatggctgcatagaattccgtggtgtatatgtaccacatttttttattaatccagtctatcattgctgagcatttgttttgattccatgtctttgcttaatgggggatagttgtaacccctatgaatgcagagaggcatgtggtacagtttgagttggtgtcattttagtaaataacagtccagtttgtggtgatataaatcacatttttttctttttcttttttttttttttttttttttttttgcgatagagtcttgctttgttgcccaggctggagtgcaatggtacaatctcagttcactgcaactttcgcctcccaggttcaaggaattatcctgcctcagcctcccaagtagctgagataacaggtgcgtgccaccacgcccagctaattgttgaatttttagtagagatgaggtttcatcatattggccaggctggtcttgatctcctgacctcaggtgatctgcccacctcggcctcccaaagtgctgggattacaggcgtgagtcactgcacctggcccataaatcatattctttatttgcatttctggaagaccatcaggagggtagtaacatttattaaatgtccctttccatatttttcttatctcttaactgaaactcaccagaggcaggcaccagaaaaccccctgtgtttgcaaaccttgatgaagtttgccagtcactcccttggcttgtagtccttttacttccattttactcgcattcagtgctccctggaaggtgtttctttctgcaaatagctgcgtgagaaatccagcatgtcctggaccctccctcttttaaaacacttttttaaaaggattgttctaaaagaatcttcctctgcttctgcttctaattctggaagaaagggtggagctaggtgtgttcacatggtagtactttttcttttgatccaattgtttaaaaatatatggcagaataaagaggacgggaaaacctcaacaacacctcaggagtcagagagcagaggaaggtgtttcactctgtgcagatcctggactagctctgtgggttcctgtgatggtactgaggtaaagagagtgaagcatctgcccgacgcacagaatttaagaggccaccacaatactcaaccaagaagaaatcatgtcctttttttattatttttttttttgagacagggtctcattctgtcacccaggctggagtgcagtggcacaatatcagctcactgcaatctccgactcctgggttcaagcgattctcctgcctcagcctcccaagtagctggcgttacaggcacataccaccatacccagttaatttctgtattttttagtggagatggggtttcaccatcttggccaagctggtctcaaactcctgacctcaagtgatctgcctaccttggcctcccaaagtgctgggattacaggcgtgagccactgcacctggccgcaagtgcccatatgttgatagcacctgggagaaaattgatcaggtgtgtttttcccacttgacagatgaaaagactgagccacatgatcagaatttcagcccaagttcataaatatcttcccttggaacatcaatttatgattagcactgctcatatgctcataggctgaaagttttctactcctatgacccctaaagtgtacttggtgggtaattaggagcttgctgagtgaataaagataatggtaatggtaataatagtaataaaaataaaactagctgggtatggtggtgcacacctgtaatcgcagcactttgggaggctgaggtaggtggtcacttgaggtcaggagttccagatcatgctggccaacatggtgaaaccccatctgtactaaaaaatacaaaaattagccaggcatggtggtgggcgcctgtaatctcagctatttgagaggctgagggaagtgaattgcttgaacccagtaggtggaggtttcaatgagccaagatcgtcccactgcagttcagcctgggcgacagagtgagactccgtctcaaaaaggaaaaagaaacaaacaaaaaaactagcattaactggtgctttgctatgatttctacaggagttacaagagttcttatatgagcattctaattattacataggggaaactgaggcacggggcagttaagaaactcacctgtactgagaacaagaatttgaacacaggcattctggctttagaggccacactctaaatttctcctctatccttgttctagcattcagtcctatccatgaatacatgaagcaaatatcattttcagaatccagtttccagaggcgagcatgttttatacatctgtggctattggttttgttccaggaaaggggtcctgatttagaacccaagagggggtttttagatctcacaccagaaagaatttggggtgagtccacggtgcaaactaaaaaagcaagtttattaggaaaggcaagtggtgaaagaacagctacttcatagacagagtagggcgttcccgaaagtaagaggaagaacgcatccaccctaggtacaatgtttatatatatatgatatatatatcatatatatcatacctatagcatacatatcatatagcatacatatcatatatatcatgtatcatacatatatatcatgtcatacatatatatcgtatgacatatcaatatattatatatatgatatatgagatataaatgatctagatcatatataatgtacctatcatatgatgtatatcacatatatatcacatatgtcatatccatatcacatatatggtgtatatcatatatatcacatatattgtatattatatatatcatatactatatatcatatatattaaatatcctatatcacatatcatatatatcacatgccatatattgtatatcatatgtatcatgtatcatatatatcatatatatcatatatcatgtatgagatatactttatcatatatgatctatattttatatatatatcatatatatgatctatattatcatatatatgatatatattatatatatcatatatatcatatattatcatatatagatcatatatatcacatatatatgttttatcatatatattatcatataatcatatatgatttaaaaagatcttgggcagatttgctctgctacaagggtttgtgataaaggattaattttcttaattattgtgttttgcaagaattgatattatgatctttgaagcaaaattaggaatgcctttgttctctagataccgggatatctggacactcgcaagtctggttctgtttagcaaacattatttacttgttcccttaaccatacacatctagaggccaggaatgcctgacttcctgagaatgcagcccagcaagtcccagcctcattttccagccctcactcaaaatggagtcactgtagttcgaagacctctgacaattggacacacgtctgtggttcctaactcaggacagatggatttctgtggactccaagcttccaaacggcaggcccccggctggtcatctctttagctctggcactaaccgagtgccaagcacattagcacttggtgaatattgattgaaatgaattgaaattgtgggtggaggaaggctgaataaaggccatttctctgaagaaaagaaagaaaaagaaagtcatcttatcccgtagtcagtgtggattgcaggcacctttggcttatttgcagtatcttgaaaagctgcttcccaatctggtctgagagaaacacgtgagctgaggggactctctagggagatcccaagaggaaactgcctcttccagcctccccagggaaaaaaaaaaaaaaggcaaacctcctttcccaatgtggctgaatgtgtctttgcaagacactcagcattcttgtgtgtttattttctgggtcccccaagccccgccctccctctaacctgccccgtaccccgccccccttcatgtgggtgtcaattacagctgactttgcaggctccagccctgaacacaacagccgggcatgatgccctgggccccatggcatacggcagtggaggtaattagccagccttgactgggccctcggttgcagttcgaaatgcttcttgaaaaacaagtttctagccttggagagcgtggctttgtacttgatagatgttctgaatgtctttattgtggtactatgcaagaaattgggattcttttatcccggtgctctattttgggctggtctttataattagatctaattactcatacagacgtcatgaggacaatgacagctacctcaccgaacacatgatatctggaagaatagttataagcccttggtgcatatttacttattacgttttcattacaggtaggttgtattattatctccattttacagaaagggaagctgaggttcatagaagttaaagtaactcactacagtcatagagcccctttctcctttctatattctgggtattaccaggttgggtgccttccacatattttctcttgtaatcgttttaatgtcctcatgatgattttgttgtccctttcttaccgacttggaagctgaggttttgccaatgtaatcaggatgtgataaatctcagagtaagtttggaagaaggattcgaaccccagatttgaaccccagtggcctgattctggagttcatgctctgtggctacaatacattgcctatatcgggtaacaaatgccttcaatccccttcgcgcagagctgcttcattgcatttttgccctgatgatgctttcggatgctgcagagtgcattggaagggcacagaggcctggggaccacacccatcttggtggagagccccaggctgccacctgtgctaaggcaggcaaactgttgactctttctgacatccagatacaacttctgaggagaggagataatacaaaagttattatgaaagctagagagaatctgtataaaatagcaccaatatgttcaacatgatgattatgggctcagataaaattgtaccaaaaatcagacctgaattcaaatcttagttctagtgttgatagtattcaggaagttgaaaggttatttaaatccccaagtctcagttttcccacctgtaagaggtgaataagagaaaaatacagttaaatagtaaaaaccttagaggattctatggggtcctgtctgattaaacacgcaggatataatagcattcagttgagggtagctattagctatcagtgtaattatgaaaacattagttgaacctgagcactttccattgtgcgatagacccactaaattaaagttgaagaaagtcctttgaacagaagaaattacagtgatttacagcatctgttcttcccccagtacctttctattgattgaagggctgtatgttgtagttaattaaaatgaatatcttcaattggatacagcaatgcttttgcaaaagaagagatagcaggattgcagcacagtacaggggtgtgactctttcattcacagtttggggagctcagaactttcttttgggttgcagaaataagttatgtttcaatagaattcaaataaataaacatgtgaggcgttattatgcttataaatttgaaggctgtgatcattcctcctaaacagtggatgaagattttctaaaaatgcaaaaatcatctcagtgggtattccacccttttctcctgcctacagaaatgccagatgcactcaggctggtgttgggctctgtgatgtgtttgctttgtgagcctcctgggcatctaggtgtggccacaggacaagatcttgtcaaagagatggaactgccagtttctgagaggtctctggggaagctttcattttcctgttggagtgggtaccttctaacaccgtttctccttcccagccttaatggtgtcattatagtgttaacggtggggctacagaactggatatataaccgcatggcaccttgaccctggtgttagagtgtagtagaacagtcacagcacaggctggacgtatgtcacctgagaaccttaatccctcttcaattaagcctccgcagttaggatttctattatttgcatccaaaagcaattctagctgatataacttgaaaaattaccgcaaaattttatttcctatacaaatgtgctgtgtcaggtgtgagtgtgtgcgtttatgatatgaacaatagttcttccgttaaatattacctattcgttttttgttccagatgaggactaacatgtaaccatttcttttgttttctaatcttatctttttccttcatgagagtttacttgccattttcaaacacagaaagatatgtttacaaaagcaaaaaacttgtcttcttatgttgaaatttttctggtgtttgtttgcattcctaggcccactggttatccatgaacagaaaagtgttttccaagctaacatttgacatgagaatcaaaagcgagtattgaaaaacagctttaataaaatggaggtggcaggttttagctgaaaaactccaattatcagaaggtgttggtatttctcaaggaagaacacaatacagctaaatttctgactctcccggagataatttggagggagcaatgtcatcaaaggagggcagattatatgtgggaagaaaatgttcaggaatggagcaggtacagtagctcatgcctgtaatcccagcactttgggaggccaaggcaggcggatcacttcaggtcaggagttcaaaaccagtctggctaacatgttgaaaccccatctgtactaaaaatacaaaaattagctgggcatggtggtgtgtgcttgtaatcccaattaatcgggagtctgaggcatgagaatcccttgaacctgggaagtggaggttgcagtctgccgagatcacgccactgcactccagcctgggtggcagagcaagtctcagtctcaaaaaaaaaaaaaaaaacactaaaaaattcaggagtggtgagatccagtacttttccaattaagtaaactctttttttatttttttaattttaaatttacaggtacacttgcaggtttgttgcacagataagcttgtgtgatgggggtttgtggtacagattatttcatcacccaggtattaagcctagtactcattcattgttttttgtgattctcccctcctcccaccattcaccctccaaaaggcccctgtgttttgtccccctctatgtgtccatgtgttctcattatttagctcctactttacttttctgtttctgtgttaatttgctaaggataatggcctcgaggtccatccatgtccctgcaaaggacatcatcttattcttacttttggatgcatagtattccatggtgtgtataaaccacagattctttatccagtgtattagtctgttctcatgctgctaataaagacgtacctgagactgggtaatttataaaggaagaagattaaattgactgacagttccacgtggctggggaggcctcacagtcatgatgggaggcaaaggaggagagaagtcacatcttacatagtggcaagccagagaatttgtgtagaggaactcccttttataaaaccatcttgtcacatgagagtcagtatcctgagaacagcacatgaaagaccagccctcatgattcaattatttcccgcctggttcccccaggacatgtgggaattgtcagagctaccagtcaagatgagattggggtggggacacagccaagccatatcatccagtctacactgatgacatttaagttgattccacatcttggctattgtgaatagtgctgcagtgagtatacgcatgcatgggtctttgtattacaatagaactttttattggcacatgaaaatacaaataagcctccaaatagtgtgtaatacaatttctttgaaccctcgtgttttaccttacaaatttatgtaaaattttcgtagtttttcatgatatactcatgttggtttatataacaagaatgtggcccccgcaccaatgactaaaccaaattagtgatacgaagagttatccatgtttatggtattggattgtgtattctctggcatccaatttgagaaacctgagaatggtcctgtggttggctatcaggtacccggggagaaatgtagctgctttcaatttgaaaacccttttccaggtaacaaagattgacctacattattccattttgatctttacagaaacccattcccattgttggccagcatgtcattttgacttttgttggttttattagtgagaacactgaatatcattccagagtcagggctctgatcctggagcatcagtcatgtctacttaagtcctttcattgcagcgagctccttctcattcgttcatgagagtcgttgacgaggtggatcctggagtagtctcagacggcctcgccctctgttcatcatccttttgatggaatctccctgttagtagttccaaatcatagttaccatgagttgaacagttgtttgtaccaggagctgagcaaagccctttcttgcacattgtcacattgagtattcacagtaaatgtaagaggtagatttactgttatctcattttgaaagatgtggaactggccaggtgcagtggctcatgcctgtaatcccaacactttgggaggtcgaggcaggtggatcacctgaggtcaggagttcaagaccagcctggccaacatggcggagccctgtctctactaaaaatacaaaaattagctgggcatggtggcggatgcctgtaatccaagatacttgggaggctgaggcagggagaacaacttgaacccaggaggtggaggttgcagtgagataacatcatgccattgtgctccagcctgggtgacaagagtgagactctgtctaaaaaaaaaaaaaaaaaaaaaaaaggaaaggtgtcgaactgaggctcgagcattttggtaagttatctaacatcacattactggggagtggccatgctgagacatgagttacagttttccagataccaaaactcttagctgttccattgacagcttcctagcagggatagcacaccaagcctctaccctttccttgggtagtactcatcctctgactctgtcacccgctttatcctcttggtgatggcagagctacttggaatcactagtaactgcattagaatgatgtgcagttgtctatccaatgagttttgtccattatttctttagccgtaaataaatgaggaaagtacagaattattggtggggggtggtctttgaaaaagctagggtgggagaatatcgagaatgatataattatctatttgctgcttctggtccgccgacttgctggctttttttttttttaataggattatggaagatgaaaaggaagcgcttacttcagcttataagagcaatgtaagcaattttgcattgcactcactccccaggggtggtgtgaacatgtttctagtaaattaaagtatcataaaagcattggcaacatggcaacttttatattaatttcttaatttttcgcaggcttaattataaatctcttgggagaagaggcaaggcctgtcggttcctgggaaaacagtgttgcatctctaggcttgaaggtctgctcttctgctcagaagtatgtgtgctgtgatgtaggctgggtggctgctgtaggttgcatgcactacttgtgcctagtgatggtagtgatgccctgtggacaagacattaggctgggaggcccatgcatgcagccaagtggagagagtgctcttggacaaggtgttgtgtgactcttagcatgtagtaatgtgtcataagagcacagtctctgcagtttactaagtgtaaaatcctggatctggcctggagtggtggctgaaccctgtaattccagcactttgggaggccaaggtgggcagatcacctgaggtcaggagttcaagacctgtctgatcaacatggagaaaccctgtctctactaaaaatacgaaattagccgagtatgatggcaggcgcttgtaatctcagcaacttgggaggctgaggcaggacaattgcttgaaccctggaggcagaggttgcggtgagccgagatagtgccattgcactccagcctacgcaacaagagtaaaactccatcttaaacataaaataaaataatcctggatcctcctgtactacctgtgtgacctagagaaatttgaccagccctttgatctgtgaaatatgatggtatcaatgtcacctgggatatgcatgaaaaagcctacatcctacagcactactgagcatcctcaccagcctaggggtatctccagtgagacgaaccatcaggaaaacaatatatatccctatggatgaagccactgttaggcaggttttgttacttgcagcctaaagtctcctcacctttagtagtcactaaattagaatggtgcagcagcccattgagttccggattcactgaatgatggcatatttatgctggacagaatcttagctctgcccagtgagtttaccacatgccttctttacttaatatttttattattattttgagatggagtctctgttgaccaggctggagtgcagtggtgtgatctcttctcactgcaacctctgcctcccaggttcatgaaattctcctgcctcagcctcctgagtagctaagattagaggtgcatgccaccacacctggctaatttttgtatttttagcagagatggggtttcaccatattggtcaggctggtcttgaactcctgacctcagctgatccacctgcctcagcctcccaaagtgctaggattacaggtatgagacattgcacccggtaccttctttacttacaaatctactgtaaggaaagtgaaaaatcaggagggagggctccttgaaaaacccagggggaaatatcctggctttgctggccagatcccaatgagttagttcctctggatttcatttctcaagattctggaatttcctctcccctctccttccttcccctaccctaccctaccctaccctaccctcttctttcctctgcccttctgtagcatagtatggtttaaaatgtgatcacattctattttaatcatggaaagatttttttctctggcctcttgtcttttctgggctacatgccacatattggtagggaatatatcttatgtttttacatgtccttcaattaattttgaaatattaattttatgataggttaacttatgctgcacacacatacatacacaaaagatatatggtcttataaataggtatggctggacaaggtgactcaggaggcttaggcaggaagatcacttcagcccatgtgttctcagtctagcctgggcaaaatagctagtccacatctcttaaaaaattaattaactaaagaacactatgtgtggaaaatactggattagaaagattagacagggctgggagcagtggctcacgcctgtaatcccagcactttgggaggccaaggtgggtggatcatttgaggtcaggagttagagaacagtctgaccagcgtggcaaaaccccatctctacaaaaaatacaaaaaagaaaattagccaggcatggtgtcaggtgcctataatctcagctactcaagaggctgaggcataagaattgcttgaacccaggaggcagaggttgcaatgagcttagttggtgctactgcactccggcctgggccacagagcgtgagttcatgtaaaaaaaaaaaaaaacagaatttttttttcttttttctttttcttttctttttttgcaggacttctttgtatctttaatctgcaaatgaatgtgaattgtaaatctccatggagtgatatagaataaggcactttccaaacttaccggacgagagaaattttttttcataaaacatcttgcagaaactcactttagagaacctgcatatctccaatttttaaatttcatttgtctttttaaaaatgtgcaatattttttcaactttttattttgaaaaattctaaacatgaaaaaatgtaagacttgtacaataacccttatatacgtctaccagaatcaccaatttctatttttatttatttatttatttatttatttattttctgagacagagtcttggtctgtcacccaggctggagtgcaatggcatgatcttggctcactgcaacctgtgcctcccgggttcaagcgactcttgcctcagcctcccgagtagctgggattgcaggcgtctgccaccatgtctggctaattttcctgtttctagtagagacggggtttcaccatgttggccaggctggtctggaactcctgacctcaagtgatccccctgcctcagcctcccaaagtgctggtattacaggcgtgagccaccacgtccagccccaggctggttttgaactcatgggctcaactgattcacctgccttggcttcccaaagtgctgggattgtaggcatgagctcctgggcctggcccagaatcaccagtttttaatattaaatattttttactgcatttgctcatcctctgtctccctcttttccttcccttcctctccctccccttctctctctccttctctctgtctttttgcaaattcttgatgggtatcttttcgtgacaagaaagaaggtggtctggatgccagttgcctcctccacttgcctttaagaaaataactgaacacgctgtagggcaggtgcctgtatgtttcacttgtcttggttgatgatttattataatcccatcttagaatcctagaatctcaagttgcagagggacctgaaaggttatctaatccaccccttgctcacctgcccaccccgcctgcattccctacccatgctttcgaatgccatttattgtgtttgccagggtttgttggttagtccattctgagtggaatgaaacttgcaaataaggccttgtggagagcctgccctcttcctgggcatcatccaagcgatctattagcagcttccatttatcagcgtcttgtgtgggtgtagtgggcctaataatgggagctcagtcagagagcagcattttgatagaggactgaagtgttttgccaagtcttgattacccataataacaagaatgaaaactttggccctggttatgcacagatttattgaatcatggaatattcatgctggatggaatcttaggatcatctggttcagtccctgaagttttcaaaggaggaagtgagtggagaacaagagagaatgagtagtttgcctaaaatctcatcactaccatggtttctgattccaggcccaggttatctcccgagccactaggcttatctcaggacagcaacagaaaacttttcagacacacacacacacacacacacacacacacacacacacacacacacacagaggcatgccccacacattgcaaacataatcatatacacgggcacatctatacataagcataggtgggcacaggtgcacaaacttacctgcaatctcattcataaatggaatttccattccgttgaaatatagctcatgactggggcctccactgacctgcagttcacaatctagaagtgtgaacttggaaatagaaactcatccaaatacatgaccacagtttattcacctgtgtggtgcctcttgcagatagcagaggggaggagaataagaacgaacattgtaaggctgttgggatgactggtccgtggagtgacagaagagattagaaatccaggtttattgggagggcatctcaaagcagccacattttatccctattcgggtcagaaatgaaatgtttatgatggctggaatgagatcccacaggaaacttgagtttactaagtgccagctaggcagtctttccttgcataatcttatatagtcgtcatcatggttatgtttctggtgaaaaaaaaattagatatggaaatgctattagttaccccacattccacagccagtaaatggtaaaaccaagaatcaaatgtggatccagagagcactgagaacataggaatacataaaaaagaaaacgcatttcaaagagaaacacagcagagttttagaagtgtcctaatggtaaatctccccctaaatttttggaaacaaatttgcattttcctgctggtttttccaggcaggactttctcctctcagcaaagccctatagacctttagagcagtgtagtctattggagtttcctgtgatgatgaaagtgtttataatcttactgtccactgtagtagctactgtttacttatggttattgagtgagttaagatatatgctggatttcaaagacttagtatatgaaagtgttttaaatagctcattgagagtttttaaaaagtcgattgcctgttgtgataacatattgggctaaatatatttttaaaattagtcttacctgttttattttttcttttccctttttattttaatttaactttatttaattttattttattttatttatttgggaccgagtcttgctctgtcccctaggctggagtgcagtggtgcgatctcggctcactacaacctctgcctcagcctcagcctcagccttagcctcctgagcagctgggattacaggtgtgtgacatcacacccagctaatttttttttttgtttgtttgttttttgttttttgttttttgttttttgtttttgtttttaagatggagtcttgctcattgcccaggctggagtgcaatggcataatctcggctcactgcatcctctccctcctgggttcagtgattctccctgccttagcctcctaagtagctgggattacaggcgcccactaccatgcctggctaatttttagttgagatgggttttcccatgttggctaggctgctcttgaactcctggcctgaggtgatccacccccctcggactcccaaagtgctgggattataagcgtgagccaccgcgcccggcttttttggtatttttagtagagacgggatttcgccatgttgggcaggttggcctaaactcttgacctcaagtgatctgcccgcctcagccttccatagtgctgggatttcaggcctgagccactgtgcttggcctctttttccgttttaaaatgtggctattagaaaaattttaattgcatgtattgcttgcattatttttctcttgggcagtatggatctggataatttgtctatgaagatatatttacaattatatgtgcttctctctgtctatctgtatcagtctgtcttttgaaggacattttattaaacagcattatatagtgtataatgaattacaatttgttattatttaacggtgcaattagaactttttttccccacatattggtacctgtaagttaatatcatcctctgtaattattatatagcaatctttagataaactgatttattagttgcctatcaatttatacgtagtaccagggatggatataaagaatagaaacaggtacagctgtggagaatgcaaccatttaagagtgggacagaagttatctctgcagactgtctggagaataaagaaacaaaggaacagaagctacttggaacagaggtgttgatggaaatgaagaaatagaagtccctaaaaggggtcaggtgctgtggctcacacctgtaattccagcactttgggaggctaaggcaggtggatcacctgaggtcaggatttcgaaactagcctggctaacatggtgaaattccatctctactaaaaatacaaacattagccaggcctggtgatgggcaccgtataatcccagctactcgggagtctgagacgggagaattgcttgaattcaggaggcagaagttgcagtgaactgagaccgcaccaccgcactccagcctgggtgacaagagcgagactctgtttcacacaaaaaactgagaaaatgtctgcaaactacttgaaatatgatttagctcccctgtactagaatatactcttcaagaggtcagatactgcttgtttttatgtgaacatatgtcaccaacaactagtaaacgtgcccaacacacagtagggattcagtaagtatgtgttgaagaaatgaatggaatggcaactctcaattttggatttctttgcttcgcattttaaaaattctgatagtggccagatagcggtagctcacggctgtaatcccagtactttgggaggccgaggcgggtgggtcacctgaggtcaggagttcgagaccagcctggccaacatggtgaaaccccatttctactaaaaatacaaaagttagccggtagtggtggcgcatgcctgtaatcccagctattcaggagtcggaggcaggagaatcgcttgaacctgggagttggagtttgcagtgagttgagatctcgccactgcattcccacctgggcaacaagaaagaaactccatctcaaaaaaataaaaattctgttagtattcacatagaaggatgatactgtgtcccataaaatatatccaagtttaccaagtagaagtagcatatattacattggtgcaaaagtaattgtgctttttgtcattactttcaaaggcaaaagccgtgatcagttttgcaccgacctaatagttgtgaatgtgagcttggacaagtttcttaagcttactggtcttccatgatcttccatgtccatctcaggatagttcgagcccaaactgcttgttaaggtccaggaagctgatacatatcagtgagtgctgataacagaaaaccatgctatgtctagttgctaattttttaagataagataaggctgtcattttttatgatagaaaagtgactctcgcaatttattgccaatgagaaccaccacattgttcattgattgcatattttaaagctctgtgtccagatattctaatttactacatcacagttggctatttctggccaggcgtggtggctcacacctgtaattccagtacgttgggaggccaaggtgggtggcctgcttcagcacagaagttcgaggccatcctaggcaacgtaataaaattgtctctccaaaaaaaaaaaaaaaaaaaaaaaaaagacacggtggcgtgtacctttagttccagttacagaatgaggcaggagaattacttgagcctgggaggcagaggttgcagtgagttgagaccatgccacgtcactccagcctgggcagtagagtgagaccttgtctcaaaacaaaagttggctatttctgcatttctccatttcagctaatacatctgtatgtacaggccctggacaggatgcctgggagacattaataagcaacattccgtttgggcctcaggaagctcatatcccataggggaactgacacaatgattagcacaaatacgtagataagtccttttgaaaaatgaattcccatgtgattattatcatcaacccacttctcaaatgttttttctttttgttgttgttgttttgagatggggtcccactctgtcacccaggctggagttcagtggtgcaatctcagctcactgcaacttccacctcccaggctcaagccatcctcctacctcagctgtccaagtagctgggaccacaggcttgtgctgccattcctgcctgacttttgtagttttggtagaggtggggtttcaccatgttgcccaggctggtcttgaactcctgagcccaagcaatctgcctgcttaggccttccaaagtgctgctaggattacaggtgtgacccaccaggcccagcccacttctgaaatgttaatgtgcataggaatcacttcagggttttgtatcaaattcagtttcttagatcctacccacagagtttctgattcaatcaatagggtggtgggggtgtcccagatcctgtgttgttaacaggactccctgtgtttcagaagctggtgctatgaaaactacaccttgaaaactattgtcagagtgtggtccacctctagaaaatattggcctgtctttgccagagtttcacccattccttagggagaacgggtgtagctgtctcttcctttccagtctgtgtaggaagcagaaccaagctcatagagaagcaattttttgttttttttgagatggagtctcactctgttgcacaggctggagtgcagtggtgcaatctcggcttactgcagcctctgcctcccggattcaagggattttcctggtgcaatctcggctcattgcagcctctgcctcccaggttcaagcaattctcctgcctcagctttcccagtagctgggactacaggtacccaccaccatgcccagctaatttttgtatttttagtagagacggggtttcaccatgttggccaggctggtcttgaactcttgatctcacgtgatctgccttggcctcccaaagtgctgggattacaggcgtgagctactgcatccagcctagcaattccttaagtaccttgttcatcccttccaaggtcagcttgggttcctcagtagtcgtggtatttctctgtggtgtaaaatgcacataaaggacttaaaaactaggtaagaaggcagttaaggataaaagttacacaacttcaaccatattctgttagagccacaaagggcttcagaaaccagctaatgattttagagaaaagatggcatgagtccaagaggtcacatgatctacccaaggtcacttgtgtctagagtttttgtgtatcatgacatgaccaatggccatggcccagaaaggctgattccttccttttccaaaaaaaaaaaaaaaaagatttgtgatacttcaatatattcagtgcccaccgcccaagcacggtgtcattcacaaggaattataatggatttcattgtagaatgcagactccttcttcccaattacttctttgctttaaacataaagccgagagcctgaccctgggaatagttcttgtctgaatttctgatagattttaatttcgcagctggagcctggtcctcacagtcattccctaatttcttttgttagtctactgcattcatctttggttctgtgtaggatccatagatggactgaactgtaacactgactttcttttctttgtctcacttgtcaaataaaatcatttgaggctgaatggtattgatagctgtgcaatgacttgttgctactgtagaggggaccctgcacacaccttcctgggagtcatgtttgttgttcaaatgagtcttctgagaatcaggatctcttgaaaaagataacacatcagtagtattaaaaactaacgaatagggcaaatcctcatttagctcctttcggtaataaattcatttgcttgggttcaggatttgtagagcatattctaaatgcattgctggctgagggatccatcagagtgggaaggggagatggggaaagccatcctgttgcattgaagaaacggaatctgtgatcaggaaacctggttaaaggtcctttcccctttgtaattttattctacatagggaggcaagagtggtgctgcaacatatggagagacttgagtttaattgttaaaattccactcagccgggccacttcttcactgtgatttgcactatttagcatttgtgtgcattaggtaatatatttaatgtttctccctccaatccaatttgcgtgtgtttggcagcagcccagctccatgggcatggggcaggggagatcataaatctgccatcctggagcatggaaactgtattgctgcatttgatagtatgcttgcatgaacactccaaaatgcttgtgaagcaataccacctcttccccgaacgtctctcagggacaacattaatgtatctcatattgtattgattgtagccaataagtgcctaaatgatttggtgcaaggcagaaagattatgcagggaagaggggtggaggtggctttagaagaagtatgtggtttaattactggctgaatttcctcaatccacctccccctctgggagtttaacaaacaggccttagtgcactttagctgttgctgacatctgttgaaatgatatctgcccgtgatgaggggagtttgggaattgcgcttggggtattggcgggatcagggagccacaggaagctcctttccagtctgcaaaattagaaggaggaaaacactgcagtagtactctaaggttaagctatggagagcacagttttatctaatggaattctgccttccgacttaatgaagccatcttcatcttaaatgcagggttggatgtaagtgtctagagtctaatgatcttaaagtcccaggtgttgataacaaacacagagttgagctgaaaacatgaatagtgcatgggcaatgcttcaggcacccaattgtaaaaaccacccccagctctctctttttaatgccatgctaagaactgttaggaaacttcacagtttttaggtaaacaacaagtgaccgattttcttgcattttttaatagaagcaaaagaagccaaaacctagctaaaatttcatgttgggtccagcaccaggaagaatgatgctgtgtatctgctagtgttttgattacatcaataattcaaagaaagtgccatccacttaatctcttttatgcctctccacccgaaaggatcctggttgtattctgaaagtcctgaagctatcatattccacagctttttctgaaatgtgttattatgttatgcttgaaacatttatatatgttaccgaccaaattgcatggaaacgatttgctttcagagactgataaaaattcacttttgatggtagacacaaggtgagatgttatcaaaacaaaattccaaattaacttggatatctctatcagaacatatccctgattgggcatgtgattcttgcattattttgtgtgtgtgtgtgtgtgtgtgtgtgtgttggtcattgtatttaaaaatgtgtttgcatacgtgtgtatatggatatatatgtgccaggtattaggctggctaattattgtgactaaaactctctggggttaagtggaaaattaaaaattcagaacaaccatagtctgttatctgtcacctgtaatttaggctaatatctcaattctcttgttatggacatttctcttacagtgtggctttacataatgggaattggatgtaatgtgatcaattaattagagcatatgatttacattagtcaaacctgtattgattacaaaatgactatgatctgaaagtagccttgtgtgtgtgtgtgtgtgtgtgtgtgtgtgtgtgtgtgtgttagaagtggtgatcctgctttgtatgtggccaacttggggagggggatggatttttcactttattattgtgacgtgtgatagacctatggggtgttttaaaattcccaagcaaataatcttgctggtggtgacagaagaggaaggctttgaagaggggtgtggtggctcacgcatgtaatcccactactttgggaggccaaggagggtggatcaccttaggtcaggatcaccagcatgggcaacacactgaaaccttgtctctactaaacatacaaaaattagctggacgtggtggtgcacgcttgtaatcccagctactcagaaggctgaggcaggagaatcacttgaacctgggagcacagaggttgcagtgagccaagatcatgccaccgcactgcagcctgggccatagagtgagactccatcttaaaaaaataataataaaaaacaaaaaaagggaaaggctttgaggtaaaagctagaggtacttacacttgagattggttcagattttataactcaacagacaagtatctgattctctgcatcctcctatgtttgaaccataaatttattagaaagcatatataggaaaaaacaacccagttcctttgagtctgaaactttctagtccctaattactttttcccattggaagtatatttatagcatacaaatctaaacttctcaacttaccttgataactggtccccatgttgatggccatggggcgtcttgaagaccatcagtgatccaagtatattccattagttttcatgtcaagaacattttattgtatcctaattatctgaaacttggtcatctgaaataacatggcagttcccgataaatcattgcctttttgatttcctagccatcttgaatacaggaaggcttagtttagcctttgcttttaaattcatataaatacaatgatattgagtatctctactttagaataacactgaactagtactgggatttttaaatttgatattcggacagctctttttctgttctgtggttttgtgcatgtgtgtgtgtgcatataaacatgtatgtgtgtgcatgtataggtatctggatacacatctagatgtgtttatatctagattgatacatacatgtgtatatatatccatcctcctatctggacacgcatatttgttacttgaaaataagtagggcttgcatacattgtagttactattgtaagtgctttccaaatatttaactcatttactagcccaacgactttatgctttaggcactgtattttcatttaaccaatggggacagtgacgcacaaagaagctaattagtttgtctgaggtcacagaggtagtaagtggcaggattgggattcaattgataatgcagtgcttcatacaaataatgctttgcaatttttgagcacttttctacatgtcagatagagggatttaattttttactcatttgatttttatggccagtctatgagttgatttccatcattgctagtttgctgaatgggacacagaggctgaaagaataacacatctgtagtcacagagttagaagctgatggaactgaactttgcatccaggaaatcagactagagaatttttaataaattatcaagaaagtttataggcagcattgaagatttcctcatcagctttatacatatgtatatgtatatatgtttatatttatatgcacgtatttataagtacattgtagacagatgaaaaataataaaagcaggaagtaccttttgttgtgttgactgtgttttgcccccaaacttacaactctcaatagttgtcttttctgttagctgaaattaaatagagaattatcttagcattttcccccaataactttaaggtttcttaagagatggtaagtccctttgaagactagagtgatttgactcaacttctccttctagtaaaaaaaagtctgccaccaatacatgtttatatttgttaaaataacatacttatcagtatgaagtggcatcagcaaaaccaatgacttaaaggtacaattgtcaacctatgttgaaaatatgttgaatttccaagagggaaacggctgcttgatcagagttcatttatatccacgagcattgcaccagcaataaactttaagttaatgttaacaattttaatttgtatcttttaattgttgaagtctgaattgctttccaatttcccacagagtttaatgtgtatgcaaattgcacagccagaaatttaagatacaaaagatagactgcgttttgcaaacataccataattattgcttaatttttaaagggtctttctctttgtcagggtattgttcggtttcttgaaactgaacagaagaaaacttttggttaatgattagtataaatcttgtaatggaacttaattgaatattaactttgttgttctcacaactacagactactcaattccctgtttctctgaggtagggtttcttgctctgttagtgcaaataatttgtcttctagtaatagcaggaaacagttatcagaacaccagtttaattgtctgaaggttgtgcactacatgtaagctcttagaaaaaggttaaaagaattctcatgtctattttaatattatatttcgtaatcatttaaacagcttggcagtcctagcaaagtaaaaaaaaactaaaattgaaggtaaatgccgttcttttgttaaaattcaaggtaggaaatgctgagatttagaaaaaatatagatataaatatatgtacattatatttagtgtacaatagcatatgtagtatataattatctatttatttatttacttattgagtgtaaaatgaaagcagccaaagcagtacatttggtggattagtagtgatttagctatgaagcatttatatattcaaatatttgttgctaaatattcctaaagcctatggggttctagaaactggcttaggagaggagactgaaggatgaacaacactcattagtgtcttccattgtgttcaagtgtttacacatgaatccaagaaataataagatgctacagatggtgaaaactaatctgaagggggcaaaatgaagccagtgagacacagaatggtttggggatgggggcagttgtgttagacaaggttttagggaaaagatgatgtcagagctcttggcaatgacttggccctaccagaagcaagagacaaagttctaaatgagaacagctggttgtattgaagaaccaaaataggattttaatttggttatatcattgtgatcgatgacttttgttgctttttggtgtctccaaattgcaatcctgtttcacattttgtgttcctttccctcagactattccaagaatgaaggatgtttgatgatggctacaggttgtcttgtacagaaaacttaatatatcaggctctcttgagagagtaggaagggcattttattacagactccagtctaaaattccttctgagtactttaaaatatacccacaaatactggagtcatgtttcttctttttttaattaattaagtattattattattattattttgcgactgagtttcactctatcacccaggctggagtgcagtggcacgatctaggctcactgtaacctccgcctcccaggttcaagcgattctcgtgcctcggcatcctgagtagctggaattacaagcatccactaccatgcctggctaatttttgtattattagtagagacagggtttcaccatgttggccaagttggtcttgaactcctgacttcaggtgatccgcccgcctctgcctcccaaagtacagggattacaggtgtgagccactgagcctggcctttttattttattttattttattttattttattttttatttttatttattttttttatttatttttttttttagagatcaggtctcacttgttgatcaggctggtcctgaactcctgggttcaagcggtccacctgcctcggcctccaaaagtgatgggatgacaggcatgagccgttgtgcctggccaggagctacatttttactccagattcattggtggaccagagtgatttggtgatacttaaactcattctgattttttttaatttttattttttatttgagacggagtcttgctctgtcacccaggctggagcattctcagttgtttaatggtggttttaaaatgttttattatgaaaaatttcaaaaaaacacaaaagtagaatagtatactgatccctcatatgctttacagcagatttcaacaactaccaatatgtggccaaacttgttttgtgctttaatcttcttctcccttccccatcaatattttgaagcaaatccaaaatatactattattattaaatatatcagtatgtatattggaaaaaatgaaactttttaaaaaaagaactgtattgtcattaatgttattatgcctttaaaattagcaataggccaggcatgttggctcatgcctgtaatcccagtattttgggaggctgaggtgagcggatcacttgaggtcaggagtttgagagcagcctgagcaacatggtgaaaccctgtctttactaaaaatacagaagttaaccaggtgtggtggcacacacttgtaatttcagctactccagaggctgaggcaggagaattgcttggacctagcaggcagaggttgcagtgagccaagatcacaccactgcactccagcctgggcaacagggagactctgtttcaaagaaaaaaaaaaaaaaagattatttaagtaggtgtccaaacatcatattatttttaaagttttcagtacttacaattagaatatgagaattcttaaggaaaaaaaaagtactgtcattagcgttattatgccttgaaagtagcaataatctgttaatataagcaagcattctatcattgttcaagtctacctgataatcttacacatttttaaagttttattatcagaaatttaaacatgatcgatatgtctcaaattaaaattagtcgatacatctctcaagtttcttttattaaactggtaccacctccaactcagtgtttgcaatctatttgttgaggtcaccgggtcatttttatgcaacagtctctacatagtctggttttgctaattgcattctttcttctttatattttctgttgactggtggttaaattcagaagtttgatgagatttttgttcaattttgcttttggcaaaaacacataataagttttcttttctttttttctttctttttctttctttttttttttttttttttttgagacagagtctcgctctcctctgtcgcccaggctggagtgcagtggcatgatctcggctcactgcaacctctgcctaccgggttcatgccattctcctgcctcagcctcccaagtagctgggactacaggtgtccgccatcatgcctggctaactttctatatttttagtagagacggtttcactgtgttagccaggatgctctcgatctcctgaccttgtgatccgcccgcctcggcctcccaaagtgctgggattacaggcgtgagccaccgcacctgggaaacacataataaattttcttgtttacttccattaggaaccacataatgcttttctttattgaagtcctttttggaaatttttatcagtcactagcaaccattaccatcactcctttttcatttattagatagaatacttgtacagagaaaaatcttttactgattctttgcttaccccaaggtagagttcatgtgagaaaaataggggcatctgtatcttccttcatttttttccagttttcaaatccgtttgagttagtttgcttgcatattccaaaggagactaatgatcattctaaatgtccattctgaagctctgttgttggccagtgggaatgtctttctgctgtctccttgttcagatggatggagagattccttgctttgtgaggtgacaaggtgttcctggtcaacttatgtatttcctaccctggccctgactctgtgtgtgtgtgtttgtgtgtatgtgtatgtgtatgtgtatgtgtatgtgtatttgtatatgtatatgtatatgtatatgtatatgtatatgtatatgtatatgtatatgtatacgtgtatgtatattttgagatggagtctcgctttgttgccgaggatggagtacagttgcatgatctcaactcgttgcaacctccgcctcccgggttcaagtgatgctcctacatcagcctcccgagtagctgggattacaggcacgtgccatcacaccctgctaatttttgtatttttagtagagacagggtttcaccatgttggccagggtggtctcaaactcctgacctgaagtgatccatcctccttggcctcccacggtgctgggatcacagggatgcgtcaacacactggcctctattatttgtttttagaagcttttcagaaccaggaggcagctcaatttgggagattttgtgaacatctttattattattactttaactctgttcagcacttgtctcaacttttcttattaagtggggagtccccatagtaagcgggggtccccaaaatagaagatcagttctactttttttctcctggagtttcttcttgtgcacacgattgagcacgtgagtgaactcctggtgtttagagtgacagtatccctgggcatagttgattcagggatgggcatgtgatcaggtggaccaccgagagattcctgggggactttgctcttagacgctatggagaaatttttttttctcatggggttgttgatcttgttaggtgagtctagggttattgtggccatccacctctcagtgtactgacatgcaatctaagaaattaggaaagggaaaaatcttgatgctgtcacttgaggccctggatacagcggtgcatgaagttaatctatctactttggaactttgcaagcatgtgagccagtgcattttcttgtatcctctaaagctattttgtgtttgtgtgagcacatgtgtttacacatgaaattgccctgatatgaaggttttctgtttatccagcaagaaagagatttaaaaaagatcttttcaactattttcgctgggcgcgatggctcatgtctgtaattccagcacttgggaagctgaggcaggcggatcatgaggtcaggagttggagaccagcctggccaaaatggtgaaaccccgtctctactaaaaatacaaaaatttgctgggcgtggtggcatgcacatgtcatcccagccactcgggaggctgaggcaggagaatcgcttgaacctgggaggcagaggttgcagggagccgagattgcgccactgcactccagcctggtgatagagtgagggtccaactcaaaaacaaagaaacaaacaaaaaactattttcaaatagcactaagtggcttaaaatacacttcctgaatgtcggctttgtttgaggaatgtgttgtggtagatgctatataataaagggaaattaggctgataggagtttctctcaacatcccgatacactcagcgtgttaagataaggctagaaatcagaataacacaagacagaaacttaggaagttagaaagtgtaagaatgtaggaaaggcgatgaggtcaacattttattacagttattttctccaaactatgagtggatcttggtggtctttttttttcttcttcttttttctctgttgtgtttggtttcccaaagagaggttatacaatcaggccatgatttacaaagaatagtcttgcaggagcattgcgtaaaatgggtttaaagaagaatgaaagatgctagacagatcgtttaaaaaggagtttctgggccaggcacggtggctcacgcctgtaatcccagcactttgggaggccgaggtgggtggatcacaaggtcagcagatcaagaccatcctggccaacatggtgaaacccccgtctctactaaaagtgcaaaaattagctgggcgtgatggtgagcacttgtagtcccagctactcaggaggctgaggcaagagaatcacttagacctgggaggcggaggttgcactgagcagagattgcgccactgtactgcagcctggtgacagagcgagactccatcttaaaaaaaaaaaaagaaaaaattataaaagaaggagtagtttgtgaagccctgttaaatcctgctctcagggatgcatatttacaccctttaaaaataaaataaaaccagaggttgaaacaaggtattaaaatacctctggagaaaaactaacctcttccaggaaagttttgttagctataaactcaaaggttgatacatgtagcatcaaaggaacataggaaagcttagttgatgctgtaattattaaacacaaacaatgtaattaagttagtatgtattagaaaaaaacatgatatgcacatcaagtctaattttattaatagaactttttgggatgagactaaaggacaattccttgtccaggttctacttataaattgcaaagactcactaatggttttcagatgattggttatttggtaaattggctttcagtgggtcaatgaaatggtcattaggagaactgtcaataaatttatctgctttcttttaaaaaaacatcccattttcccagggtagaaatgaggggtttttttttttttttttataaaaaaagtaacgcttcacaaatttgcgtgccatctttgcacaggtgccataccaccttctctgtatcattctagttttagtatatgtgttgccaatgtggacactagaaatcagttttgttttgtacttaatagagcatctttttaaatcttatgcacagaagaatgatgcatagaagaatctgtaatgcataagaagcatcttatgcattatcttttgaatcttatgcatagaagaatatataatgcataagaacaacgcattatatattaattagattaaattaactccattcggatacctaaggttatatttgtgtattaaactcctcaacatcagggtaaaagcaaagacaacatggcatcagattctttgtccaccggttttatttagtctcagagacccaagctggtcagcatttggctctggtggagtcaccatagcctggatttgaaggtttggagcccagcccaggtttggaggatcagtaagttggtatgccagcactccaagagagagaccatctctttgtcatggacacgtcctagctatgtatctaaggtttattagtacaatgaatttctatttaatggctttaatttagaacagttttcttgaaagcctcaacattggtattccattgtctgggcattttttctatatagggaaaatatacaaaagccacatcataaccaggaagatgtatggtgagctggtattcaagaaaggagaagtagctgtgagacaccaaggattggctgtaccagattaagataacctaatccacgtgtctctataagtggctgggtcagctgttggaacctgttgggacagaacaggttgaatccttgagcaaagaggccaggtgaggtgactcacacctgtaattccaggactttgtaaggtgggccgatcacttgaggtcaggagttcgagaccagcttggccaacatggtgaaaccccatttctaccaaaaatacaaaaattagcagagcatgatggtgcgtgcctgttatcccagctacttgggaggctgaggcaggagcattccttgaatccaggaggcagaagttgcagtcagctgagatcgcgtcattgcactccagcctgggtgacaagagcgagattccatctcaaaaacaaaaaacgaaaaaaaacccaaaactaaacaaaataaacacatatcctcacctttttgtgtgtgggacatacagtatgaaaagatgagtgctaatagctttccccttacctttcaagagaacctaaagatacttgcctccattccagtcatcttcctccctttcaatgagactgtgttcttgcttgctttgggggagaaagactaagttgacttatagaatagagggatggcaaggaaacatcccaatacagtcagtatttcttgtggaaggacaaaaagagaaaagtttctgggttatgtctagaaagataattgacaggaatggggagaaggaacccagtaatggcaggtgaacgagaaaattggtacaatgataagtgttctgtaatttttatcttgagaaatggaaaagcagctcctgaaagatcctattagtgatggcttggtgttggtaggaggtggcttgacactcacagatagactttggtgttgcctgttgaacacaaacaatttcatagaatatcagcatcagacaaggccatctcaggactgtggtgggtcaggacaagacaagaccgctaggtgatcatgtctgaactcagtccaaaacatggaccttgcctaaatcgcaagatgaccattcatcttctttttctggctcacatgagtgactgctgcttcttcaccgactacagctttcgcttcactaaattcttcccttcttctggataagaactatgaagatacccagtgatataattggtctttctgacagcatccaatccagagaaaagccccaattctttaacccctactcaggatcacgtaacagaaaggcaaatcctctaagaagctggacagcatcttactgagatactccgtggttcctcatggtatatgttctcctttgcaataggtagtaaaccctactttgttcaaatacaggtgtacatttaaacatctttggctagaggacatacataatgtcattaaatttatttatttatttatttttttttgagatggagtctcactctgtttgttgccaggctggagtgcagtggcacgatctcggttcactgcatcctctgcctccgaggtccaagcgattctcctgtctcagcctctcgagtagctgggattacaggtacacaccagtatacccagctaatttttgtatttttagtagggacggggttttatcatgttggccaggatggtctcgattttctgaccttgtgatccacccgctttggcctcccaaagtgctgggattacaggcttgagccactgcgcccggccaaacaagtttttttatgtagagacagggtgtctattggtcaggctggaatggagtgatatgatcacagctcactgtagcctcgaactcctgggctcaagcagtcctcccacctcaccttcctgagtaggtaggactagagttgggaaccaccacacctggcttggtttcgggttttatagagacaaggtctccctgtgatgctcattctgatcttgaactcctggactcaagtgatcgtccttccttggtctcccaatgtgctgggattacggacatgagccaccatgcctggcaattaatttgattaagaaaaagtaaaccctatgcagaagagaacacttagcaaagttaagtcacctgcccaagaaccctcagctcccaagcagtggaatcacactttgaaccctgccattttctgtctgagcctttgttctgcctttaacatcacctccccatatggacgcaccgtcttgtctcttccatgttttcgtagtcttagttttctaccactgccagaagtaccacacatttggcaccttgaaataacaaatacatatgatctcacggttctataggtgagaaatctagttggctcatctggtttctacactgtgagtttttctcaacgctgatgtcaatggttggctgtatggactgataaggaggctctgggaagagtccattttcaaactccttcaggttgccagcaaaatttatttccttgcagctgtaaagctgaagtctccatttctttactggctggtagcagaagggcttctcttagatcctgggagctttttacgtccttttgtgaagtgtggactcttccaactcatagtcagcaatggtacgaatgcatctcatccttgaaatctcattgacttcttctgccatatgtacctcattgcagctggagaaagtcttgtgttttaaagtgcttttgtgattagatgggattttccccaataatccagagtcatctccgtatttttaggtgcatacttttgataacatctagaaaatcctatttgtcatgtcacgcatcgtattgacaggttctggggattaggacatgggtatcttggggaagtggggcataaatttgcctactgtacattgttaaacaccctcccatcctccagccatctttgactgttttagtcattctttcaatgtaaatgtacgtttctactctttcttgtttggaagctcttctctttaacatgattttgcatgtacttttgctgctaatttcttgactatacagggtaaactcccatgaaaatcatctcatttccctacatgcaggtccttagaaactgtgaggatggggtaaggctgctgccattgaagcctgcacgctcctgtgcgtttctgtagcccacctagtggacacctcagcattaggaagtatcaacatggacttgtaagaaccttcatgctgtctcctcaagcttgctagctggggcctcctagtacaacaggtgccgtgagaaacacgtgaaatggcaacagatttcagaaatggtagcaaaataaaaccagtataatgttgggcattgtgtctctcacccaacttagcattatctatattcagttgagagcaaacttggatccagttttcagccacagctactcctcttgccctttattgtttcatgtacaagttctcactgaaaaaaatatatatccacagcataatcagaatagttgttaccgaagaaaatgtaacaggatgatatttttggcgaattggctttaatgagttttgaatgaatagcttaaagtattagaaagtaaaattcaggccaggtgcggtggcttatacctgtaatcccagcactttgggagactgaggcaggtggatcacctgaggccaggagtttgagaccattctggccagtatgatgaaaccctgtctctactaaaaatacaaaaattagccaggcatggtggcgcatctgtaattccagacactcagaagtcagaggcagcagaatcgcttgaacctaggaagcaaaggttgcagtgatctgagatcataccactgcactccagcctgggtgacagggcaagactttgtctcaaaaaaaaagtagaattcagtgaacaagagtaaataattcaagaaattcaaggttgatagctataaaaatgaaattccctccctccctcccttcctccctcccttccttcctcctcccttcctccctccctcccttcctcctcccttcctccctccctcccttcctccctccctcccttcctccctccctcccttcctccctccctcccttcctcctccctcccttcctccctccctcccttcctcctcccttcctccctccctcccttcctccctccctcccttcctccctccctccctccctccctccctccctcccttcctccctccctcccttcctccctcccttcctccctccctccctccctcacttcctccctcccttcctccctccctcccttcctccctccctcccttcctccctccctccctccctcccttcctccctcccttcctccctccctcccttcctccctccctcccttcctccctcccttcctccctcccttcctccctccctcccttcctccctccctccctccctcccttcctccctccctccctccctcccttcctccctcccttcctccctccatccctccctccctcacttcctccctcccttccttcctctcttgctctttctctttctctcttcctttccctctttctctctgtccctctttcttttttcttcttgtctacttcctctccttcctctccttcctcttcttctctcttttctctctcactctctgtctcttccttctttctctttctttgtacatgtataatttgaagaccctgcgccaagcagtctcttggaattagaagcaccttaaaatgaaaaaaatgtctcgccactgtgacaaatccacaggccttgcaagaaaccctgcagatcactaacacacggccataggaatatattgactgcagcccaagcacaggagaagattaatcaatccaacagacttgcattaattgtgaaatggaagggatgatgcgatcaatgataggaatgaaagtgcagcagtaacgatgccacatccagctaatccaataatggagaagctgatgtatagcatattggaattctaccgtctgggcacttgtcaccataaagaatatcctagaattatagggaaaaattgagcaggcagcagttgagccaacctaatcagcctgataccacagtagttctcttgattaaacactaaattaagtggcattcagctctgtaacctgcttgccttgtgaaaaataatactagagctaacgtgaaaagtttgtattttaatcaaagcaaactacgaatattaaaatattcctgggctattttggtgccgtttagctgtgaacaagtttaataatttataaatggttcttttgccattggctacaaggaaaaagggtccaaagctatattgggaggtaaggcttcctgtgctaaaaatcaattagacttgatagaagctcagagaactcttaagaaaaaaaaaatgcactcaagaggccctgggagaattcaaatttagttaacttctataacggtttgcctaagggcatgaactctattctttgctgcaaagcacgtgatcattccaggaggggtgagacttaatcagctgtgaatactatgagggtcccttatacatatatgtcattattaagtcctgaagctcaaatacacagacaacctagagctaaatggcaaattctccaggaccaagagaaaactgcttttcatgaacatttagagaacactagagaaagaacttacattgtgagcatcaaacccagtctggttagactttctgtacagactcttacgctaggacacacactggtgagatcttggtgattattatatgcattggccagtgagacctcttagagttgaccgagtccgtgagcatccgaggggctagatctctggtggccagtgaaggagatgtgggttggaaaaggagggagagacactgatcacatctccccttttttttttgtttgtttgtttctttttttgagacagagtttttctctgtcacccaggctagagtgtggtggagtgatcttggatgacttaaaccaatggctctctggtaccgcctcctgggttcaagagattctcctgcctcagcctaccaagtagctgggattacacttgcatgccaccactgcccggctgatttttgtatttttagtagagacatggtttctccatgttggccaggctggtctcaaactcctggcctcaagtgatctacccatctctgcctctgcctccgcctcccaaagtgctgggattataggcatgagccactgctcccggcccacatctcttttcttgagcagaagatagtgtgctgataaagttctcccaccaaagtgagtcttagcagggccttgggcaagaggataaattaactacttaggctgttctttcctgttatattttgtttgttgtttgtttgtttttatttcaagtcaatttgtggccttgccttttaattgaaagcaaattcatttttttttttttcctgggtgggaaagggtcactgaaagaagagaggccatcaggctgtgtcttacatagttgaaaagtcaaaaactgcagacagatttggatttatttgatttcaataattagcagtcattcgtggagtcctcataccattccagggctggttctaagggcttttgcaacattaacttatgtaattcttttaatgattctgaggtcaagatgctatcatcattttcactttgcagaaggagaaactgaagcccagaaagcttaagcaatttgccaaggtcttaaagagtgcaagtgtggcagatggggattgaaaccaggcgggctgtttgttgctatgtgtttttaaaacaggttgggccttccaagttggatttttgtttgtttgtttttgttgtgtgtgtttgtttgtttttgttgtgcgtttgttttgttttgttttgtttgttttttgagacgaagtcttgctttgtcgcacaggctggagtgcagtggcatgatctcggctcactgcaagctccgcatcccgggttcacgccattatccagcctcagccttcaaagtacctgggactacaggtgcctgccaccatgctcggctaattttttgtatttttagtagagatgggagtttcaccatgttagtcaggatggtctcgatctcctgacctcgtgatccgcctgccttggccttccaaagtgctgggattacaggcgtgagccgccgcaccgtgccccaagttgtttttggacagtgatatcagtcatgagaaatgggaaggagtgggatgcctttggatgatgttagctcaagtggtattgcatgctcttccaccccatcttctgcacatttctctctggaaatacgcccttcattaatcctctgacattggctaagtagatcatgatgtggtgttctgatcaatgaggtctagtccagtcactgtaggtcaaatcagattatccagacctccaaaataataagtggactttaggtcagacgtatggagtcaccaatgagaaacagcttcagaatccatccagcaaagatctagaataatcataggatgagactatgatcactatcatttattgaccatcactgaatgctgggagctcttgcgggtgtttttgttcaacttgcttaactcataacatcagcaagatgaaagaaattttcccagttttaaagatacaggatctgaggctgacagaccaaatgtctggcaggtgagatctcataactactagtgacagacctgggactgaatcaggtctcttcaattccatcaccttttgtctatgaaagtactcatccttcaggtttctgaggccacatgggtgtgtcataggcaaggagccttcaatcatagatgacatggaaagtcgcatctgtctcatttcccaagccatgttaataactgcctggaacagacagtgagaaaaacaaggacattggaacaccttatttctggtttcctttctctcttgtacagtgtgatttttaaatgctgctaacaaaacattggaacagaattgtgctccagaaaaaaatgagatccaacagacctttctttattatgggacaattaattttaagctgactttatcagcaaagggaggccagagtgacttgctttgtaattgttgggaagctgtgcacactggattagaggagaagtaatgtttcctttcaagttttgacccattttaacaaactgatatcttagtgtgttcaggctgccataacaaaatgccgtagactgggtggcttgaacaagagctatttattttcccatagctggggaggctggaagttcaagatcagggtgccaagatggtcaggtcctggtggaggctctctttgtggttggcagatggccaccttctcaatgtgtcttcagtggcgtttcctcagtgtgtacaggtggagagagagagaaagcaagccctctctttctctccttttaagggcagtaatccccttatgaggatcttacttttatgatgttatcttctcaaaagtcccatctccaaatgtctttagactgagggttagggatttcacatacaaatttgtggtgtaatgctctgatactcattggctttgtgactgagattgagccatttagttctctaagcatcctttctttggtgaaaaaatgcttgtagtccctactcacataggactgctgaggtaattcaatgaagtaaggtatgctaggagcttaactcagtgttctgctcatgttatacgtgcaataaacataaaccagtccctctcacttgaaggaaaaattgcccactttctgacccagagaacatgtgacaatgtctggagacatgtttggttgctacgactgggaagaggatgctactcgcatctagcagatggagtgaaggcatgcctctaaatatcctgcattacacaggacagtccccaaagcaaagaattgtctgtatcaaaatgttagcagtgctgatgttgagaaactctggtataacctatcattgcaacacaactactaatgttatattacctggaatcagggaggagggaggatgccattaacaaattatataaagtctgttttttaagagagactgtttttctctgttgcccaggctggagtgcactggcacaatcactgctcactgcagcctcaaactcccaggctcaagcaatcctcttatcttagcctcccaaggaggtggaactacaggtgtgcaccaacatgcccagttaattttttaaaaacttgtagaaatggggtctcaccatgttacccaggtcattcttgagctcttgatctccaaaaatcttcctgcctcagcctcccaaagggctgggattacagatttgagccacggcgcttggctaaaatgctatatactctattccgtacgtcagtattctcactaaaagaaggaagagtaggtttcaaggaacttgaggatgaaatatgtaacagtattcactcagtatattaaaaataaatacacaatgtcattggaatggccgatttattgggacaggcaattgtgtatgcagaataaatgctcaaaaagaactgtccaaggtgctgaaactttgacaaatgaaaataacctgttcaaaatgatgtgtaaactgaaggttttgtttgtttttgaagtggagtctcgctctgtcgcccaggctggagtgtgcagtggcatgattttggctcactacaatgttagcctcctgggttcaagcaatcctcccacgtcagcctccctagtagccaggattacagtcatgcatcaccacgcctggcttttttttatttttatttttttgtttttattttattttatttttttttaaagtaggggtggggttttaccatgttggccaggctgatctcgaactcctgacctcaggtgatccactctcctcccacagtgctaggattacagtgataagcctcccaaagtgctagaattacaggagtgagacactgcaccccgtcttaaactgaattttaaaggggataactgtctttgcaaaaatacatttaaaaggttgggaaaatatattttggatttgattctcagtctttcaaggtaatgggaatggaatcttgagtgagagagagtggatgataaactagaagccaagttctttaccaggttgttttttcgagatggagtctcgctctgtcacccaggctggagtgcagtggcactgtctcggctcactgcaacctccgtctccaggattcaagcacttctcctgcattagcctcctgagtagctgagattacaggcatgtgccaccacacccggctaatttttttgtatttttactagaggcacttttgaacatattggccaggctggtctcaaactgctgacgttgtgatatacccgcctggacctcccaaagggctggaattacaggtgtgagccaccgtgcttagcttctttaccaggttctatgcttcctgaatgcagggattctgtttatctttttcttgcattatggaatagcataaacttggggtctgagacagagttaagggtcagttcatgttctctttttcctttcttcttagtcactctcagtagtctggatttgttgtggtgacagcagcagatgcatccagtggcattgtgaaggcattagtatcattataggcgctgaggctatgggtgagcatatggcctgggactgcaaatcagaaactgctcgcattcctgggattgttcttctagactatggagtagatctggagcttggcttcttagccttttctgggcatcagaaccacctcagagttggcaaaaacaaagaaacttgagccgtattatagacttatggaatctgaatcttctggagtataaggcactgagcaggaagttttgctcatcagtgttcagacagaggctggggagaggaaaaagtgtttttcccttcccaaatcaagcatcaattaattctcaggactgctttggatagaaggttgttcacattattctgagattttggcttatttaagagcctattagacaccatttgtggttcatctcctcttgtttaaaaggctcttttgagcaaacaagaagtatttgaaatttttttatgactagcggtctagttattcacatttctattatgttccattccattcccaataattcattttaataacattttctttttttttcttaaagattttttttttctgactaataacattttctgatttgggtagaaagaaatattattccacaataagcaattgtgaaatactaaatttacttggctttaattacatctatagaggtaagcaacgtgtttcagggaaatctaacttctctttgaagggtaaagacccagttaattcatcatttacccattatttggtgtgataggcaacaccagtagttattgctgtgtggtgatagggtttctttcttggaaagactacacttcctagtcactcattgcagttaagtgagaccataaggcttgttcttgccaatgaattgtaggcttagtaaagttcatcacttctgggacaaagcatggaagagtgagacaccaccagacatgaccatcccttgccgcggtgaatttgaagtcctttgttgagatcaggaaatcgccatcaacatgtatccccaagtaattatgtggaacgggacctgcctcatccccaagatctgtctcggacatgtggtagatccttctgccatactattcaaactgaagactgggagttaatatggtgtcatggtataaactagcctatagagttgagttttagaagaagcctttcggatactgaaaacaaggcactgaacttaaattctgcagactggatttaaatctgggctcatgtttctcacttgtttcgggacgtaacctaagtcactgaactgccgtgataacagacacagccacagtgtattcagcacacctatgtgccaagcattgcacacagcgttttgcatatatcatctcacgtaattcctccagccacacttccacttgggtagacacgcctcacttggtggatgtggaaacaggcgtgatacacgatgcaaaaccagaaagtggaaatgctgaacttgaagtcacatgtgactgatgcctattcccgtatttttcttttttctaaagtggagttgattaaactgtctacttcactgggccgttttaggatgctgtgagcagggtaggtgacaggacgtggttacccgccaggtgaggttattgtgatttggtttcggccagcacttgctgcagagaacttaagactgtttcttttctggctgtcacttgaccctgtgtaccaaccttgaaatccctcactggcattttggtaaatttgtttcatgtttttgtcccatcagtagtaaaggtttcaccattattttcatttcctggttgagcgaccctctttctttcatgacttttggcttcatccttcagcctctttctctttttttattgttccatgttgctgtgagcagaactcatttttcaaaagacagatggtggcaaccctgttctctctaaataaaaaagcaaaacagctgttaaggtgcaaacagagtcgcggccagcaaatcgtatctgcttcaagtgttggcgaagtttcccttcagggaatgggagctatctaaacaaaatgtgcagcctcggctgtgctctgccaaggcccaagtatagaatgatggcaaataatggaaatttatagtgtactatagatccagcacctttctatcttggcgggtgcatatttaaatgcagtgctaacggagctgaaatttatggctctctaataacgataaaatgccatcagagaatgagataaatcttggccccaaaccttagcatgcaacgcacacactgacgcgcgcacacatgcttgtaaaatatagccagatactgctaactcaggagtctgcgtttggaagaagccaacggaacagagaaagtagaggaagtgttttatagacgactgcaaattgttgttttcatgaggctggggtcaaggtacattgtggcctcaggttgaaatgagtgttgctttgtctcatggctgatacatgcttgaccttggtgagggaagcttttccttttctagatgttcaatagcttttctcttcacgttttcacaaccctgtgacaggccaacttccaaacaaacactgatgaattatcaccctctgggaaaagaacatcgtggtgtgcttaagcgttttcttctgtttgtttatttatttatttgtgcattcattcattcagagagaattggagtcttcgaggcttagcaacaacagagagatgaaagacatttaccaaaatgctatatttgcaaactgtcggcgacgtgtgaattaggtgtgccccctttctctacgggcagttgtggtcttcagggaatggaattttacaaaatatcatttaggaggttgtcattcacgtttgaaaacaggcgtggccagctcctccagccaacctgcatgtacacccagctgttttctctctgtggagcatctaggtcttaggaagggaagcccatctggaaatctgtcttaagcccttgctgaatttccacgagccgtgcattcgtggatcctgcaagttagtaactacctgaagaagggggcattctctactggcttgcattctaggtgtttcctccagcttctccttatgcaaggggacttctaatattttgggcgagatgtttagtttcagtgagaagcctaacctccgggagttgtttcaggccacctccattaagagttagatacttctttctagatgcttctttatgcataattgtgtgtgcgtgggtgttcatgaatattgtcttaattgctcctgtttttgaaatacaacgtctaatccagtctatcattgatggacatttggattggttccatgtctttgctattgtgattagtgccgcagtaaacatacatgtgcatgtgtccttatagcagcataatttataatcctttgggtatttacccagtaatgggatgactgggtcaaatgttatttctagttctagatccttgaggaattgccacactgtgttccacaacattaggagatatacctaatgtaaatgacatgttaatgggtgcagcacaccaacatggcacctgtatacacatgtaacaaacctgcacgttgtgcacatgtaccctataccttaaagtattaaaaaaaaaaaagaagaaatacaacgtctacagattaaaacccactctaggccaggtgcagtggctgacgactgtaatctcagcacattgggaggccaaagtgggaggatctcttgagctcaggagttcaagaccagcctgggcaacacagtgagacctcgtctctacaaaaaaattaaaaagcaataaataaataaataagcaaagaagaagcaaaaagaaagcgttcttgttcagaactgaaaaaaactgttcctggtttcctagtttttagaagtgtgtgtgtgtgagtgtgtgtatgtctgtgtgtgtatgtgtaaagactgagaggtaatgatactgattgagttgaaaataaccattcctttgtaatatttctaaaattttttaggacactaaattattttatataaaattatataatattaggtggtttggtgtgtttgccttgtttaggttttgttaggttggtgcttgagaaaaaaacaggtagatttggaaaatgctgatgtttaggatgaaaagggatccaatttttcatataaaatgaattctttggagtaagaccttttagctgagattcatggacttcatgaaagtatgtgtgtgtttgtgtgagtgggagagagagagtgggagagtgcattcatgctgttgtaggttttgctaagagattttgtactttttgttaagttgtcaaaagctctcttgtctgaacccctgagcccatggtcctctctctcctcttgtttgtgctgtggatttgcagttactttacagttcgaatgaatgatctgttctgtgaatacgtagtttcattttacagttagaatgatgtgatcagggctgtgattcctaggctaggccattactgggaaaggtgtgacttggaccagaaaaaaagtaaggaagtgaatctcatgctaaagagaacaagcttggtttcaaacactgcatgtttatgggctttgcccaccaggtttagcttgtacaaggaaatacccacgccccaattcccattaatcctgaacatatgattctctctagctgttccacacctcccaatctgtggtccagcaatactgacatttttgcgtgtgttccaactaaaccctgctctcttttacctcccagcctttccacattttgttctctccacctgaaactatattccctttcttctggctctctcttttttttttttttctctgatgaagtgctgctaccctcaggaaggcgtctgtagtgttttctagatcagcttaggtgaacctttcatgtcttcctgtagcctccccacttccattgtcaaggtatttactacaattgtcatgtctcaggccaggtgcggcgtacccggggactcttttatgccatctttatacctctgtgtaaatctaaaatattttcttttttttctttgtttctttgtttctttctttatttcctctttttttagacagaatcttgccctgttacccaggctggagtgcagaggcacagtcttggctcactgcaacctctgtccgccaggttcaagtgattctcctgcctcagcctacggagtagctgggattacaggctgccatgcccagctacttttttgtagttttagtagagatgaggtttcaccatgctggtgaggctggtcttgaactcctgatcttgtcatccacctgcctcaacctcccaaagtgctgggatttcaggcgtcagccaccgcgcccagccaatctaaaatattttcaaaatataatgtttatgaaaattaaataaaataaggaatctaggtcaatatctgtgttttatcaaagcaaccagaagatcagacatgtccacataaagagtgatgaacttgtattaacagaaaaggaaatgacattggacactgtctgtgtcatcacactgcagagggaagaggaagaggaggagggaaatgtccttccctctgagaaccatgagctcagtgaaatccctgcattcccacccacatccttaatgttcccagtatccaccaccctgaccggcttaagtgagcacttaagaatttttctcgaggccagtcttgaaggctcatgcctgtaatcccagaactttgcgatgctaagacaggcaaatcgcttgaggccaggagttctagaccagcatggccaacatggtgaaatcctgtctctacttaaaaatacaaaaattagttgggcatagtggcaggcatctgtaatcccagctactggggaggctgaggcaggagaatcggttgaacctgggaggcagaggctgcagtgagcccaggtcgtgctactgcactccagcatgagtgagagagcaagactctttttcaaaaaaattgttttttgttgaataaatgaataaacgaagcatcacaggacaagggaaacttgtctcttctcagttagttgctgagtaaattgttgtttcttatgtgttgcgtcggcccccacctcatttggttactacttgagtcctcttggtttcattttattttctctctctctctatatatatatatttactttttaatatttaaaaacatttttgaatattttagtatttatgttcttatatattttaaaatatttttatttttaaatttgttttatgtatgttttttatatatttgtatatatgttttatatatcagtattaatttttaatataatttatattgtatatattttatattaatattttatataaatattatattttataaaatttataaaattttataaaatttttatatttataaaatatattatattttataaaatatataaaagtaaaatattttattttttataaaatataatattttataaattatataaaaattttattaaaatttttatttccctcagcctatttgcacagactggattaagtgtccatcatagtatttaccaagctttttgcacataacaaaaatgaccctaaaaacaagagtaacagtttttatttattgagcatgtactatataccaggcatgcttgaaaagcctttatagatttatttctaattcttgaaggtagttggtattatcttcattctaaattgccagaaccttctttctctctctttctttctttcttttctttctttctttcttttctttctttctttattttcttttctttctttcttttctttctctctctctctccctccccttccccctccccttccccctccccctctccctccccttcccttccccctccccttcccctccccttccccctccccttccccctcccctttcctttcctttcctttccacagggtctcactgtgtcacccagattggagtgtggtggagcaatctccactcactgcaacctctgcctcctgggttataaatgatcctcccacctcagcctcctgagtagctgggactacagacacacccctaatttttgtattctttggtagagacgggatttcaccatgttggccaggttcgtcttgaactcaagacattaagtgatccacccacctcagcctcccaaagtgctgggattgcaggcatgaaccaccactgcacctggccgtgaaccccatattcttaaagatggtagagctgggattcgaagtcaggtctgcttaaacccagagcatatcttcatgccccacatttccctctgtctctctgagtttatggagttggttagaaatgtcgtatttctttttctttctttatactccagattccctgtgaggtcaggaactaggcctttttcatgataaccctagtgaagatcctaattttgaaaacttatctaatatttattgggaagctgttgtgagccaagcactgcagtaggctctggatatattaggcccatccccgtatagagctgacatgtagcagatgaaagcagaaaaagagaaaaaaaggtaagtaggcaaaatgaggaaaaacgaagtcttagtatgggccaaacagtttcctaatgtttggtatattagctcattttatccatgagacaagttctattcttattgacctgattttatatccaaggaagctgaggggcagagaatttgaacaactgcctccaatgttcacacagctagaatgctgcagaactagggcttgcaccccattgtctcactcttgagtcttcattctttatcactaaatagacacagccaggaaggaggcagaatgggcagtgaaatgcttttgcagaagttggcatttaatgtgaaggttgaaaaataagaaggaatgaccatttgaagtgtagagataagagaatcctatgcaaaaagcccagccagtgcaaaggcactgaggtaggagagagctgagtaaattcaaagaaaataaaacacatagtgggaggctgcagaaggagggaggtaatgaccattatgaaatgaatgggctgggcatggtagctcatgactataatcctatcactttgggaggccaaggcgggtggattgcctgaggtcaggagtccaagaccagaccgcatctctactaaaaatacaaaaagttagctgggagtggtggtgcatgcctgtaatcccagctacttgggaggctgagacaggagaattgcttgaacccaggaggcagaggttgcagtgagccgagatcatgtcattgaattctagcctggatgacagagtgagactccatctcaaaaaaaaaaagagagaaatgaatgatgggcttgagttgggtggagcacttgatgccagggctttaagaacagcctggccaacatggtgaaacttcgtctgtactaaaaaaaaaaaaaaaaaaaaaaaaaaaaaattagcttgccatagtggtacatgactataatttcagcactgggaaggccccagtataccttggaactcctctgcctaggttatctcccttgtcttaaatcagagatgggtgttacttactctacagtacacagaaacaggtatcacttatcaatccctgtgttcttttccacttagctcaaatacagcctcggcatccttctgaacactctggagtaggctgccatttttaatcacccagatgttaaatttattcatcatccctatatatatttcccacaggatcaaagtatatcgagtttggaaagggagttgaaaacaaggaagactccctgcttttgattcccatgagggcaatagctgtcactctcctaggggatgttttgataagacagccacttaggtttctatatcctcctgataaccgtatgttgaaaaaggatttaagaggaaggtcataaaaccagggatttcttaacagcagggtgtggcttggcttactaagaatatacttgtgatgcattttaatgacatgctttatgttatcatattaaagattgtaaaagcatctagtaatcatttaataaatattaatgaagcatttacaaattgcaccttaatttacagcattggcactcatatcgtgctctggacatgaatgcacagagacatggtggctttgacaaagactaccatggagagcctggttctgtgacattgtgccatcctggtaccataagtgattttttaaaataataattcttggagggcagttgagtgcaatgaagcttgatgcctaaagcagttttagcaattatttttctgtttggggaacattaaaacataatctaccatgaatttataatccatagcttctctctcatgcacttcttaataataagcagtagttataggcccttgtgcaaaaattctttgtagatgttaggagatacttcctcattgtgtaaacactggggcaggtaagggatatattgcaagcgataactgtggggtcgccactcccctgccaccatctttgtttgatgcttagggagatctcctgttctttgcaggcacttagatacgaatggaggagccccaggcacaaattcctcagcactctgtcctgctcttgttgctggacttgattgtctttcagacagtgcattcaatgttgagttcagagccattccctgcaattccctctggaccctgttggatgttaaccacgatggttctcacacggggctgggtgtcacgtggctcacagaaaactacagatggaagggccttagaagtcacctgctgcactcctcactttatagaggaggacactgaggcccagagaggaacaggacattcacaggccacacaccaggcaagaagcagagatgaaactgttacaggcaaggggctggatcccgaccccaagagagcgttctcagatctcccgcaagacaagagttgagggcgtgtctgtagagtgaagcgaaagtatgtttattaagaatgtagaggaataaaagaatgtccactccatagacagaacagccctgaaggctgctgcctgcccatttttatggttatttcttgatgatatgctaaacaaggggtgaattactcatgtctcccctttttagaccatatagggtaactctgtgatgttgccatggtgtttggaaactatcatggcgctcgtgagtatagcagtgaggacgaccagaggtccctctcagggccatctgggttttgatgggttttggctggcttctttactgcaaactgtttttatcagcaaggtccttatgacctgtattttgtgctgacctcctattttatcgtatgacttagaatgcctaaccttctgggaatgcatcctagtaggtctcagccttgttgtacccagcccctatggaagatggagttgctctggttcaaacacctctgacaaaaccggatcccaagacataagattgtgcagtgtgcatttgcatgcttctcagcctcagagctaaggagacctgggcatgtcctgggggggttttggatagaggggggcacctcttcatcaggggtgctggagaaggcctggcctggcctctggagcctgccgcactgccagtcaggacatcctagctgagcaggagccatgggcgtcccggggaatcctaggtactgagaggagatggccagcagatggcgctgcagggattcaaactggagcagccatatctgacagcaaccccaggtcagggattcaaagctccagcaaccaggatgagctgcttaatagtacaggcctggacttcagggatgcctagacccctctcgggagctcccacctggcctggaaagagagccaggtctagaatgggctggtgcaggtatctgtagactggtcatactgggtttgggatcagaccccagaccaagaaggaacaaagggaaaacaaaaggactagcgcagctgctgtgtccaggctggggtgcttgctatgtgggcaggactatggtcacaggccagggtggaaatggcagccagaaggcctccctctgcgtggggtctcccttaaacccaacttcttggggcctactctgaggacatcaagaccgtctcttctaggaaggcaagaggccaacacccatgaagctgctgtttttcctttcctgctcctgacttggaggcgtggagattgccaccaggccatgtttaatgtcttttaattaacggtttaactcgggtatccatgatgcaagggttttgcaaaggaattcaatctagttttcaaaattgcagaattaagtgggtaaagaacagttgagggcagcacttacatttctgaatatttagactctttttttcttcttctttcatttttttcacacttccaatctgcctcttttcttcttctctctgtttctatctctctcacacacatacacaatcacagctgcttcatacggcttctccccgtcccctctcctggcagctgtggcgtttctgcacagaggtgcagggaaggaggaaaggccttgggtcccctggtcaggatccagctgaaacaaccagaaatactgtccctgtacctctcaggtcgggtgacttactgtgcctctgaaccctctttcttccatacctcccctacccaattccgaggcctcaactttgtgctgccagagggcactatgccacctttaaatgagatttagaaaaagtttacacatggcacctgctgatctggacattccagtcggcttgctgtatctcctagttgcaagggagggctttgcttagagcagcctgtgccccgtagggtaataccggagctggcggcctcccaggaaggctgcaaagtgcttgggtgctttgccctctctgaagcatacatcagcacccctaaggtttagctgtgctgcagccacagcccacacactcctccattctccctgaacaataggacccttgctgagatagtctggtaggagaggggaggctctttcctgaacccgtctctcctaaacgctttctatgccttagagtgctaagaacagtctaccctccttacgagactgagtgtttcctgaaggcaggagctgtatcttattgaactctccagcgcacagaaaaaactcataaatatttgttcaactaataaacaagtaaatgaatagagaggatgaataatcttttagggtaagttaattacatctattttatttaaaatgcattatagaattttgtctctgtgccaggaactgcttaaagtattttttagatataatctcatagatgcctaacaaaaaccctgtaagttagacacccttaacatctccttttttcaggtggaataggagaggtacagattgggtaggtaacttgcccaaggtcaggcagagccaggattcaaactcaagcagtctggcttcagggcttttttttctaaatcactccctgtggtttctcttagtcttagaccaagactaatgtacttagaaatacccagccagggaacaagaatgcatagaatttaatcccccaagcccaactttcattattcagctttcaaaagacatggcagggaaggtttccagacagaagaggaatagtcagtttgtttttaattcaccagtaaaacaaatagacttctttccttttatatttgtaacatacagcttgcatttttttttattttaaacaagaaaaggaagaaataaatgagaaagaagggaaggaaggtggaggaggtgggagagagaaaggagagggaggagagggaaaccgggagaaaaaaagaagggagaagagaagggaggaagaaaagaagggaaaagagaaggaaggagggagagaaggggaaggaaaaggaaggaagaaacaagggtggaaggacgaaaggcaagaaggaagggaagaaggagaaggaaagaaaggaagccttatttaatctccagcacagaaagtgttcgcagccctgagaaacgtggtttctcatttgcctgttacttggcacagtttgactgcctagaagcctgcagaaatattggaagtcaaggtccaatataataattggcttacagatttgaagaaggatagatagactcttccatttccaagattcattagtccagctttctccgtaatagacagggcttgctctacgtgtaagccattttctaatcaaattggcacacagttcatgctctgacttggtataaatgggcttctgtgaaattgctctgcctgggctcagggctggagttagatgggatggattttatctctctgatgcttgatcatcttgggctctgcatggaggaaacctgtctctactaaaaatataaaattagctgggcgtggtggctcatgcctgtaatcccagctccttgggaggctgaggcaggagaatcgcttgaacccgggaggcggaggttgcagtgagctgaggttgaagcattgcactccaacctgggcaataagagtgaaactccctcacacacacacacacacacacacacaaaaaaaaaaaaaaaaaaaaaaaaaattgaaccacacatcattgtgacttctatttgtgaaatgttcccaaaggatatttgaaaatgtgaaccaactgtgaattattgcaggacttgatatgcacaggaaatgtaatagggacgtggaggttcgtaatgtgagtttggaaaccatggaacatccaaacattggcgatcaacaaagccagcagtatgtggacagcttatgagaaaaggtgtgggcatcgcttggatctgagtgggaatccaagctctgccactcagctatgtgttgctaggaaagtttgcaagcatctatgaaataatgaaagtttaaatgaccatagcagcaagcatgctgtttggaagaccaatctccagatgaacttaactaacggtttctagtaatgctaagcataaaacagaaaaaaaaaagctatatatatatatatatatatatatatatatatatacacacacacacacacacacacacacacacacacacacacatatacgtatatatatatgtgtatatatgtatatatatacacatatatatacgtatacgtgtatatatacacatatgtatacgtatacgtatatatatacacacatatatatacgtatacgtatatatatacacacatatatatacgtatacgtatatatatacacatatatatatacgtatatgtatatatatataaaatcaagaagagccagaagagattggaaagctctttggccctgatagaagaaagctgatgcgtcacacagaagaaacatgagtcttcagttcttcttttgctcttgtcttctctgtcaagaaaaatcatcttcagtcaggatggaatagagtttggtttaggtgacaaagtcagtgttggtgaagcagaatgaagagagtgctagctcttaagaaatctaatattttacctggactaatatctccaaacaggagagtaacttggacatgagatcattaagtatcattgacaatttgtggcaaaaagcagaagggtatgagatttgaaatgcggaaataggatattctaattttcaaaacagatgaaagaagctgggagactctataattatagggtggtagcatctcatggtgtaaccactattaatggttcacttgttcaatgattaaagtcccatgtgatctgatcttcacatgaatctggacattatgaaaagcatggcttgtggatttcttgaagatgaaagaatgataacttgattcttatgtccattcattgggaataatgaagacccagcaaatgccatttcttctcactagaatgggagatttggagaatggggtagacacatgatgtgtgaattccagcaagacagtcaacaaggacacacttttcggtcacgtgtgtgtgatccctttatgggaaaagtggaggatggtgggatagatagtcagaaaagtatgtgggaaagtaaaacattattacaaattggtgccaaaaattataatgagtagattggcccataaccctggtggttttaattgtagtgatgtcattgagctttgttctgagatatgtcctgatggcattttttctaaatggttggatcatgatagagaaggctgttcttcagtgacacagatgggatggagtggagtgcctctgtttaatggagtcaggactttcatacccattttacagatgaggaaatgaggcatatgaaatgtattcatttcctagcattgccataagttaacgccaactggatggctttaaaacaacagaagtttattcattcaaggttctggaggccacaagtctgaaatcaaaatgtcagcaaggccaagttccttctgaaggctctagggtagaatccttccttccttctcccaccttccagtggctccaggcgttccttggtttgtggccacatcactctagtctctgcctctgtcttcacatgctattgtctttgtttctctgtgtgttctttgctatttcgtatgtggacactccctttggatctaggacctactctaatctactatgattttctcttgatccttaccttatttacatctgtaaagactgtatttccaaataaggccacattctgaggttctgggtggacctgaatttgaagagacactattcaacccattatacaaagttatggggtctaattaaggccctcaaataagaggcaggtccaggacttgacttcatccgtgtctgactctaaaccacacattttttcttttgtcttaggggagataaggatagggaaatgaatccaatccttgtcatttgacaaagagtggaagggaatgtgggtatttatcttggaaataaaatgatcaagaaaggacatggggtgtgtggagcagaatgatcctgcagaaagaggacctttatgacctagttggtttgggatgggagatggtgtatgatgctgatgctgcttcttccaaggagggtagccagggttgtaagtaagactgtagactgggtggagaggaagcaactgcaggtatgctgcaggatagtggctacagctttgcatgtagagagtcagcaatgccttacagttaagaaaataaagctaagcttggctgcctggcctggaatcctgactcctctatttactcatgatgtcaactttggcaggttgtttaacctttgtgactacactgtagagataaaagcagtatcatggctgggtgctatggctcatacctgtaatctcagcactttgggaggccgaggcaggtggatcacttgaggtcaggatttcaagaccagcctggctaacatggtgaaaccccgtctctactaaaaatacaaaaattagctaggcatggtggcacatgcctgtagttctggctacttgggaggctgaggcaggagaatcacttgaacccgtaaggtggaggctgcagtgagccaagccaagatcatgccactgcactccagccgaggcaacagagtgagaccctgcctaaaaaaaaaagaaagaaaagaaaagaaaggcaatgtcaacgacatcgggcagatgtgatgaataattttgatgggattggcgagataatccagtactttataaatgctacctattgtgatttttaaaatactatactctgtgccctcaaacaacatcccgtgttttacccactgcagagaagatgcagatggcttgtgtctcatggggcctggctcacatgtaagccaacgtggtccttgctggcctgctggacacacagggagctccactaccttgccttctaactgatctctccctgatcagtataattacggaggccctgctttcttccagcagccaaattgttgggatggacttcctcgttatttgaagcatttgttactgaagttagtatggcctcctggctttgctcacatctgggaaagaaagtcgattctcctttgtatttagtggcttggaagctgccagcaactttcggatggccgtagtgtcccctcttgagaatcagagaatttcattattatttttaaaaatcttatcttggcggggtgcggtggcccacacctgtaatcccagttctttgggaggccaaggcgggcggatcgcttgaggtcaggagttcgagaccagactgaccaacatggtgaaaccccatctctactaaaaaaacaaaaacaaaaacaaaacaaaaaaatttagctgggtgtggtgggaggagcctgtagtcctagctacttgggaggctgaggcacaagaattgcttgaacccaggaggtggaggttgcagtgagctgagatcccagtgcactccaatctgggcaatagagcaagacttcatctcaaaaaacaaacaaataaataaataaataataaaaatcccatcttaattttttaaaggaaaaaaataaaacctatggtcatgagcaaattacagatcagctaaatcttatgtgggaacatctccccatctacagctatttctgtttgtttgtttgtttgtttgtttgttttgctagacgagtattttccctcctcaagctaattgcttgatggaattaaagacgataatctctaataattccagtgaacacatggttcattttcaggtagttttatcctcgaatttcacttgttattttgttgtcggtggcaaattttccttttaccctctatgagacacccccgccttgggtctacctgaactaaaaatgcgtttggtgtctccaggctcatggcatagccactctgggaaacttgtctaacttccagattctcaaatttctgcagctgagagcatgtctctcttttgggaaggaggcttttcctggctggtgggagaacagcttcaatttgggagacagtgtgagtcagcaggaataacgctaaatggctggaaatcagctcagcaaaaatagcaggagcacctactgtgtagagactgtccactagccctgtcttcagaaggcaagaaaggaatgccaactctctcctcttgggctgagtggggagatgagacagggcagggaagaaggaaagtgcagtaagcaggttctgatgacgaggcggtaaaggtgttgattttagggattatagggagaccacccgtgccttacctcctccttaaaagtccaaaaacaggacgggcacagtgggtcacgcctgtaatcctagaactttgggaggccgaggcgggcagatcacccgaggccaggagtttgagaccagcctggctgacatggtgaaaccccgtctctactaaaaatacaaaaattagccagatgtgatggcacatgcctgtaatcccagctacttgggaggctgaggcaggagattcgcttgatcccgggaggcggaggttgcagtgagccaagattgcgccactgcagtccagcctaggggatagagggagactcagtctcaaaaactgaaaacaatggtgaatgtgaacgtcctttaagaggacagagctgatcatcatgggtgatatgcttaggataactttaaagacacagaatggctccctgtggggcaacttaacagaaacaaaagcagatgaggaagggaggctgggatggggcttggttccctattgaacagtagaaagacattttgtccgggcgtggcgacttatgcctgtaatcccagcactttgggagcgtgagctggggaccagcctgagtaacatagcaaaacctcatctctactaaaaataaaacaaattagcccactagagtggcatctgcctgtgggcccagctactcaggaggctggggcaggaggattatttgagcctgggaagttcaagctgcagtgagctatgattgcactgctgcatttcaggctgggtgaccaagcaagaccctgtctaaaatgtctaaaataaaataataaaggcatttaattcaatacttagtgaatacttggatttctctccattgcggagatgaggtaggtatggcaggggatggggacgcggtggtgcaggtgtccatgccatggcttaagtgccatccctggagcaacaggacgttgtctgagtgattctcattgctggttctggattcaaatagcctgggtttgactcctggctctggtttttcctaacttggggcaccttgtttagcctctctccatctcagtgctctcatctgttcaaggggataatgataatgacagtatctactgggtaaggtccctgtaagaagtcactgtaggatgaaggcagaaagctagatcatgcctggtaatgaccaggttggtgctggaggagagggggctgaggttggagatcatcaatgcaccaggggtctcgggatgatgaagagagtcgctgccctctgcttcttcccccttcttccttgctgggctccagctggctgaaagtgtatgaccatctatctctagggcacttcagaaagatggatgggaagtgggaagaggggatgaggctgcctagagagccttgaaattttaacttctgtgaaatatccagagaagatccctggcaatgtttttgtgtctatctcattgaagacacatcagtgaggctagcagagggccctctttattggggagcagaacaggagacattcgcctttcagtgaggacacctcacatcagtgcccctgtagatttattgtgaattacctggggtttgggggaggggtctcagaaaatgcaatttctaattcacttggtctggggtggagtctaagatattgcattactttttttttttttcttttttcttttttttttttttttttgagatggagtcctgctctgttgcccaggctggagtgcagtggcgtgatctctgttcactgcaacctctgcctccccggttctatcgattctcattcctcagcctctgagtagctgggcctacaggtgcccaccaccatgcctggctaatttttgtatttttattagagacagggttttacattgttggccagggtggtctcaaacttgtggcctcaggtgatccacccgtcttggcctcccaaagtgctgggattacaggtgtgagccgctgcaccgggcctctgagacagtgcatttgtaatgagtttccaggtgatgccaacgctgttggtcctcagtctcactttgagtgttaagatcctgcaggatactccaagtgagaactgtacttgggattccgcaccctccccttcattcctcacccaggcttgcccatttgactgtggtgctggcccatttatcctagttaaagggttccacagttccctgtgattatccctcatgatacggatcacgttatacacttaaattaaataaaatgcaccctatcgaatgcactgcacacaaaaagaatatttatttgaatattaagtacagataagacttcccctgggattatttcagagcgcatttgcagaatttaattgcaatattttcccactcagtttctttctgaacgctacttgtgaaaatattttctttctgaaggtaaagctctgcgttgttggtttattattattattattttaaatctgaagagctctctgagctcggtcattacttccagtgtctaattaatcctgatgatgataaagtaaacagccaggtgacctagattttccttttaaattgctagcaattaacatgaatgcctgctcattgttgcagaacttttgggaatctagtccttccagttaggattccttaagttgggggttttaagagttcattttgtgtgaagcatatgtcttccagcactccttccattaagctttccaggaagaatgtgaacacagacacacacacacacacatatacagagcaacagtcaccaccaccacccagccaaccctttcagacaactgaactggaaaattagaaaatgaatactcctcaagtttctcaagctacagaatccttcccatttcttaaataatgacattttgtaaagtcatagaaatcagcaatagaaaagacctcttgtgtaaagatctcttcagatgcgaaagtcagaatagcatggaaagacagcctggggatgtccaccttgggtgccttctatccctatttccttgtctggagaattggtcccatgggacttagttcaccttgacatttttttttttttccatgacagccttgtagttgttacatgatttatttcttttgacattctctacaatgtgtagatgtggatttacagtgtcccatcctaaaactttcagaagcagtagccaatttttcacaatcttggttttctaccgctgtgttataggaaaggggtcccaatgcagatccccagatagggttcttggatctccctcaagaaagaattcagggcggccgggcgtggtggctcacgcttgtaatctcaatactttgggaggctgaggcaggcggattacaagggcaggagtttgagaccagcctgggtgtctgtactaaaattagaaaaattagctggatactgtggcggctgcccataatcccaactattcgggaggctgaggctggagaatcgcttgaaaccgtaaggcggaggttgcagtgaaccgaaatcgtgccactgcactccagcctcgtcgaaagagcaaaactccgtctcaaaaacaaacaaacaaacaaaaaaaacaaaaaacaaacaaagaaaaaaaaaaagaaagaattcagggaagtccatagagtaaagtgaaagcaagtttattaagaaagtaggggaataagaatggctagttcatagacagagtggatgaagggcagaggagcccctcatcagagtggatgatgagccccttggggctgcttgtttcccatttttatggttatttcttgatgacatgctaaacaaggagtagattattcatgcttcccctttttagatcatacagggtaacttcctgacgttgccatggcatttataaactgtcatggtgccagtgggagtgtggcagtgaggacaaccagaggtcaccttcgtcaccatcttggttttggtgggttttggctggcttctttactgcaaactgttctatcagcaaggtccttacgacctgtatcttgtcttgtgctgacctcctatcttatcctgtgacttagaatgccttagccatctgggaatgcagcccagtaggtcttagcctcttttttttttttttttttttttttttttgagatggagttttgctcttgttgcccaggctggagtgtgcaccggcacaatcttggctcaccataacctccacttcccaggttcaagagcttctcctgcctcagcctcccaagtagctgggattataggcatacaccaccatgccagaggtcttagcttcattttacccagcccctattcaagatggagttgctctggttcataaacctctgacaattgtgatgctgtctgctaaatatctaaggaaacagtgaggcacgtccagtccactgtcaacttatgaaaagaagaaatcacaacaacaacaacaaatggactactgaattcagtttactttcttgtagtgaaaaggcacgttatatagtgctttccgtgtgataggcactcttctaattgctttgcaaatattaactcattcaaatcatgtgatgaccctgtggggcacatgggtagacccaggcaaggaatttgttcaaggtctgtaagctaataaggagttgagttgagctttgaaccttggaagtctggctttcgattttgttctctgaaccactgcattttagatgcctctcaaatgtctctcagttaatatgatcaagatgactgcccagataaggccatggcctgtgtgtctctgctgaatctatttaattgggatgcagattataaaattatcaacttctgataaaattattattagagctctgtaatatccaatgagaaagaaaaaaaattacagttaaaacatcttaacttgaaaatgtcttgagaacatatattctatcccagtagagagattcaaatggtatgtaaatcccccacttgccctcccctccacactctttcccacctctggatgtagagagggggatgatgggaaaatcttcgctgagatgctcattctacacagagtttcctggctatagggtaacgatggtcccaggagaccggttcagggaagcatgccaagcccttttagttacccaggacattttggtgagtattgcttgaattttcttagactgagcaagggtttgggatgggatggggttgaaggagggcaattataacccttgatcatgagggaaagaaatggtgattgctttcgctgctgaaacaaatagaaatcatctttgtaataactgcaattgttttctccagccctcctctgccttggttcacaaaataccttattaaatctggagaataaaaatgtacctggggtaatggtttattattagaataaataataggcaatatgtttcttccaccctgcaaggtatcagatgccaagacatttcgtggtttagcttgtaaaggtgcttacatgtgtcagaccagccaggctcttcatggccaggggctgccctttcatttcaagaccagcatcaagcctgaagtgaacaactccacgagactgcattcttgcagaaagcagatgtgggaggccgaaggggatattggccacgtgctgcctggggctgccatgtcttgctcaatgtttgtctgtctgattaatctgtctggacctgggggacttcttttgttgataatggggtctttaccaagagggtgcatggcagagcaagtgtgaaaagcacttcctcccaagaaaacacctcattaaaacgtgtaatttgaggtttgttcaaattctgtgggcatcctgacctctgacatccctttaatcagataaccaacacttgaatctctccagtgacttatagccagagcagtgactctcttgatataagtaccattattaccaaacaatatgatgtttaaaggaatatcagaagtgctcactaaatgtgttgtcctgcctgggagatagcaccccataggtcattcgagtgctaagaatactaagtgttttgagattttaggatatgctccataaagtattcccgaggactcttagccataaattaaatatgttagagctttcagcatttgggtttattgtgcaagtttacgtataacaacaaatccattattattttttctacttagtacttagccttgacaagctctttcgtccgtctcccttgaccctccaaagctggcatcctttcaaaaccagacaagatttttacagcagataatggtcttccccaaggttaagaggaaaacatcgtgggagagctgggtgtgttctccaagctattttctcaagtgtattttgttcgtttatgcaacatgagacagaatcaagttcattaatcatggctgacttgagtcattgttgtgactttttgtttttacttttttaattgattatttctcacctcctttcctgaaacctaagcatttactagtgtaacacacttttgttcttccttgtgacaaaaagtaacaaccgccatgaccggtggtgggatctgtatttgcttatctgacataaactatcctgtcttcttagaatcagaggacacactttattgtgtgatacacttgcaagaagcagtgggtatgattacaaccatacgtcggattataggactgtattatgttcaaagatttcaggcctttataaactcaggtatctaataaacattacacatgagaccctagaagcagacgaggcaaagcgacctctctctttttattttctgtttgtacttttactttcctactgaagagaatccacacaaaaatacttatgtccctgcagaattggagcttttgttttgtttttcaagatagccaccctacatttactcttttggtgctatggggagttattttattattattattattatcattattattattattttgagacaaagtcttgctctgtcaccaggttggagtgcagtgacatgatctcagctcactgcaacctctgcctcccaggttcaagcaattctcctgcctcagcctcccgagtagctgggactacaggtgcccgccaccatgctagctagttttctgtatttttagtagagacggggtttcaccatgttggccaggatggtctcgatctcttgacctcatggtcctcctgcctcagcctcccaaagtgctgggattgcaggtgtgagccaccgtgcccggctgagttattttatagccaccattaatcacatacttactatgtgccaggccagatttggctttgatgctctacaaataacatctcatttaattattacaataaccatataactcaggcatttaaattatattattattgctgctcttagtatgaatttataaaactgatgcatgctcattgcaataagttgaagtgatataacagaatccaagattaaaaatgagaaaacctgcttctctgtcccttcttctccactattggtctggttcccaggacatcatttttctgcttttgtctgaagtttgttgtttatcattccagacttttttccaggtataaatggatatttttctgtgtgtgtaccttgtgtgtgtgcatagttttttatacacaaatggattataggttaaaaatgattttaacttgcttttgttttattttgtcatagacatcattcctgaaatcattcattttctaatggattcataatattccgtagtataggtcaaagtttggcaaattgtggccatgggccaaagacagctcactgcgtgattctgtaaataaagttttttttttgttttgtttttttgtttttttgtttttttgctggggggggaaggagtcttgctctgtcccccaggctggagtgcaatgatgcaatctctgctcattgcaacgtccacctcctgggttcaagcgattctcctgcctcagccccctgagtagctgggattacaggcaagtgccaacacgcccagctaatttttttttttttttttttttttttgtatttttagtaaatacggggtttcaccatgttggtcaggctggtgtcgaacatctgacctcatgatccacccgccttgtcctcccaaagtgctgggattacaggtgtgagccaccacatccaaccctgtaaataaaattttattggaacacagtggcacccatttgtttacacgttgtcagtggctgcttttccaccataatgggagaaccgagtagctgcaacaaagacaagagagtctgtggctctcaaagggcaatgcatttcctatttggctcttaggagaaaaagtttttcaattcctaatgtagatgaaccacaattcttttaaccatttcattacttgtggacattggcattcttctcagttctgggtctgttctgtgacaagcgctgtccttacttcctcattcgccgttgcactctggtaaagtgattcctagaatactaaccattgaattaaaggaaatggaagttctacatagtgataactgccagctgccccctcgaaacagtcagtaccaatttaccacccttcttaaaaagataatatcaaacctttcgaaaggaatctgatgctacaaaagtgtcattaatttagccaaattcacaaggcctcttggggaacaaagccaggatttggacccaagtcatttgacccagtgcttcttgtgaaaacctcctgtgtcattaatttgaataccaattgctggtatttgctgaatttttaaatgtgttaagtgctttgcttagtaattcttatagattatgctcacaataaaattagacactttgcaggtaccatattatctctatggtacaaatggggaaattgcctgcagagattatataatatggctaacgttacttaggagatgttcaaggactggacttccttagtctgattccttaacctccagtctccattggggagaaaactggatctacagaagggcccagtgctttgatatcagagaaatctaatttggtggaaattatactggttcttacctcaataagccaagtttggaaatttatgtgttttatggaactagacaacactagctagtcggtgcatgtcttgttttagagaaacacaagtgtgtaaacagcatcttgtcagggcacagtagctaatgagcacctgctaaggacaagtgaggcgcagattggggaggagggctaacagtgtaggtatccatggttttgtttggtttacctgaccctggaaactgtgtacaatggtgattcagagaggaaacctagtcaacccatccagatggtaattccctcttgaatatttcctatctttacggttttaggaattcactcactctgtgcctcagtttttccacctgtaaaatggagctaaaatcaaatcagctaatgaaatcaattgtcagctgcttacaaagttctgagaattaactaagcttataactaggaactgtttagcacattttatgacatattacaaacattggatacattttaacgaatgttagtgtgcaatttatttcagcaaaaagtgattaaggccaggtgcagtggcttgcgcctgtaatgccagcagtttgggaggcccaggcgggcggatcatttgaggtcaggagttcaagaccagcctggccaacatggcaaaactccatctctgctacaaatgcaaaaattagccgggtgtggtggcgctcacctggaatcccaggtactcgggaggctgaggcaggagaatcacttgaacctgggaggtggaggtttcagtgagctgagattgcgccactgcactccagcctgggtgacagaggaagactttgtttcaaaaataaataaataaataaagtgattaaaacaattactttcctagcagcatagttaaaattgagcaaaacctaaatattttgcaatcccaaagttccttcgcttccatcctccaccccccacaatctccctgactttatcctgcttttgactgtgccattcacggtatcttgtttctgtatccttggggaggtcctcccgcccaactcctatttactcagtaagggttagatcaagggtctcagctccagaaacaactgactgatgtctcctccactgcttcccgtccttcagcaggctgggttggtgcatctcctttgagcacccctggaaccctgttttttcttttctatcacatacgaccctgtatcatcatcattattttattcatcactcctcccctgtcttttttaaataaaatgtacaatgtgtcatttagatacacaccccctttcattagcacagcgctaggcagttagtaccctgagtacatatgtcaaatgtgtatcatagtcctgaaatgcatcaaggaaaacgcaaactccagggctcaccctaggtacttggagacgtgcgtttataggaaaatgccatcttgtttcagaagagtttataatgattacaaaaacagcaacgctgagaaataaagctaccaattgatttgatatattgagttctatgctggtaaacttgtccagtgttttccttctaagtgattcataattgtcctgaaaactggattttccaacattctattattgtggacatgaaaacatgaacatctatttatccattcatttattgtgtgtcttctgtttctttggactcctactttccccagttcaagttaatctctcaccagttccctcttgcacttgactcttgtgtcatattcaattactgcacttccataatctcactgagctttccacacatcctcctgcctttcctctgaatatatttttttcattctttacctggatacattgtctaaaagacaaaacaaaaacaaacaaaatacactaatacctttttcaattctccaagacaagttgggccacctcctatgcactgcaagcacctcttacactttcactgtacaaatgttctctgtattgtaattatccatagactcatctttttccccacctagacaatagctccagtagccttctttgctgttgtattcctggcacttaggacagtgtctgacatccagaaggtgcttgagatatgtgtatgtatatgtgcatgtgtgggtatgggtgtgtatgtgtgtgagtaaatatatatgaaaggatggatgagtaaacaagtggattccaaacatcgtactcatctctagaaaaggaaagccacctaaggctcagttctagttcttgcagagccagtctgatgtgtgggagagaaaaatcagactgaaaacagggtcagaataaagcaggaagaactgataagagagaactcaaagtcaggagaaggatgaaaaaggctgagtgagaaagcgtctttggccctgttggctaaatgaagataggagacggggaagatgaatccctgctattaaacatctcgttcaaccgggagagcaaagggtctcatgctgaagtttattgcttcagtttctaacctttcataagtgcttacttggcagccctttcaagagtggtatttgattctggaagcatcttaaaggaacagcgcccgaccttccactttactttttttcatttaggccataaaatatattggttttgtgcattactgccatgggagaaaaaaaatatcacatgttagtttccaaatgaaatgacatttgataaagtgtacatttaagatatttttcaaggctagcttttaaagaatgcacaggcagggtctttcttcatcacagactgtagggagttacaggtgcctttttttccacctcccctctccccacccggagcctctcccataatggttatggagaaaattttttaagagcctcattagttgcagcaataacttactgagtcttccaagaatcattacaccctgtttggggtgctgtttgatgagcaaggttgcagccgaaacacacaactcatgatgggattctgccgttttgtgcaatggacagctctttcttcacggaagatgtgaggaaagcatggatctgcattcgatgatccctacttaaaggaggggaggtcactggccacctaactcatgagatgtgtatgtcactggattgactcaaattggccagggactcccacttccaaacaaaggggttggcagtaggtggagtatggtggtggtggtggcaaccagtttactaataatttatgaaatggaacaggtgcatgacccaaaaaaagaagcaggatattgtcactagaatataagcaaaataatatgggatgctgtgcagggaaaaataaacacaacaaaaacaaacatgtctactatagagattacttgaaatatcctttttcttattcccaaatctcattttccttatttggcttcatttgaaggacagcatggctatttccttggctactgttggattttgcattgtctgcaataggaatatgataatgtggtgccacttcacatggcacaagtcagaggtcagtaggccccctggttccttcagtgtcgtcattgtgcttttgtgagtctggcaaatccttgtgatatttgaaggcagatgttaaaaatattaatcttgttatatactttttttttttcaatagagcgagacattgtctcgctttgttgcccaggctggagtgcagtggcttgatcttcattcactgcctacctctgccacccaggttcaagcagttctcttgcctcagcctcctgagtagctgggactacaggcgcattccaccacgtgtggctaatttttttgtatttttagtagagacagagttttaccatgttggccaggttcttctggaactcctgacctcagatgatctgcccacctcggcctcccaaagtgctgggattacaggtgtgagccaccatgcccggccaagataaactttttattaattaacgaaaatcaatgctatcactattactatacatttttaaaaacacttgtatttctgcaaggtactgatattaaaatacttgctgattataaatgccctgtatgtcacaaaggatagtttgaaaactacagaaagcattaagaaggaagcattgccctcagtctttaattgcatcagccatttagtttatattttacatgtagacaggtgttccattttgacttaatttttgtataaagtgtgaggtttaggtaaaggggtgtgtgtgtgtgtgtgtgtgtgtgtgtgtacacatccagttactctatcattatttgttctggatgtttcacttttttcggttttcttaaaggttgtgttatagggattatcacacacatatttctctcagtctacaagactcagtattttgcctctttagttggaatgcagaaaccttatcacccatgttaattagcttgacttcggtgattgtttttacaatttatacatacattaaaatatcaagttcaatacgttaaatatatgtaatttttattttttaattgtgcctcaataaagatgggagataataaagtttatcaccacgtatgcctctttgtttctgtagtctttgtgttttatctttttttttttttttttttttttggagttggggagtacagagtctcagtctgtgtgcaatggcatgatctcggctcactgcaacctccgtctcctgggttcaaacgattctcctgcctcagcctcccaaatagctgggattacaagcacgcgccatcatgcccagctaatttttgtatttttaatagagacggggttttgctgtgttgaccagactggtcttgaactcctaacctcaggtgatctgcgagcctcggtctttcaaagttctggaattacaggcgtgagcccctgcgcctggcctatattttgtttaacttccgtattgtatatccataaattaaaaagctcttcatgcacttccctcccccccagttttttgctttaagccattaaacatattttaatgaactcaagagtatagaaagctcttcatgcaatttcctttttttttttttttgctttaagccattaaacatattttaatgaactcaagagtccagtcacctattaacatttactcatatgtttaccatttccatttccagctcttcctttcttgttgtttgaagtttccttcaggtatcctatttcctttatctggaaaacttcctatagcgattattttagggcaggtctgtctgcagtgaattttcttagttactttcatatttcaccttcatttctaaaggatattttcattggatgtagtattctcagttgacaattattttttcagtatttcaataactgtgtgttattttctgctgacctctctggatttttgtttgtttagtttggattttgttttaaatccatagttctttgaattgttgggcccttacaagcattgcattgtttgtctctggttgttttcagtgttttaattttaggctttaccaatatgactgtgatatatgtggttgtggatttcgttgattttaactcttttagttccttgaaattgtttatatcttttgtcaaatgtaggaagttttcagccattatttcttaatttttttttttgcagtgaactctttatccttatattctagaatttcagtaacatgaaatattgtacgttttgatatttgttccacaggtcctgcatttctttttttttttttttttttttttttttttgtcttcaatttttttttcccctatgttgtttagaatggatactttttatgtactcaagtttacttctttttcttctgttgtcttcattctgtgtttggacaccttcagtgagattttattttattccgttttaattaattaattattttttttgagacgtctcactcttgtcacccaggctggagtgcagtggtgcagtctttactcactgcaacctccccctgccgggttcaagcgattctcctgtctcagccgtctgagtagctgggaataaaggtgcctgccacaacgcctggctaatttttgtatttttagtagagaaggggtttcaccatgttggccaggctggtctcaaattcctgacctcaggtgatccgacccgcttggcttcccaaaattctgggattacaggtgtgagccaccgtgcccagcccaatattttatttttatttttttaaaaaaatttagttatttttatggttgtaaaatttccttttgatttttttgttttgttttgtttgtttgtttgttttcgatggagtcttgctctgtctcccaggctagagtgcagtggcacaatcttggctcactgcaacctctgcctcccaggttcaagcaattttcctgcctcagcctccctagtagctgggactacagtcgcgtgtcgccacacccagctaattttttgtatttttagtagagacagggtttcatcgtattagccaggatggtctcgatctcctgacctcatgatccacccgcctcagccttccaaagtgctgggattacaggcgtgagccaccgcgcccagctccttttggttctttattatcttttgtttctttgctaatgctgtcaatttttttctcagttattttcagtgtgttttttcttaccgtttggagtcgttttataacagctgctttaaagtttttatttgataattccaacatctttgctatgttgatgttggtgtctgtgaatgtcttttcccatgcaaatttagattttcttggttcctagtatgctaagtcattttggtttgtattctgggtatattgaatattgtgttaggagactctaggtcttgtttaaaatcccatggaagttgttgatatttttgttttaataagcaatcaatcttgttgcattcaggctgaaagctcttgcttttcttctgtggatttgtttccaatatcagttctgttgggtgtctcccatatatatatcaagtctgggacatgggcagtagtctattccttagttcaattctcaaagcttatggaaacattttagggtcagatacagacatgagcacagaggtcagtgcaggagtttataaaaatactgtttgggggtgattttcccaaattattttctctccgggatcctcaaagtaatatttgttttctagggttccctgtttgttgtcctccacccagaaagctggtggttttttgtttgtttttaatttttctgttcacctgcttctcatctgagtctgcatttagggcaaagtgtcaagagaagagaggaaataaagaaaagcaatgggaggtgggagttgtttgcccaacctcttgagaccacagtcctagatgttaagtgtctgcagccacccctgttgccactgttgtttatacatgaacactaccctgagattgcctggagactgcagcataagaggacacacaaacttttaaaaagaaagaacagtaataaaaaaaaaagaacaatggggattttccctattctcttagtgttaagactcatctgtcttgtttttcaagacaaaaccagagtgcttctcctgagtctttatatggctgggtgtctgattttcagcccttggctaccttgcacccacactaaggggtattggtggtgggaggtggtaattcaccacttatgtggcggtactttaaattttggtcgttttgttcccccctccacttgctgctttttaattttcagagatctcaaatagctcccccatgcattctatacagatttccttgctgcattcagtgggggaaacaggatgaagtgttttcgctccatcttgtcaagaaccgaaacctcaccacccacttcatttattttgtgttaaaatacacataaaataaaatttaccttttttatcattttaaagtatacattttactggcatttaagtacattcacaatgttgtgcaaatatccagtttgagaacattttattcaccccaaatagaaacctcatacccattaagcagtcactcctccttttccattaacccagtcctctggcaacatttaatttgttctctgtctcaatgaattttccctacttcatcttttaacagtttatggagacataatttacataatataaagtcacctatttcaggtgtataattcaatgtgggctttttttttttggatatttatagaattgtaccagtttcttttttaattttttggaatatttctcccagtcttttcctctttagcttctttttttttcctttatttttatctttttttttttttcttttgagatggagtttcactcttgttgcccaggatggagtataatggtgggaactcagctcactgcaacctctgcctcccaggttcaagtgattctcctgcttcagccaactgagtagctgggattacagatgcccaccaccatgcccagctaatttttgtatttttagtagagaagaggtttcaccatattggccaggtttgtctcgaattcctgacctcacatgatccacccgccttggcctcccaaagtgctgggattacaggcatgagcaaccgtgcctggccttccttcattttctttaatgatctgtttcactgtatttttaacccaagataggaaccataatattgtatatttctgtggtttcttttcttaacaactaaatggtgtcttttgaacatttttcatatctctatatttaaaactatgtttctaaatggtacatgttatgccatactatcagtatactatattttttaatttttccattatcacacataatgtttataatttcttttttcatacataatgttgttgttaattgacatggaaataaacatttgtgtgcctctgcatatttttttaagagctaatcttagtggtaatatttctgggtaaaagggcatagaaaagcactgatttatagatttggggctctggtgcatccttaagtaaatattcttccttttttgtttttagagaaagtcaaaacaaactttgtatacaaaatgcgtaaaatatacatcaaaagttggttcctaaaccttcatatcccttagtaaaagtttcaaaaacttacagtatattgtctggtcctggaagtcgggagttgtttcactggttaaaaaaaaatactggaaagatatagaataaaggtgaatgaagacctaaattttatttcagcttaactattttagttgacagtggagtctaccagctcctgatgacagaatgaccatatatctcaaaattccttctatgtgttcctttttatttgtgtccttagcataatcatgtaatacgactccacccatccccttaacccacctatgttttcttgtttggataataaattatatggccactccaaagaagcgtccttggacattaagtaaaacatgtcagtagggcaaagataattaatgcatggcatatgtattgctaatacccactttcctatctgatggccgataccagaaacctatcaggatctctttctgtgattgaaggattggcttcacaattctccccagcacaatcctatggggacttactaccatctgattagaactggaccataaaatgtaacccagttgccaaggcatgacaactgacactactggccctaaacattggagaagactttgtgtgttttccactgacttatcatgaccatctggagtgggcctttatggaggaattcttgcacctgtgatatagggcaagctggggttttcagggaaaagggtggggagtttcatgacaagaggggaggtgccctcatcccaggcagatgctgcctcccacacatactcctgcacgtctctcctcttcccctttccagtctctgacttatcctagctgtgcttctgaatcacacaattgaactccaagtgaagcttgagctatgtagacctaaagaaaaattaaatacataattaattaattatgggttttctttgagctgagtaattaaaagtaactttctgttttctttcatgtttttctgatccggagccttctgacttttccccttcattttcttttctttctaggtttcaagacaacagatgaattgtgaaagagagcagctaagggtaggtgcacctgcttgtaaaatgcttcctgattctcatttttgtgtgataagcaaaaatttccttgtctctcccaagacacgggttctaaataacaggcttcatcttaagactggtagagttgaaaatatttatcccagcttatttagtattgattgagctgttaaatacagtatatcttctttggaagtgccgttatagtagatatggattttttgatttagattcagcaataaatacttttcttctggaatttgtttgacatcattgtactctttttatgtacaacacgaggtctaagtaataacaaaggtcaaaaggatggctggctgccttcttaatatgaataccaggctgtttgctgagtggctaaaatgctctttggctgttgactggggtgggtgagcaaggaatatgtcaagggcgttttctgggagaatttgtgttatctatagacctcttggttttagtgacatttgtgtatatgggagagggagacaaaattttaaaccttatattctgtttccccacttaaaaatgaaactgtcttggtgctcaggcatatcggtgtaagaagtattccctagatgtgcagggagtgtttggttataaatggagcttggtgacattgttctgctttcattgtgtcagagtggacattcttcttggtatggggatggcattttaagaaactttgggatttcttcccatttgttttcttctaaatgaattcgtgttttcagtggatgagatttagattatgattggtgtatttttcatgtcactaatggaagttggcagtttttactggacaatgtgccttatagccatgttttcaaattgttataaaaatcagagaaatatgctgcttttaaaaccacaacagtgggatttggcgttaggaaactcctgtgcccaaaggtgtctaataaataagcataatgtatttaacaggcctaatgccttcatacactgccctgtaacttttcagagcatttacctaatgatagtctcatgatggcaataatttgtagagttgcttccatttcacagttgctgttggcatcaggtttgtgaagtacttgggtaaaataaacaacagaatccaggtgcatgaaaccgagaaagtgagacaaggttttctgtttcttttatgcatatttgttttatgcagtatctcagtatggccctctctacccactttcctccaagtacctgtgccgacattcgttgtgaccctttccttcatggaacagacttcaagatttttaagcttttctgaactgtcttactgcttttttcctgtagtctgaattactggttcatcctgttaaataatgtattacaactttagatttctcttgctgtttggatggggacgatggtcagaactaggtcagagctagataaagagaaatatgtgcctttgtctccaggagtccctgataaatgcctgagaattaagataatattgaaatctctattgcaaatgacacttgcttggcaagttaaggacgcagtaggtaatgaaggacctgtttgcattttgagggattatttcccatttatgagtccattgtcgacaggagtgtggtttaggttcaagaatggagtcttcccctctctgttacataaatgcagggagtggcttgatattaacataatggttcatttagtttagtcccaagtatggctccaatagccccatctctaacatcacgaaccagtgctttgtttgttgttacttttatggtcactgttcttgctttttaaatgaatttatgttttgaattgatagatggcacatttgattggatagagcacacatatatagggttcaaaatttaaatagtaccaaagagagtgcaatggagttttcccttcccacgtgacttaggcgtctagttccctctgggagacccctagtgtgattaagtactggtagctatctcatctgtagatattttcttctgccctcttcatttttgttctctgtctttccatctctttcttcttcctttcctccctccctcttttcctttcacacctgtgtctgtaagagcccttccatcacctcaaaagaaaacttcccttattaaggtgattttttttttcggggggggggggcggggagcttttttttttttttttttttttttttagagagagtctctttctttcatcatgctggagtgccgtggcgcaatctcagttcaccgcaacctctgactccctggtttaagcaattctcgtgcctcagcctccagagtcgctgggattacaggcacgcgccaccacgcccagctaattttttttgtacttttagcagagatggggtttcaccatgttggccaggatggtctcgatctcctgacctcgtgatccgccagcctcggccccccaaggtgatgggattacaggtgtgagccactgcgccaaacctgggtgggggggcattttttaagggtttctgaaaggaatttagaactggaaggtaaatacctgtccatctcaatgaaatgcattttcctcaatctcattttgctttcttagaaagagagtggaagaaaattagaaatctgtttagttaccacatcgttgaagggtaactgtctgcaagccacaataaaaatgtgtcctaagtgcagcagtcaaaatgcatttccagatttgctatccaggatgactggactgtggccgtgttatcatgtcgagggtccttcattagtgcattctgttgtcagaattcagggatataagtggatagttgtcaaatttattccttttccttggcctcctggaaatagcagatgatttagaaagataaagctgcgctttctgttttgtgccccatcgaggctgtgtaggaattggcgtatccaatacttggtgttaggatctcctttctttttctcacgaagcctaaattaatttttccaaaacagacactgtgaagtgcttaatatcttgaagatattaaggagtctttaaaatgatcatatgattaattttaggaaataccatgttaaaaaaagctaaacagtttttattttttaactgcaggtcttctcatagcctttaatttgcaaaaatgaaatacaaagagttggatataatatacaacgtttttctaactcagctgactacgcaacacttttgtttatagaacatactcttgagatcatatcagtattatcagttaagatgctattatctgtgagttatagacaagctaagagttatggaaaagctaagagttatttacaaaaataaataactctccacctcccagttccagggttgattcagaggctttttggtatcagggcagtggtttgcaatccctgtgcttccgttggcctttctttccttcttccaagatgtctgccatctaccccatatcacgttctcacagggcagcactctcatcagaaggaaggagaagaggagtttctccttcacacgtcttgcattttactgcaggaaaataattcccagaattcgtcactgcagtcgttttcttagatgtcattggccaatctctacatcaatcactggcaaggtgaactggaatctcagcgattggctacagcagttatgattcatttgcagcatcaggcacattgttacctgcacaaaagtaggatttacttaaactggaggaagcagaaaatgcactccagtgttgttacccaatggagtctgctacaaaaggaattcacaggggtccactctgtttgtcagggtgctggtttcctgtcattagttttcattactctctttcatcctacatgtgtgggctcagcaactttgtgaattctggtttgtggaatttgacacagatgatttctctgccaacattgaatctcacaggtcacatcttccatcctaacctatatcctaacttttctacccatcttggcattgtctttgtattttgccttgtgtaatttggactgcactggatatagtctttggtcatatcccctcagcattaggtgtgggcagcaggcatggggcatcgtgcattagtaaccagctcagcccacagatgctgtccatgagcttcctgtcccctacccttccccaaagaagggcatcagccagttactcccaacagtagggtcactcttctcagagaactattgggattacttacatcgctcggttgttacgcacactacacaacagggaaacttgttcattcctccgtcccaaggtttgtcaatctagagtagactgagtgttcttctgagcttgcaattcacattattggctggattcttctggggacatggtcagaggagctcactatggaatctgtgcattaaccactcctgatcctataggctgtatttaccagcttgttctagcatcagcacaggttatggtgatagtcgtacagtgaccatatccaattatcaacatttacctctccagcatctgcaccaacagatggacaaataaacaactaagagagaaataaaatgatcctgggggcctgttgtttccctgaactatctaccagttgagggagattgtatgttcatagggtgggagattccaaagcccacctttctgagcactcataaaatatttgattacaaagggatctttgtgcttgagtggtagatgttggtttgggggctgattaacgagcttagttagaaaactactaggtagccaaatgcatgactgccagattctgttctgtggattcaaatactgatctgcaatatggcaatgtgactctatagtcagcatactaggaagggtggttagggctggtgaagcactggtatggacttaggttcagatcccacttctaaatgctccttagtgtctcaaagctttactttacctatacgtaaaataagaatagctttctcataggattggtgactggataaaacaacttcgttaaagcactgaaaaaaaaaaaaaatgcaggcctgatactcaacaaggtgagctactgttaatacagtgttattcccaataattatttcacttctcttcctcctagaaataccaggcatgagaatacagagaacacatatctactgccaccaaactccccacaaggaaagacaacataaagggcaggctctgtatttgatttcatggtgaagtatttaggagataactccctctcagttaaggttgtttggaatgcaaacaatagagacagattccagctatcttaagcagaaaaggcatgcaaccaggcctcccaggaatcagagcttagaatgggaaagctgcctgaactcaacgtatgtcttgctcatctcctgtctttgtttctgtttatgggtccactctggatttttcttttgataaagactccctctacctttatgcacacatcacaccttctagcccctaagatgtatgttgcatcgctttccaccggtatagggactaaccatcagtgcatcctcgttacaaattcctggaaaaggagcctgattggcttagtctggatcagttgttcactctgggccagttggatctgtccagggaagtggtatgaagcaacacagttgcccagggccaactcttgagggaagacttcattactggggaaaaggagccattgctagctgagtaaataacaccatagatgccgggtgcagtgactcacacctgtcatcccagcactttgggaggccaaggtgggtggatcacctgagatcaggagttggagactagcctagccaacatggtgaaaccccgtctctgctaaaaatacaaaaattagccaggcatggtggcgggcgcctgtagtcccagctactccggaggctgaggcaggagaattgcttgaccccgggaggtggaggttgcagtgagcagagatcatgccactgcactccagtctggtcgacagagggagactgtggggaaaaaaaaaaaaaaaacacgaaaaccaccagatatagatctctgctatgctttcaaaatgtggatatcagctgaacaaaggatcctggaaaatacatgtgctaccaccaactgctagctctgtatttctcaaaatataggacacctaccgcacgtcttactcacagctttcaggcgaacactaactcattaagaaagggggaatcacttagaaagttactcccctttccattgtctctctgtggtttttatgccaatcagaaatgctcagtttaaactaaagtatctttagcagggctgtaacactttctaagctttcttttttaagggaaagggagtgtgcctcaggatgagagcctccagccccagagcatctctttgcactttgaaaacattgtttgcaaaatacactattaagaatcaggggcctggagctacgcctactgagataaaatctagactttgcaacttagcactttgtagccttgtacatgttacttcaatcctctctatgtcaaattcctcacctgtatagtggagataatcattgcacagatttcataagtttgtgtgtgtgtgtgtgtgcatgcgcatgtgtcttcgtgtttgtatttttgcatgcaaaaaaagattaaactaattaatgcatatgaggttgttagaaaagtgtctggaataaaaaaggttcttaattattgttggatattaatggatttttttcattaacttttatgtgtgactgttgatattggtttttcatttaccgtggcaatacaaagtttccttggcacacatcgtattttatgttccatttattgttccacttatttaagttaaaaatgggttgctttaaagataaatattaacttcataatgttacatattgcccgcagttatgacaaagattgtgatactggaatgcaaatgactgagttttttagaaatactgaaatcatggtacccgccttgtgaaagaggttgtagagcagatctgcattatcaatatttaatttgccagttacaagcgagtttctcatttctgctagatatgagagtgatgtggattgcataatgaaaattgctaatgatcttcttggcttaaacccatcgccttcatctggacatcagataatgaaacttcccaactgccttgcaattgagctatcagaatcagagataccttctcccgctgtgtctcacccctctccactttttaaagcccagcttttcattccttagtggctcttacgatagcacggaagaaaatgtaagccccccttctccccaccccttggtgagacctcacaggatccatgagttcttcctgactataattttaggatggttcgttgtagaaatgcctgcttctgttcagttatttattcaagaaatattttttgagcagaaaccgtatgccaatcactgtgctaggcagtagaggtataataatatactaaaacttgcaccactcttattctcttatacctcacagcctagtggaaaagacatgcatttgtcaaataatcattgacaaccattggcaaaaaatgttcaatgtgaaactgatgaatatgagaaacaagagatgctgtgtaaaagggtatgaatagaagaagcttacctgattgaccttcacttatcaaacgtaccagattaatacatactgtcccatctctttataaagcatattggcagatgtgcacagcatcctatgtagtgactgtttggtacaaatttacctttctcttcacccgttgcagtgtctgcttgccaagagtcagttgtatttgttcccagggctgcttctgccagctgcacttttcattgtaattacattagttagtggaatattatgtaaactgatgaaaaatgagtgcagtaagaaaaagagctgtttctatgaaaactaaatgctttggaaacattgtatgaaaacacgattcaaaaattattttgcttagctgtgggtgagaagactgtaaaatattagtggaaaaaagccctcagaaatgtggaaagattctgcagtcagattcttttcaatgtgtcttgacattctcattccactttaatcaaacccagaattgataccatagagttaacaaactttaaactttttctgaaaaaagccagattgtgactattttaggacctgaaggccatagggtctccattgcccccactcgacactgccataatagcacaaaagcagccatagataaaatgaatgattgaggctatgtctcaataaaactttatttacaagaacaggcagtgggccatagttagccaacccctgctggtgactgaaatgttagtgaggtgtatgtgggaaggttaatgagggatttttatcaacagagaaatcattcaaagaaaaggccttagactcacatcaaagatcaataaatgcatgcacgttcatatgttttacattaaaacaaaagcctgaagttatttctatatcactttaaaagtgatttcttgctttaaaggcttccagttaaataccttctgccattctcaaatgaaatggcttttaaagaacagaatagctacaattagggctggaaacacaaaataaaattatgcttatttttatgttccaaccctaatgactcagaaccccatctgtctataatggaagaacaaatttatccttttttattggatcccccagcaagtaatttctgggactccccaaggagggtgacatttccacgtatacatcctggtgcttgtcctatgcaaattgttgttcggctgttccagaattctcccctcacttaagaaaagtctggtaagttccctctctggattgttctgtcctcaaaagcattcctctgtaagcatgaataccattctttgcattaactttccaaatgatcagctaaagccagacttcagtgattagctcaggggttagcagaaatcccaggtaggtggtgacttacagagaaccctcaggattcaggcctgagatcttcatggttgatgagatttcatgtatgttctcctgtgtgtgtgtgtgtgtacgtgcacgtgcacacatacaaggaaaaaactggcagaagtttgcttgctttaatcttacataacgaatggtcccaactttgtgattttctccaagcaaagggagtttgccccaaagtaattagttctctacttctagaagctgcaggaactcaggcaaatgatccccaggggcagcttctctagtaaaataagaaactcataagtacatttaaaatgttttttaaaatgttttttaaatgtcatcttcacaagacctgttccatacagagcttgtatgttctccagtctttgcaagaacattaattgatgaacgcaaggaaatcaacttcttgattgattctgatcaagaaatcagccaactagtcacagattttaatttctccaacttcattgtgaaatatgattaaataaagaagtgtacaggtgtccacttttcttcatttttgatgctgaatcttataattcacatatatgttaattaattctttgagtctccccaggcatttgaacactttatttggagaagactcaaaaaaaagttcacacatttaggatatttggcctaatattcattctccctttcccttgctttaatttagcctattatccccagtcctcatgcccctttccagggaaaatctattcccatttcttgctttatcattaaatctgtatcaaacagctccaagcaaatcgctaataatgctgacattttaatttgtcatagctactcttcatttctatgactgatgcctcagcaaggacttgtcttcctgctctgttcctttgaggtctaaataccatttcaggagaaaaaaaaatacgtgataggcaagggaaatagggcaggaagcaaataaatagggcatctctagttccctccagttgggggtaggaaggggcaagtttcagtgggaatgagtaaggagcaagaaactctcctttcctgatgatgcagacaaacctgagatggtcccaggaaaaatggcaacgaggccgggtgtggtggctcacacctgtaatcccagcactttgggaggctgaggtgggctgatcagcaggtcaggagatcgagactatcctggctaacacggtgaaaccccatctctactaaaaacacacaaaaaattagctgggcatggtggcgggtgcctgcagttccagctactcaggaggctgaggcaggagaatgccgtgaaccgagatcatgaggttgcagtgagccgagatcatgccactgcactccagtctgagagacagagtgagactccatctcaaaaaaaaaaaaaaaaaaaaagaaaagaaaaaaggaaaaatggtaatgagatataaaagctttctgtcttccttcatggccatagttaaaccttatttaccctgtgcttgtatgtggatgaatcatgggtacagcaagcatgtgcttccttgttgtctgcagtatatgcttccttgttgtctgcatccaacagacatttctgcctatggtagctagtactttattattctatttgggttaaatttcctctttcacgtgtgcagtcttggagagaggataaatcacaacacctgtccctagccaacagatgtggatatggccaaggcaggacagttgaattctttctcctgagactctgaatattgagtagggtaatgctaaatatggtgaagaaaacaagcatgattgaaaacctggagttcattcatttcggtagtgatattctggtgaaattgagtgaagagacggttcccagggctagacctcagattcaccctgattcctgcctttatgtttaaccctggttatccatctatccgtcccttaagctacctcatctcattcaaatgatcgccatttttttttttttttttttttttttttttttttttgctgaagttagtcagacctattccttttttctgtgatcgaagaatccctactgatacactggggaaatgtgctaaacttggagaactgcagagccaagagtttggttaaaggtttgctaaaagccaactcttcatcataccctgcaatgcctccctgatgcctctgtgaatcggcgctgactttatgtattgacagctaagagaaaggagctcttggtttagggcacacgcagggctagatgcttacctgaatttgtacatctttttgggtcagttctcagtcatcaagagcaggtaggcacaggaagagaggtctgtgcttcagggtctttggaactctgtccttccctgtaggagtaagatattccccccaaccccaggggaccacccccgtgcccacagataaaggatctgtatcagtatcaaagatatatcagtatcagaggaacttgtgatgttacgggatcatcacatgtctctctgccaacttcttccttctcagagtacccttcaaaggccactgagaatgtttataacaagtgccatttcctcagctctaccccagacctactggatcagattctggagatggacccaagggactatttttaagccatttctcaagtgggaatgagagttgagaatagtacttttcaaatttagctggtaaaatgttttgatgtctcagccttatcctaggaatgctattggcccttcatatctgtaggtttcatatttgcagattcaaccaactgtgcttcaaatatatttagggggaaaaaaaacccaacacacacctgggtctgcacggaacatgtgcagactttttgtcatcattccctaaacattctggataataactgcttacatagcattcgcattgcatcaggtattcaagtaatatagagatgttttaaagtatgtgggtggatgtgcataggttatatgcaaatatcactccattttatatcagagacctcattttatatcagcatccatggactttggtattcgcaggaagtcttgacaccaaggtccatggatatggaggaacaactatactaaattatcatgttatatgggctgagttgtgtcctgacaaaagtcatacatggaagttctagcctctagtaactcagaatgtgactgtacttgaagctaaggtctttaaaaagataagtaagataaaatgagtccataagcgtgggccctaatccagtatgactggtgttctttttttttttttttttttttttctgaggtggagtctcactatgtggcctaggctggagtgcagtggcgtgatctctgctcactgcaacttccgcctcccaggttcaagtaattgtcttgcctcagcctcctgagtagctgggcctacaggcacccgccaccatacccagctaatttttgtatttttagtagagatggggtttcaccatgttgcccaggctggtcttgaacccctgacctcaggtgagctgcctgcctcagcctcccaaagtgttgggtttacaggtgtgagccaccatgcctggctgggtggtgttcttataagaagaggagattaggacatagacacgcacaaagggcaaactacatgacccaaagggagatgatcacctaccagtcaaaggaggatgatctgagaagaaaccaacccccctgacacctgagtcgcagacttctggcctccagcactgtggggaagtaaatttctgttgtttgatttccctggtccacggtactttgttacggtagccctagcaaacgcacatctaaacctcgtgagaatcaaatacattgctactaaaatcaaaagcaaatgaacaaccaactaaccaacaaaaagccccccgaacttgatagttcatcctgatgtgtattggtacctctgatttaattacatattctaaatcctattgcccttttgaaatgcaattttaaactagctgtggtatgatactccctctgtatgtgcattttcttgtttacttaaaaaatagtggactcccttgggggatagagatgatgtccttggctccctgtgtgtcaccaccacatacaacaaatcagatggacgcagcaatcctctattgttcgatatggatggagaaaggaacagatgagtatgtgagtcacagcgtgttacttggtttcatctctggagtttacagcctcctgtgagaccaattctgtatggagacgcatttgtaaccttacctaaatgagcaagcaactggtgtttggaagaatgcattctaatatttcatggtttagtgcccctagcttacttagaaattttgcttctatctagctttcttgtagcgaaggtagaaggtgcccgtgtggtccttttagggatgatctgatggagccgtgtaatctgctttcttcaggtgcacgtctcatcttgaatgccacctttcccctgatacactccacctgcccactcgtgttcagcatcatctccaagcaccctgcctcgttcctctgtccacatgctccatggttttgcatgggtttttctgaacctgcttctgcagcaaagctgccatctatctaagacgctgaccctttttaataccatttttctaaaattgacaaattaaaatggtatatccttattgtatacagcatggtgttttagtatgtgtacattgtgaaatggctaaattgaactaattagcattgcatgacctcacatacttaccttattttttagggtaagaatacttaaaatttacgctctcagcagttttggggaatataatacgctgtgattacctgtagccgccatgttgcacagtagatctgatgaactcattcctcctgtctaagtgaaagtttgtattatttgaccaatatctcctaaatcctccagcctccaagcctctggtaatcaccattctactcttgcttttatgagtttaatttttttagacgctacatggaagtgagttcatggggtacatgtctttctgtgtaaggccctgatccttatgtgtttttcccccacagtaacttgtgtaaaaccctatacccagagaataacaaataaataacaacaaaaaaaaactattaccaattgaaatggtttaattcactccaagggggaaaaaagttttgcaaacatctaagtcacttcagagtgttttgatagtatttgcatgagaatcttaaagcctatagtcattaggcacaaacaaatgctaagcaatgcacatattagtccagagattctctttaattcacacttagagaaaaagggaggttaagagttagaaccatagctaattgtggagctgggaattgaacccaggtctatattcacttgttttgacaaacatggtacgttaccttgatgtctattgagattgccttagctcaaggtaagaatgcatttgctttttagaaaggagctaaaatgatcagtcccattgtgaggctaagatacgagaagggtatggttttctttattgatttggactttggggttagacctagcattgaggcccaacctttgtaggatccaactatgacaggtggaaaatgcctcccctggttagttagaaatttaaatagctaccaaatgagctgagtattttatgtgcaaagttttaggtgctaccagttaaattatttaacatctaccttcttgaccctgactcataaagcggggggtgtttttgttaaaagtgtagacaatttcccaaaactatagcagcaattatagaaatctatgtgttctaatttaaggtccttccacagtcaggactgaagtcactgagtggattggtggttgaaatcatttcttctttgtatgccagggttttccagggagaaaagtgaaagaaaacacaaaggtttggttcaataagaggagcacttgatgtcaactctgtcttcccagccagtgagtggcagaatccttctatttctagccatttacttattttgaacccagaccatttattttctaaaaacagattactcatgtggtagtttatataccaaactgtagaatttttcattccaaagacacatggaaatgcctctttatgctcctaacaaacagtaacagattatgcacacagagcatctactgtaagtaaataataataagttaagctgaagggacacacacagaatctataccaggcatatctgaaggggaactcatatgccagcggcagccttccatgcttgtgacatgggcccggagaactgaacaggtgatcctttcaccaaacccagagggtgatcttgaaaacttaattaaagcagagttcttccaggcagccgaaattattagttcagagttggtactcatgttgaaatctgtgttagttttttattgtggccctaacaaattaccacaaaaaaaatagtggtttatagaacacaaatttactattctgcagttctttaggtcagaatttcaacaagaatctcactgaagtaaaactgaaatgtcgccaaggctgtgtttcttttggaggctctaggagagaatccttttttttttttttatcattctgattgcagtcagagtccaattccctgtagttgtagaactgaggtccctgttttctttttttgttttctttttttattttattatattttaagttttagggtacatgtgcacaatgtttaggttagttacgtatgtatacatgtgccatgttggtgtggtgcacccattaactcatcatttagcattaggtatatctcccaaagctatccctcccccgtccccccaccccacaacaatccccagagtgtgatgttccccttcctgtgtccatgtgttctcattgttcaattcctacctatgagtgagaatatgtgttgtttgattttttgtccttgcgatagtttactgagaatgatgatttccaatttcatccatgtccctacaaaggacatgaactcatcattttttatggctgcatagtattccatggtgtattttactgggtgtgagctgagggtcattcctagtgtctagagggcgccattttttttttttttttttgtaattcatggctccttccttcatctttaaagccagccatggtttcatgaatcactctcatggtttgactctctcgtgcctcttcttctgttgtatctgtcggactggtttctctcctgcttttaagggttcatgtgattacgttgggtccacccagattatccaggataatctccctattttaagatccgtaattataattccattggcaaaatcctgtttgccatgtaccatagcatacatagatctaagatcagccagccaagattgtcggtccaaaatcatgccacactagttatgtagtatccccactctaagtagactgattctccatgtgtattcaaacactgcagacatttgatttgtgttctgggatggtccacctccattttcatataaaatatagaaagtcagagaccagagcattcagaactaccatccaaggtagcccagggtggccattggcccaggactcacctctacctgccttttgaacttcttcttttgcagtccctactggcattcattgcttcaccatttaagtccagctgttacaaaagaagcattgttagaatgtctaccataatagtactgactctttgatactattattattattattatttattattttgagacagagtttcactcttgtttcccaggctggagtgcaatggtgcaatctcagttcattgcaacctctgcccctccgggttcaggagattctcctgtctcagcctcccaagtagctgggattacaggtccctgccaccacacccagctaattttttgtatttttagcagagatggagtttcaccatgttggccaggctggtctcgaactccagacctcaagtggtccacctgccatggcctcccaatgtgctggggtttcaggcatgagccaccgcgcccggcctgatactattttattacttgatagttctgttgatttctactcacgaagtgtgtcaagtaaggtaatgagaatgtagaaatgtaaaattattaaaaccagaagcatttgtatgtgtcacttaagtgctaagtaaaacacatgaatgaatgagtgaatggatgtttctaaagactctaggagatgtctgtagcagatggcatcagatccctgacattattttatcacccactcctttatgtcaaaagctggctatgaaaaacacctatgaacctatatattttttaatcctttaatttatttattttttaattattgttttttaagttccaggatacatgtgcaggatgtgcaggtttgttacataggtaaacatgtgccatggtgttttgctgcacctgtcatcccaccatctaggtattaagccctgcgtgcattagctgttttccctaatgctctccctcccatcagtctccccaaagaggcccggtgtgtgtggttccccttcatgtttctgtgtgttcgttgttcagctcctacttacaagtgagagcatgcggtgttcagttttctgttcctgttttcgttcactgaggataatggcttccagcttcatctatgtccttgcaaaagacatgatagtgtgcttttacactgaacctcttcataagggctatttttctggctatgggacacattcctttcacggcctgggtaagcaagaagcatcatggaattaacaaccctggaaaaagcactcaactgaggataaatggggacttagtggatcgtgccccagcttcctcatgcgctagagtaagtggggcagcatcgaggtgtgttctgccatctcccagagctctacaatgggattaagccccagttgcccatagtgggcacttgctcgttaacaaaaattgtgttcctcctatccatgtctcaatttccattccccattgatgttcccttacatcactccaaaatgtagaatttgcgcttgaattttaccccagctctgctttcagggaaacggaaactaaaatagtacattcgccataatgagaaacaccatagcctaataattccatcaagtaaggttttctgatcagtggatattctcatcatcatccttttgccatcagtcttttatccctcctcctctttttcctctcttgcacagtacatcactgctgttgtaggatgtggattcttggattattgaataggtttgcaagcaactgccgctgtgctcatggtgcatttcccaaaagttaaaaaacttgagtttggctcactgagcgatcagagcacgaggttttgatggcacagtgtcttgctcacatatgaggagactgatgtatttgctgccacattccactcatttatacttgcctcagtgtggtttcttatttgcaggttgcttttaacaatatagatgctttcctggatagagaacatggaggcatgattttggaaaacttgtctgcctcagatgcacccacgcatacacagatatatgcatataccgagtattctgataacaacttagagatttaaatatttttggcaattttgtggtgttattttcaggggttgtatattcttaatcttgattgcatatgtgtcttgacatctttacgccaaaggcatgtttttatagatgtctgaattaaacactgaactcttttcaagatagctgagtttacgtttaagtggttttgattaacctgggtttgcttatttgctcctaaatgttctaatgcagagccatctcccttggcatgaagtgatttgggagcacagctttagtaataatacttttctaagtaggcaagagcatcctgccctgaatgtttcccaaaactggccttaaactgaagaattgaggtttagccatcccccttccccttagccattcaggtggtgcggattgggaaactggaacctaactgcacagacaccaaattgaccaagggtgacaaaaccagcactgacaagactgtggttgttgggtaggtgaagggttcatgagctagtaagcaggactcagcttggaatttggaaaatccttagtgcaagcaattttgcccagagtggcatgttgtcaagttgtcctcaagctacatttgccattaagagaaatgaacttcaaaaaacagcatagcccttcacaagcctatctttactcaaagcctgagaaaggagggtcccatctggcttaacacattacaatttcttcacaagtggagcttctcggctgctaccctgaagcttccgttttgactagtattggttcttaggtatcacagaggaattagattattctaaaagcttttattgagcatatactacatacaccactaggagaatagtaatgtcttgctctcaagggctgtgcattctggtaggtggtgtgaaaaggtaggtatatgtaattataatgccaggaaaaagaaaatgcgatttgttagtcatgaaattaggtgttagaaaagcgcagaggagagtattattacccctcctagcctcctagctgcaggaagtgtggcagatcatttaaaggatatatatgtattacatacatattatattttatgtatctgctaattcttggatttttgaatagatttgaaagcaactacaacttgatcacaaattgttgttggggtcacaactgaccccaacactaatttgcccagatatgtgtgtgtgtgtgtgtgtgtgtgtgtgtgtttgtctgtatacataacctgggtaatttatacatacatacatacatacatatatatatattttcccagtattgaaatactacctgaattctaggtccctatacacaaaaagttactgtttattttaacttaaatatcacttagacatcttaaacttcatatacccaaattcacactcatcatctgtgtcttctacacacacacacctgcccattaatctgctcttcctcccttatcatgtctttttacaacagctcctaattcagttgttgagaccagaagctcagctgttgctcttcactactacatctttttcagctctaccttctcctttagatttgtgattcctaatatctcttaagtctatgaattcctctcaaaattcactctcgcaaacctactcgaagtcataacgatttctaaactagattatttcaatagcattccaactttctgacccgttctctagtctttgttccttttacggtaaacatgtatcttgagctgcctggaacaatagtagttacaactgttgtcctggtataattattaatagcactttcttctttccccagaaagtcctggtttggagaataaattatgatcactgaaccttctattcactccttagggccagaatgacctttaaagagcttaattaatgctactcttattcttcattcatcactttcattacagtgcttatcaccttccttacgcttacccacaatctgttattccctcgtttgttttgtggtttacttggtcatggtttctcgttctcctgtcttcttactccctttagattgactcctcttaagggtaagagaatgcttattttgttcttaactctactctctactgcctataacatagtagaaactaaatattaatacatgtttgcaaataccagtggctattgttttttgttgttaatacaatgaaagaatcagtatgcaccaataacataatctggctacaagataaccgttattctagaaagctgccctaggaagagatttcagaatatttcagaggatcttctgttttttgccatgttagaataacttgtaccataaacaactttaatactggacaaaatatatgaagcatcattttcaggcaatgggtacaaagcagcacagagctgtgatccttcagagaatcggagacatgtgagatgaagctaccgttggcccagttttattcctgggaggaacgtcttgaacataagtgctctgagatgaagaatttacaagttggggatgaggaagtagctggaatttgtggaaccggttgctacagaaaggacagatctgtgtgggaaggagaagtctccatgccctgagttcttggctgaggaataagccacttatgtgcagggtcaggctttgtgagtcctcacagggagggttaactgtgacacagaggccagggtagaggtagtacaggttgtaggtattcagttgagactccagaaagatcagactttaggagtaaagtgtgtatcttagggcaagggtcagcaaattatgctctgcaggcaacatctggctatgggctgtctttgtagtctgtgatcaactaaaatgggttttagatgattaaaacttaataatatgtgactgagactattttacctgcaaagcctaaaatttctactatttggctcttttcagaaaatgtcagccaatcccttccctatatgaaggggcatggcccatgactgtagacaaatcctaagaagatcttcccaacaaagcatgaaaatgagctttacagggtcaagagcatgcatgagttagccgagcgctgccagaacaaaactcaaccaccatttaaagaaagacgatataattcagaccccctacaattcgttctatgtattgaaatccacacaattgaaatgtccaatggtaaatgtccagtaatgataaataccatggctggtgtggaggctcacacgtgtaatcccagcccctttgggaggtcgaggtgagtggagcacttgagcccaagacttcaagaccggcctgggcaccatggcaaaaccccttctctacaaaataataaaaaaaaatatatacaaaaaaaaattacacaggaacggtggcacatgcccttggtaccagttactcagggggctgaggcaggaggattgtttgagcccaagaggtcagagtgagctgtgatttcatgactgcactccagcctgggtgacagagcaaggcattgtctcataaaaataacaaataaataaatactagatgtgtagaaaagaaaaaaaaattgactgacaatccagagcagtgtttggcaagccacagtttatgagacagctccctgtttctgtaaatattcttatttcattggaatatagtcattcctatttgtttccattttgcctatggcttcttttgttttgtaacaagaaggttggacagtttcaacggagaccatatggcccacagagcctacaatatttgttttctgtctcttttaaggaaatgttttgtccactgattaggagaaaaaacagtcagtagaaagggactacaagatgacccaaatgttaggattgaagtagacaaggactttgaaataactgtttgaaatattgtagggtttataggaaaagatggacatgatgagttcgcagatgggaagtctcagaaatcgaatgaaaaccataagcaagaaccaaactgagattctgttaggttgatgcaaaagtaattacggcttttgccattaaaatgataataattaaaataatggcaaaagctgcaattattttgcatcaacctaataaaattgacagtacagtatctgaaatgtaaacatcagattgtaaaatgctgaatacagaaatctgttaacttgaagacagtgaagaatagaactaaggaacaggaagaagaaaaatattgaaaaaaattgaaaaaagcctcagtgatttatgggaaatatcaagcatttaaatacatataattggatttctgaatggagagaagagacagacaatgggacaaaaaaccattttaaggaataaaagctaagattttccaaatttggtgaaaacatcagcttatactccagagagcatggggaaaaacaagcagtataagcataagaaaaaattatacctgaaaacattataaagaaatgcttaaaaccaaagataaacagatgcattttcttttggaaaagagatctatatttgtctattgcgcaacatatctctgtaatgagtacaggtaactaagttctctaaagccatcccccagtgagacattgtgaaaacttctgggattggaaatggtgaggttgggaagaggtaggggagctcattgagagtagaatcaaagggaagtcaaagggtgagaattaaagaaaaagagaaaaaaggggcaaaggaactccccaaagcgtaaaagcaacatacggcaaattcgatagtagccaagatgaagttctgtgttatttgaaatgtgtactcatggggctgaggctgtgcagttgatcttactacagacaagttggttttgttctgttgcataggtacagactgcagtgatgttgcatatatagggaatccacttctgggtaccaacagtaaaagtgcttcattgctcagtgatgatcaaaccgtcttcaaatgcaagcagttattggttttagttaacaattatttatagagcactgagaggttgcccaaaagaactctaggagaagagttgggaagtcaaaaactttcagttgctgtgttgccttgtaacagtgtttgttagcatacatgattaggggaaagaaggataaaacagttgcaagtatttaataatctggaagttttacagaaatatctagattttttttggcttctctttaaaacaataagtattaaaaaataaaagcccacacaactttgggtttgcatttctttttattttttcttttttttatttatttttctttttttatgagacggagtctcgctctgttgcgcaggctggagtgcagtggtgcgatcttggctcactgcaaggtccgcctctcaggttcacaccattctcctgcctcagtctcccgagtagctgggactacaggtgcctgccaccacgctcggctaattttttttatttttagtagagacgggatttcaccgttttagccaggatggtcttgatctcctgacctcgtgatctgcctgcctcagcttcccaaagtgctgggattacaggcgtgagccaccgcgcccggcctgggcttgcatttcaacatgtaaacaatttcctgtaactgaataaccatggctttatttgaatgaggcatactacactttgccaccgtccttgcacttccctattagtcccctaaactgacaccagttgtcagtttctatttatcctcacacttgggctttttttttttttctttttttttcgagacgagtcttgttctattgccaggctggactgccatggcgcgatctcggctcactgcaacctctgcctcccgggttcaagtgattcccctgcctcagcctctcgagtacctagaactacaggtgcactacctgctaattttttgtattttagtagagatggggtttcaccatgttggccaggatggtcttgatctcctgacctcatgatctacctgccttggcctctcaaagtgctgggatttcaggcgtgaaccaccactcccggccatttttttctttatggtagaattaagtagaaatgaaatcatttattttacccgagtctttgtcaaaaccagcaaaagaaaagaccaagaagagtcccatgcttgagaaaaaagttaagaaaataggatataccagatttcttggtggaagtgtaaaatattttcatatgcctaatatacaaaaaataatgccatatcccttctcacttgactcaaatggaacacctgtgggatgcctgcagatacttgaatttcttcaaattactgctttagcaaaactttatttttgcacatgaaatttttttcctcccaataatataccatcatactaacaaaggttaacaacacaaagtgtaaacaattctaaataccaccttcccatttctaaccaagatgttcactcgtaacagtgtatgcataatatgaaatgaccagtttaaacttccattccaatgtcatggtttatatgcccactcatatacctcctgtgagccctggggataatgacacagtttcttgtacaatttaagtggtgtcacctctctggagaccagtgaacagactgctggttgttgtcttagttaaacacttactttctaacaattttctaacattgcatttctgaaacagcttggaaatgtgcagtgttattgggtgtacgcgagagaggtgggcaaagacatccatctgatttcttggaacagggccatttagttagtggacgagacctcagaggttttctttgcacagacttctcctgatgcacttataattttctgcccagaaatctcttcaaggcctgtggagttttagctctgggggaattattcctctgaataagcggtttcccagctgcgcacataatgctccaatcaggctagtctttgttcagacaatccatgaggggaaatgttggcattggtgggcaaggtactgttagccccactgtctcaaagtacatcggtgatgtccatgtgtaactgaccaaagtaaatgcagttttgcaaactgcaatgagttttacgtgatgaattttcctacaaaagtcaaaatgggaaattcaggttagtgtaggtggtgaagctactacatttattagcatcaaaagcacagagtctcaaagacgaactaatctgtgaataactgtgccattagtaagatcataaacatggactaatggggatatggtacagtgaaatgctggtatttgcagcctgtcatcatattagtacaatgatgaaatttgctgctaagttcctcagcaaatgttcagtatcatgtttgtgcctttttgttataatttgtaccgtattagtagcaacttaccatattagtgactttaaaatgtttttaaaattatatctgtcgggttgatagaaatggaatgttctggggttgtgcaagtattagtcgtattaaacttgtcctgttagcagctttcccttgaactgatacttaaatgaggttttgatataaacaaaatgtgcttctgagatgtgcttccagctacaaccaatttctcccagtccattagctactttgtatcccttttaagcaacttgagattgtgcttttattgaggagccaaaatgtttgctcaactcattaggccaaacagagagaaagtaaactcaagggctgtgctgtctcctgagttactctggggcccggtgaatggagcattacctccatcactgctaagacagacaaacaccttttgagattttcctgcctttgcctctctctaccacttgctcctcctcctctttggctcatgagaaaggctggtaactccactgttcattctttctcatctttagtctctggatttcaaaagtcatcgttttcctgcagaagaaggagaaaggagcattgaataggcaaaccagctgatgtccactatacagagttttttggtgttagaaaagctggtttagaaaccaccttaggaagtgacctaacccagaaatggtttatctttgtaaaatggctttctcttgtttataaccaaccccatatactttatttatttatttagatggagtgtcactctatcatccagtctggagtgcagtggcacgatcttggctcactgaaacctccgcctcccggattcaagcggttctcctacctcagtctcccgagtagctgggattataggtgcctgccatcacgcctggctaatttttgtatttttaggagagtcagggttttgccgtgttggccaggctggtctcgaaaccctggcctcaagtgatccacccactttggcctcctgatgtgttgagattacaggcatgagccaccacacccagcccgaccctattttttattttatcttattttatttattttattttatttttttttgagacaggctctcgctctgtcacccaggctggagtgcaatggcatgatctaggctcactgcaacctccacttcccgagttcaagcgattctcctgcctcatcctcccgagtagctgggattagagtaatgtgccaccacgcccagctaatttatatatataccttttttttttttttttttttttttttagtgaagatggggttttaccatgttgtccaggctggtcttgagctcctgacctcgtgatccacccaccttggcctcccaacaagaccctattttcaaatgaggtcatattgtgaggcactgggagttagggtttcaaaatatcttttttggggggaaacatggttcaactcatgacagcctgaagtctttatttacgtgtatctatcccatatggtgtaccattctcaatcagcaggagccatacattgtctgttgctgtaggattataatcagactcactgacttcacttcctatctctgcaccatccaggcgcgggactgcatatgtttattggccaaacccagttttacttgctcatcatacatctggctctgccccaactggagcttgcaaactgagggttgggcaggggaggtttgttaagaggagaccagtgcatgttcctaaaagaaggggagcagaggaaaggtatgctgagcaggtacaacaaagaaaacacagaatgcttcatatggaaagttctgcctgagcagaaccacagtttacactgtgtacctgcattttgtcatgcagcacaagcaagaatagagggagctattcagcaactcacagtccttctttgtcaagttcagattgtaaattcttggagtatttagaggtggtgtcacatctgtttctctccctctgtataaagaaaaataaaatgccatattgaataagtacctcataaagccttttgcgttatgatggagagacagccaggaagatgagagtgaaaagtaaacattttcctgcatggcaaatggaggcttttgagggtgcttgagatgtttaagctcttgtcttgatctaggtggtggttacacagggtggtgtttgtgtgtgtttgtcaaactgtacacttaagatttgtgtgctttaaccccatggttgctagtggctgtagggtgataatgggaagttattattaagtgagtgtagaattccagttttgcaagataagaaaaagttctgtgggtggatggtggtgatggttgcccaacaatgtgaatgtacttaatgcagctgaactatgcatttaaattagttaaaatattaaattcattgtgtatatatatatacatatatatacgtatatatgtatatagatgtatatatatatacatattatatatatacatatatacatatgtatatatgtatatatatataaaaccacaatttaaaaaagactagtatactttactatatcaatattattcctcagccaaaaagtaaaagtaaataaaatgtcccattcccatttgtttttgggagtcacaagaagggttgaactgacctctgatttcatgcagcgtggacaggcaattttagggatctttactgcaatatctcagcagatagctgaacactggcataaatagattatttcctccaatgccttgcctatcattctgtaccttcttcggcttcctaaatcctagcaacaagtaacctgtctttatcctggcagaacggtcttcactatgatttcagtgccaaagtaatgactgtttgtactgaatacatgtaacagagcctcattccttagggaatgtgtgtttttccccttcatgtttgttataaagtttgcagatcaccatccctgtagtcacttaagctctctgacctgttcagagattcctcagcaatttgctctctgggtatccttttttcatggtccatgttctcttggggtacactcacaactttatttttctagctgcatgctgccattttgggattggctgccatatgaaccctgggtgttagggtatgcttcccatcacagatgacattgaatagttcaaccctctccatctctcctcttgcaaggtatcatcatcattcattgcgtggaagaccacaacaaactcttgactggccttttcgctgtcactttgcctcaaggccacaatccatcctcaggaccaagggagcctttgaaataagtcattccctccttgacgttcgttagcagtttctcattgcttgtggagcaaaacacagatagcacctttagtaactaaagctctgcatgaactggtctttacctcacttcccctcctcagcccttgcgagttgctggccgtagccacactggctttattttactttttttgaggcagagtctcactctgtcaccaaggctggagtgcagtggcacgatgttggctcactgcaacctccacctcccaggttgaagcgattctcctgcctcagcctcccaagtagctgagattacaggtgcacaccaccacacccagctaatgtttgtatttttagtggaggcagggtttcgccatgttggctgggctggtcttgaactgctgacctcaagtgatccaccagccttggcctcccaaagtgctgggattataggtgtgagccaccacgcccggcccacactggccttattaacatgcagaacatggtaatagtgttcattctactaaacctgtttgtgtgtttgtgtcctaaactttagctattataacttggccactcctcatgggggaatcaaagggaagctgttcttggctttagagaaattcacctcccaaggctagaaaaatagaagcactcatttctcactaatgatgggaatgagagtagtgggagtttttatatggaggacattatttatgtactttttaaattaatttgttcattgactcagtacaaattgatcatctcactacacctgtgttgtatatctcaagagttgggtagtcaagtgatagttttattattgtctatatttcataattatttattttaaatatttcataatgagtaattttttaaaattatactgatcaccctggccttggtaacatggatgatttgaacacctgcctggagaatccaataataggattgctcttattgatgaactaatatgtttaaccatcttcctgttgaggtcagtctttttagtggcataaatattccttccaggcagtggagtttgggataatgtagtagaaattgctggagtttctcctaaaggagaagaatctgtgcttgctcctgtggccacagagatcacaactggaaatgagcagccacgtggctgaaagtggaagaagcgattgaattcctcccatcctctctggttcatagtgatggtcggtggtaaccaccccaatttgcaggatctgggagaaccactctggagatcactccttggtatcctaattccctgttatctatcttggtaaactccagccttctggttggatattttagctactgcaacattgaagacctatggttcaggatgaatctaccttctcaggagcttcagttgtacagaatacattgtcaagtgatgtcctgtaaacacatattaaatgaaggttccaggctgggcgtggtcgtttctgcctgtaatcccagcactttgggaggccgaggtgggtggatcatttgaggccaggagtttgagaccagcttgggaaacatggcacaaccctgcatctaccaaaaatatcaaaaattagctggatgtggtggcatgcacctgtggtcccagctacttgggaggctgagatgggaggatcgcttgagcctgggaggtggaggttgatcaaacctccacctgggtgacagagtgagaccatgtctcaaaaaaaaaaaaataaaaattaaaaaaagaaggtttcagcactgattcagttgagtttatcaagtcatttttcacatttcgttcagtgtttagtaacacaactgtttaatgaaggcttgcagactttctttcataaagtttaaagttgtatgctgattgctgtatataattaatgtatcacaatggcattcaatttctgtagcagatcagaagccactgaaacagagaggccaccagtagcttaatcagtgttggtttcaggctattgctttgcagttgattaattattgtgttgagttgataactgataactggattaattattttaaaataatttctcttgaagcttgacaacaagagttgtaaatgtttccactgtgaaagcagctctggacctaccagcctgcttgtaaatatggaaaaaaatggttttgaattgaatatttgaatatatttactttgttattaaaatgatttaaaatggaaggttttgggagtgacaataaatagaaaatgtcactctgctcatttcaaggaacaaggtttgaggaattgattgaatcatcaatttggttatgagcagaatttaaaacatagaaataatttgctgacaccccccgaggggacagtccacggaatgttccattccgtctgtttaacctctggactccagagtacagggattgtaacacctcccacacttgattaatgggaaacagctgtctcctgcttgtgtcacagtgataaaatgtttctccatcttagggcgaatctcattccttgcagagggaccacatgttcaagcaggtgggagaatgaatgggtgcaaactgagcagaggcaggaagagcataaccaggggactcatttaggctcacagaagcttaagattaaatataaaaaaacaagaaatgacacataccaatccactggtgtatcagaggccatgaagtatagcctgtgtacacccctcaccgtggatcaaatgggtttctttgttggctttctcagagcttgtaagagaactcagtctgctaactcagatgcacaagaaacaacttattacattattcatttttaatcagtttaattttaaatccagattcttatccctatcaggcaaaatgttcactttcagctatttcactcctttcccttttcctagagatgggcaagagcctgggagaaggtagtgcccagaaggcaccgtgcatgggtcagttgttagtggttgccatggtgacatttgctttcaggtacacatagtgcatcttggcttggtggctcccttggttctctaccatcctgaggaatggtgactctgtggtgaagctaggaaccctatcacttagcatcctgcccacctagaggtaccatgcagctgtttttttcctgggacccagagctgtttgccccgctcacagtcttgataccctgtgacctgttaaaggccctaacactctcctgatcatctttcaggtcatttaccctaatcccacccgggggcttctgatcaaacgtctgcaaagcatgggcaaataaatgtgtgggacagacctggtataatacaatcaaaatatggaaggactgtggtaaacaggagagcatgattcaggtccaaaggcattcagatgcaattaaatataacagaacactgtgctggtcaaatggactatatatgtatatatgtgtgtgtgtgtatagaggtatgaactaatatatatgtatgaaatacatatatacacacacacttatatgtgagggagtagtggaggagggaagaaagaaaaaaatgtggatagaaaaaagcatattaatatttgaacaaataatcttgctatgtacacctcgaagaggaaaaaagaaaatgtgaatttgcatggacctagtaatgtcttacttagagagatccattctttcctttagctgatttcagaaggccacttgtgagaaatagtgccccatgcagcaatgccccaaaagaaaggggaatgtcaaggtgctgcctcataactgacttcagtgactatgtgagaggtataaaggatttcagaggtggtgatacatttcttcaaattgagcttcaaagaccagaggctgattggtctcctgtgctcacttgccctaagtgaaatgaggtttctccgtaatgtagaataggtgacctgtaactctcattgcagaaaatgagcattgagtgaatgtaaaatgtacacacaaccatgatgtgttcatattcccccctctctcatgtctgtctgtatctggcaatcttgtctgtctgtctgtctttctgtctatctatctatccatctatctatcttctatccgtttgtccaaccagccattcagccatccatccatttgtccatccatgcatctattcatctatctatgtatctgtctgtctgtctgtccatccgtccatccatccatgcatcccactaatatgtcagtgtcttactcagaatggaaatactgaagataaagtaggtattatattgtaaaagttctatatgaacgccgtatctaaagttgtgtgtgtgtgtgtgtttgtgtgtgtacttacatctcagatcaaataaagaggctacaaacataaatgcctccaagggccaggcctataaaggaaaattggttattctacttgccaaataacatctgattccatggattgatgcaaactagagaactggaacatgtttgtcacctaaagagaacagctgccactcagcaccggctcatggttatcactttgaaaatgtagaccttaccttgctggatcagccagtacttcaaaaaaaaatatatatgtgcaagttatttgaaatctcttggtttttaaatattggcaaataagttatgtttcaaaaaagtatcgatatattggccaaatgaactgcaccgtcagggtatttgctggcatggatttgaccgattcaccaccactgcatcccgggtgcctccacagagatagatacagagcacgtgttcagtagaatatttgtggaatcaatgaatgaacatatgcctgcaaaattttaaagagtagggtgcttagttatttttccctaagttttcctatcagaaagggcacattttgtccctgtgcaaattgagaatttgtggggatcatgtccggaggtgatctctgtcaccggaaaccataagaaagatgaattttcggttttttcttcactgtaatgacagagtgtgttcagaacttctcccaagtaggagaaagcaatcaatcctggtttgttcagatggtcctggttttagcactgaaaatcctgcatcccaggaaaccgttctgccccatcaaaccaggatggttggtgattcggttcttgatgctctgtgctgtgattcatgggctctaaaatgtactaagcagattggtcagtgtatgtgcctgattgagaacttgtcagttgagggctgtgttgttattttcttacctctctgagatagccagctctgaggctgtctccatcactgcttgttttatggcatggcttggtggtgattctctccatcatgcttagccagtatgcatcttgatgggactacctataggctattttaacaggttactcgccacccgtctcatgctgccaatgattccacagtttacctaatgctttttaattgtttaggttgacattttgccatgcgcagttgtaggtaaaaatttaaatcaacaaggggctcggttaagcagttttctctgtgtgccatgtaaaaatatcactaatggtcaaaactcagacctgagcaagagataatatttccccctctccccttctgtacattgtatgttttaatattaatttcttctttatccatatatcaataattgaacactgcatcaattaatatgctgggcaaattgcattccccatcctctcattcatgatgtgtttcagtaatggagataattttcaagataaagcatacaatttaaaatggattaaaaagaaaaactaataaaggaaaagtgatttatagaaaaaaattatggatactttcaggaaatcttagctgtgcttccaagccgatggattttgtaaggagagcctattgaaacgatcaagttttatgcctgctgcaaaatttcctaggtctgcgattgcaaagagagggagggaagaatgtatacacacacacacacacacactttaaaatttggtcttctaatgagggcgtgtgtatcatcttcatccttagattaggaagccacagattcatgctagcaagtcttcttgaagctttccatttgctgggcttagttggtggggcttggttttttgcttttgatttgctgaattggcacacaggcttctgacggcccatcccccggccctccttcccttttcccggtccacaccctggctgagagccctgcacagagatgggcaggcggcagctgcagcgatgggcaggaccgcagcctctgagcccgcaatgacaccgtggcgtcggtagatggctgtagacaagtgtgctgagctgtgcggtgtgaagagtaatgagtctggggaggccttgacctgactggatgctgcttttatctgaagtacatttaaagagataaaggggaagccgggttgctgcacatgttcttttctctgcggctggagctttactttgagtttaaaaaaattctcagatgctggcctcccagagtcaccggctctgtgcagatgggcttgcctcaagaggatcggccgccttcctgtaaattccaccagtggggcttccgtgaatctcccacccgccatcaggaaatggtgtagtgcctgtctgttgatgatcaacaccatcgctagtattatgaatattgctagtatcatcagtttttgttttcgccactgtggctggccgcctaaagtgtctggatttgctcattaaacagccaaaccaagaatttgttacctaagcaggcttgacagaaaagagaagaagggcaagagttaggaagggaaaagagagagagagaaggagggagagagggagggagggagggggagagagagggagagagagagaggcagccagaagcaagtcacatcacatacagtgccactgaaggaatgttatcctcataaactcataaacaagcacaccaaatcttgtgtaaggaaagaagagggtctctaaggacttgacaggaaaaggcaagattttctacccactgctttcagtttttcttccagatactcttggtgaagtaaggagacttctgtttgctgacagagcccttgatttctctttcaagatgatgatgtatttgtgggtaggtagtgtctcttcctctgtctctctttctctttctctctctctctcgctctctctttctctctgattaataaattgactttggggataaagattgcagcccagagtaatcgcattttgtgtaaggtgattatacttgtggcagaataatcttgcactggtatagtacatgtgctcgcatttccagtgggagttcaggcaagacctggttcattagcattaagctgcaattttattttcagttgcaaaaaggaatgacaaaaaaatgtgtatgtgtatggggtttggggggatgtacggttttctgttttttgaaaacattgatggtggtgaattcagaaaaaaggtctagggaagtcgggttagacatgaagcaaatcctacatcacttgtagctgtgaggtatttcatttaattaccaagaatgaactgctctgagtagtgatggctttgtttatttgttttgtttttgtttctgtttctctctcacaagtgactacttatttgtcattttggggttgagtgctgtagaggagagtagcgtctttcatttgctttaaccagatgtgtgtccgtatgtgtgtatgtgagagtatattttacaagattggtcttgaaaaaggtagatttacatgcacttattctggctttctgataaatactctgtagttgttttttgttgtttttttttctggagatcgtattaaaataagagcaatgaagtggtaacccgtagttatgaattacaatatttaactcttgaagcaagaaaaaaatagtaatctagcatgaatggtttagaaaaaattacttattatgttttgggagacaaatatatatcctagtgtagtttagccaataaagagcatgtgtgaatttcttatgccagtaaccaaagtccttgctctgtgatttcaggtttagagcaggtgttccctgctttgccaagggagggaggcgttttcgaggttcaactcaacctctgtctttcatcagcatcatcatcactgttgtttttcgttgctcggcaggcttagaaaatcctctttatccgcttccctccagtccctgctctggttcaactcagatctatgaactctctttgctgtaaaggaagaaggcctttttgttgaattctttgttaatcacattggttctttgacctctgctggtctctaggtctgccttgcccctcagtgagccttgtcatttacacccttgccccctttctttgggacattttcctttgtagcgactttagctccatttccacccggtttagttttgcacaatttagtacaatgaattctggcagctggagacagagtttattattattttgtcttcatttcagggcaagttttctcttcgagcttgcgtatcacgaaagaggtattttgaaatataaaatcactagttaaaactgcatgaacttaatagagagttctatctaacaacactgaattctcataacatttatttttgacagtggaggttgaagcaattaaaattttgaatgtttacaaatgctgatttttaagcattaaaaaaaagtagtcacgtgggattgtcgcctcaataattaaggaaaaaactatactagcatttcatggaaaggagcctttttggcttttattttgtgaacagattctggttaattataaacaaatatcaataattcctttaggctgtggtgagttggttgctagtcacactctttctctgagttgttaagtagtgtctgtgatattatttatgaagtttgttagctcttacatatgtacatatttgcaactcaaagcagaggaaaaatgatgcgtgtcccagacccccttccacatccgaaaaacttgctgatttgtttcctagtaattaatcttgacttaaaagcagcatccctcaatttctattttcttctctcagaccaatgcattttagggctacatggctttattaactgcatttatcacattgaaaaatgggcactaccttcctttcctgtgctcaagtattctgtttacatctttaattcagattttttttctgcattcaaaaaaaaaatggcagagactttaaattggaacagctggatgcaggctgtttaaggagatatgaattagcaagctagcattaacactgtgaggttggaggggttttccattcttttcttcttcttcttttttaatgcagaggttctgctcttgccttctagtctgtaaataaagatagtctaaatgtggttgatatctctgtttaagagctcatcttgctttaggaaaatgagcctcagctacattgatgtgtgaaaatagtggttgctactgtctcatggatataaaagtgaaaatgaagagacaaggagagacaataaaatagaatccatattcagtttactcctgtcattgtttcttaaatttgtaaagtaacctctttatatgcacctatctgtgttaatagcacacgatttcagtatgtttttactaagatggaaaactttttgctggggggaggtgtggggtagatggtatagtctcccttctctagactgactttgtcattttagtctataaggatggtcctgtgtatttgaaaggtaaagaaatgctttggaatcgtatcaattaaaaatagtgtggccccattaagccagtccaattaaatagttacagatgcttaatatgtccatcatttggtgtcatctcagatttatacatttttttcccttaaatttctttaagaaggttttcctatcaaaaataaattttgtagttttcgttgtattttattttccctgagtgagtacaggttgctgtacaggggaaagaaagttgagttctctgcaaccattggctgacttccgggcggttttgattcaccaaacttggccacggtaggagggggaaacagccttccctacggacttcttggaaaagcagggaagtcacgtttactgaggatgtgatctgagctgagcaccaggctacacttgccgtagaatgaagtaaaaccctcttgaccagcacaacctcccttgaccagcacaaactcctgctctcctgtggttatttaattccgccaggattagaggttctttggaatacaattgagctgtttctcctagggctggaaagtaggcaattggcacctactcatctaattcacaaacaggatacaaattcctctgccactcaagtcttggaccaaatggtccccgcttaaactctactacaataggtatttgtttgactttataaccttttcgtttctctttactttttagttggttgaaacaaataactctttccattttattatttttactcacattttctcatttacattccaagtacacttcctctgtttttactttaagttaaaatactgcaatttttaattttaactttactttttttttttgttacaaatttggtgttccatttattcactgaaaataacttttcttcactttatcgtttcacacttcatcctcaccttttaaaaactttttttttttagaaatatcattttatacaaacatacctgggtttaaaatgggagaagagcaacaagtcaagtcaagaatttctgagggatgttgaaaagacggggagagagttatgccaggcggcagcatctctccttttaccaatgtagttcagtcacttaaaaaaaaaaagaagaaaacgaaaatgcatcattttttctacaggatcctgagagtcctctacctcccagagtgtgttacacttggcagaaactccaccacccagacagctccagttctcagcctgctgtaagcaaacttgtgaagtagctgcctgtggcttatctctgctctttcaccccatcctcagtactgggggagcctcctctgaattctgcattttctttcctgaatgctaaagctttttctgatctgtactctacattctagagcttcgttattaactgagtatagagatggcctgatttgtagattctatgtggatcagagattatgcagaagttgcagatatagagttgctttattgtcttggatcatcatgccagtttaatttaaggtctttcaggacagaaacaacatctgcccattttgtttgacattctcttttcccctttatttcaaacaatacacgtgccctttgtagtaaaattagtcaatgagaaaaaaaataaatagcaccacctcttctagcacctaagatatatgctggaacactggttaaactcttaaagatatttaaagacatcttaaagatgtttttataacatgcacacacacccttcttttctcaatttgaatatagcattgattacaaagttacaaggtataccactgttttattagtagggtttgttgttgtttgtttctcttgtttgtttctgctttagtgtgtgtttgtggagagccagaaatgctatcgcattaaaagcctgtatcaattgtaaaacacatctccatttcagatacattaaaatgtgaagaaggaaaaacaaagcctctgagaggaaatactctgtttcaaaaaatgagatcacactgctttagaacttactgttttgtaacctgcttttatcacttaacattttgtaccattcaatatttttccacaacagcctctttaatactgtatagacagtgttccagcgaatggcgattccagaacttatttaaccaattctttgattatcagttgtttctgcttataaaaatccttgctagttcctggtatggtgtgaatgcattcactaatcatatatgtatttgttcagtgggttggttattgacagagcctttacggacttgggcactgtctatggtactgcgccttgggggacgcacagttaagttaaaagtatgttaaaaggtatgaagagctgaaaacagaggattgcttgttaatattaatcacctgttgattgcagttcacaagtttggtaattattttttcttcaagtattctgtcccctttaccaaatcgaaggctgggacatccgccttttcacagtgattcttctttccgccttggtgcactggaggcctaagtgtcatctgtttttttccaagttagttgacgcattcgttgaatggttccttttcgtaggaacttgtgctggaaattgcctctggcagtcaaaggaaacatttttgttttggagagagaaattttcgttttttattccaaagttcagcatttctgtgtttcctatgagtgcagtgctttacagcaaaatgcctcaggaatacaaagatgacttcttttaccccagtgaattctgattcagaaattcgtttctgttgacctggcaagttcattcagcacccatactggtcaccgtgtatctcagttagggggctgagaaaatggcccagcagactctgattactgtgatgaaggtgttcattatattatcccttatctttcttgactgtgatgtatactgagcttgcctctcttgtctgtgtcaccaggagatagttcagagccctgaatgttctctgttgtctcgaatattccagccgccatgtttttcttgcatacccagcccacttcttctttgacactctgacatagtcacatctttaatgttgcttaaagatgtttttgaacatttggaaagggctagtttcccagcatctttaagtcagaggtacccacttatccagatactcttcaggcagaggaatgatgatggaccctcatgaacatctcaaacttctcgttgattagagggaaactggatggatcgaaagttaatgaatgggagctcatttgtgacttacatcttccccctctagcttaaccattcatggcctccccactcactgcagactttgtctggcagagggagtaatacgctattttccgcttgagcacccagaagctgttgatgtaaattgatcagtacttttttgtgttttcctgaaattctgtttacatgcacatttcctctttgtctgtaaagtgatttgtatcataaagccacatccattttttcccactgtaataatgacacaaaactcattgaatatttgtgtttaaagattcttggaaaacataatggtgtgactatataaggcgtatataatttttttaaacaaaacctggtgagtattaataaaaacaatgatgttgtctttatgattgtgttttaaacatagtaattggtcaagtggatgttgcttagtgccagaggatcagagcaaaacatactagatgtgaaatagcccttctcttcttcattttacattttgagtggtgtttcacttacctttagaaaattttccaaaccttcagacaaatacttgatcaaatgatgcgggtttgaaagacataagcaaattagtttctgtgcaaacttgtgtccccattcagagaagaacaaattgaaaaattgatattcaataccaacaagataatttcgggaagcaatagagcattgttttgaccactaaggaacatgaagcttttaggagaagtagagagagctttgcccattgtcttccatttattatccgaagacattccaggtgaaaaaaaacatgggaaggaaaggtaggaagagaaagctttgaaaatgatttggagacatgcaatgctatttcaagtggttctggggactggatagaatacatcattgctttctttgcattcctatgtcatcttctcctgatgttatcattcgaagtcagactgtcaaatcctgtgtattgggaaacactctttgttcccttgacttggggactcctgcatttcttttgaagttttttttttttttttttaaatcattacattgttcaccctactccaatgtcttgttagtggttgggtggtatggctaagatggctgatgaactgaaataagggcagactgtacagctgtgtgtgtgtgtgtgtgtgtgtgtgtgtgtgggtgtgtgtgtgtgttgagagagagagagattgagacagagggtaagagaatttttctgcttacatttaaataactcacttatggataacatttggataacgtgttctctttaatcacacagacttttgccccgtctcttaatacctgtagaacaaatattgtatctgtaaacatctattgtaaacatcagtgtaaacatcaaaggtaaacatcaattgtggaataacctttttactcttacagagtgatttgcaattctgttatttgcaaatctgtctatattttgttgatgatattagtaatttgttttaactagaatgttctttctttctttcttttttctttttcttttgagatggagacccactctgttgcccaggctggagtttcactctgtcgcccacgctggagtgcagtggcacgatctcagctcactgcaacctccgcctcccaggttcaaacgattctcctgcctcagcctacccaagtagctgagattacaggctgtcaccactgtgcctggttcatttttgtatttttagtagagactgggtttcactatattggccaggctggtctcgaactcctgacctcaggtaatcgacctgcctcagcctcccacagtgctgggattacagtcatgagtcactgcggccagcttagaatgttcttccttaatagaactcatgacaaaatgaaaacatgcttaatttttatctgtgatgtggagttgtgtgtcctcttttccacttggttgtttcttttctcttactttgagttacattgtgagccctttcacacaaagaagggtctgagctttctctatacttggatgtcatgatacataccaggtgggagcttggaatgtgtttacagatgataatcatgttggtaaggtcttggttgatcactcgataagtagcaatttgttttttaattcatttccttgttaagaaaatatggagctgggcatggtggctcacgcctgtaatcccagcacttcgggagaccgatcatgaggtcaggagatcgagaccatcctggctaacacggtgaaacaccttctgtactaaaaatacaaaaaaattagccaggcgtggtggcgggtgtctgtaatcccagctacttgggaggctgaggcaggagaatggcatgaacccaggaggcggagcttgcagtgagctgagatcgcaccactgcactccagcctgggcaacagagtgagactctgtctcaaaaaaaaaaaaaaaaagaaaagaaaagaaaaaataaaacatggagagcatctaatgcatgagatattgtgtgtgctaagttctgacgacccaggagacatgatatgatcccaatcttcatataacttacatgtagtgaaggagacagataaaacacaacacaataacaaaactggtaaccatcgagcaaaagtagtcgataaaagtgttattgctaaaactcatggttgcagagctaagtggagactcaaaggggatatgtaggctgagatatctgagaagtccaaagatgacaggcagtcagaaccaggtggatgcagatcatctcaccatgtcatggaaactctgactcaatttctcggacctatttttctccgtgtcccccagcaggatgtctgaggcaaccactagtagcttctggctgacatgccactgttaacagcagccctggtgggtggaccacactcatccaagaagtagtaggctctaggaaaagttttgaggccaattttcttgcacctggattgaattccttacctacccctgaacccatccctgatactcaacatccaaccctgtgtaaaatatttgctgtttggatctaggagtggacttagccccagtaaaacggggactgagttgagcaggttggctcatgcctgtaatcccagcactttgggaggctgacgcaggtatatcacctgaggtcaggtgtttgagaccagcctggctaacatggtgaaaatctatctctagtaaaaatacaaaaattagttgggagtgatggctctcccctgtaatcccagctacgtagggggctgaggtaagagaatcacttgaacccgggaggcggaggttgcagttggccgagatcgtaccactgcactctagcttgggtgacagagcgagactccatctcaaaaaaaaaaaaaaaaaaaaaggactgagaatagggaagtggtggtttcccaggaaatattaaagagctgttaccagaaagcgaaatgaatcctggtttggtaaaaacaacagatgcctcctatacaaataaacacatgtgatcatttgcaaggagatctaggacaaaaacaaaaaatgtgcttgggaaatgcaaccgcgagagaggtattgtgaatggtgacttcgagcaagacttttccaagaaggtgtcttctcagctaggacctgagagttaggaaactgctatgaggtaggaggatgctagggaggtgtggtggttagaaggccattgtgtacgtggaaattccaggaggctaggctggctcagcctcagatgtgaggagtatggtcagagagagagagagttctgagacaggcaggaatcagagcctggtagattagagttgcttgcatcaaccccagtatcaaagatccccatctcccatgcaacaccctggcattaaagcagggaaagagagaagaaccctacagaggaggacagtaagagagtgagtggagttttcttttctgttttaattgagaagtgttagagaattgtggaatcatttctttctaggattttaagcacctctccatctgcctcaaataatcaaattccatccaattagatgctgttgccactcataatatgcaagtctacatatgtactaaacccagggcctctctgcatctggttttgatctatattttcaaagaaacctgctccccaaacttgcacaatgattccttcacagatgctgagtcagcagagagctagtgcatatttatccagagattctgatgaaaagagggagaaagaaaaatctaaaagcagaaaaatacgaagtatatggaaattttgaggtttcctgctgagttagggagaaggggttggggaatccttgaataaatcatagtgcctcacacaatggcctgctttgtctagtaaaagcacttttggttgaggatcagaaatacaaaacagtttaataatagtgagtgttgtgaggagtttcaagaatcttcgagggcatttgacttaaatgagctcagtgatggagtattcaagtaaagccagtgttgtcaatatgctaacttaaaaggctaatcaaacaggcaagtggtacaagtgaggaaaggaacacaattagttaatggaagatggagggtaatatggaagggacaaaaagttttttatttttatttatttatttagagacagagtctagctctgtcatccaagctagagtgcagtggcacgatcttggcccattacaacctccgccttcctggttcaagccattctcctctctcagccaccagagtagctgagattacaggtgtgcatcgccatgcctggctaatttttatatttttagtggagatggggtttcgccattttagccaggctggcctcaaactcctgacctcaagtgatccacctgcctaggcctcccaaagtgctgagattacaggcatgagctactgtgccaggtaggcaaaaactcttattctattcattcatttgtaaaattaagccaaagatagcatactttactttattgaaatgtaacacacacacatcagcacccttaaacatatacattcggttataatgtattggtaataacacaggaaattcattggtttcttatggggatataggacattagagtggttaaaatagtgatgatcttggctgggtggtggctcatgcctgtaatcctggcagttttggaaactgaggcaggaggatcatttgagctcaggagtttgagaccagcctgggcaacatagtgagaccctgtgtctatctttaaaataaataaataaataataattaaaatcgtggtctttctagtgaggcacagctatattcaaaatttggtccttatcctattttttgcagtaaccctcagtttcttcatctttaaaatgggactgttactagtgcctgaggttgtttttcaactgatattgagctggttgcttatagccattggtctttttgattgatggctgcctctttttggtgggtcagtgtccaaactctctcttgttaaatagttcacaaactatccttgcatagtatctttctcaaacagttatggtgaaagtttatattgcaaaaatagtacttagaatcagagatggcagatagtagctgtttactaaaagttagttgtaaccatcaatactgttgtcattacaaaaaaactgagtacaaacaatgtcttctgcatacgtgtggatgtagaatgagggagggtagatacagggcaggagagatcactctagctgcagtgggaaatggctcaaaaaccaaggaatttcgtaattcctggctggtgtaaactcattttgtaccagcttctcctcgtaggatctttcttgggtgttttatttaacccctctttaaaatggggctaataccagaaggggaatgggatgaaataatagaaccatatttagtgtctagctgagtggtttgcactggtatgtgagactttatattcttctcttctcctattacttataaaccaacaagtatctgagacaagtctcagtcaacttagaaaggttattttgctgaggttaaggttgcacccttgacacagcctcaggaggtcctgaggacacgtgcccaaggtggttggggtatagcttgcttttatacatttagggagacatgagacatcaatcaatacatgtaagatttgcattggttctacctggaagggagggacacttcaaggaggaaggtgtttccaggtcataggtagatttacacatattctgatgggcaagtggttcgtagagttaccgggagaaaagaatgtgtgggtttcaataaagggttatggagacctaggttttatcgtgcggttacagcctctaagtagcaggttttagggagaatagactgtaaatgtttcttatcagacttaaagtttgtgttgatggtaatggtggagaggggtataatgaggcatgttcacccctcagttctcatcatggtctgaaccagtctttcaggttaaactttagattgccctggtcgaggagggggtcctttcacatgatggggggtgagggtggtcaccttcaaattttatttttgatttacatactaaataaagctctctggtgaagggaacaaaaaaaaaagctttagagagggatgcagagaaaacaaaattgaagttgaaaggaatttcgaaatttgtgtgttaaaggaatgactattcagtgctgatatcagtgttgtgaaaaatggttagaataaaatgctcatgaaaatttctctttttaaaaagaaccctgactctttctgaaaataaaagtcatatttggacattatgaaaaaatttgctatatgaagtagaatctgactccccccagcctatcactcatcactcaacatttttgacgtatttcctcctcttttaaaatatcagtatatttgaattttcatagatacccattttcctccaaaacagaatcatactataaacatattttcatacaaattatctcataaacattttctagtgttactgatggtttgggaaaacatgggtttttaaaggttgttttttttttttttttttttagcatatggctatactgtagcttatttacccatttgcctactgttggatgtcaggtttttcttgacatagcctgtgataaatattaatgaaatgaacaataacaactttaaaaatgtacaaaatggacaagggagagtgaacagaggactcagagggggaaaaaagatccaatggccgtaaatataggacactgtgttcaccctctccaatgtcagatgaatgcaaactaaaaatgtgttgtcaaattgagaaatgttttgcaaagggcaatactatactgaatgcttgtgaagttaaactgctaaacatttttagaggttgctttgcaagtacaagggattttttttaagtgaaagtgattgtactttatagcctcatcaaggattattttttgaggaaacactcagagatatagtgaaaaaatgttgcatacaaggatatatggtacaaagttacctatatacactaaaacatctctcaagttttcattcaaagaataaaagctagtattctcatgctatggtacttttaaggcactaaacgatgcctgccgttggttgctgagtattaatttagtcagagctatgcatgcaggcagagctggcctatgcaggccccatttttgtgactaggaatttattctgcaccagcgtggcatagagagaaaccgagtgagtgcagtgccagctcgccgctagcttggatgaatacatgacacaccattgcgcttggagaaaatgctattcattgaaaataaaagggaatttaggaagaaatgtaatactcatcagtaattgcaaggaaactcttggatttcgttccagagtcttggtaatagtggttacataatatagcagtgaatgtatgcgtgagattagagaattttagaaggaagaaactgagattcagaaagagaccggctgtaccaaagtgtatccaaccaaaagcattcacagagagggggcagatcacatattgaacagtggtgcttttggaaaagatcatatgacagctataaagactctgatgaaaggttactagcaggttattcaaaggtactttttttgaaggcaagattttaaggcatgttagggtaggcattcaagtagggtgattttttaaaaatgtatttgcttgccgcagaagacaagtacaggttctgctctgatgcctgtcctggtcctctttcccttttaatgttagaatgtggcaaatgctcagtaatcactgagctagggatttccaaggctcttgtctttgtctgcatcccaggtccagggattgtacagttggtaaactgtaccaaagcatggagaccaggtgtttacgaggattgaagcatagttggtgctcctttcaccaagccttgtaccacaagcctagtgctgtatccatccagagacaagggtgccgttttccttactccaaatttacataagctaccagtgtttgcacccatgctgggctggccccacccagaggagggtgctttttctaactcacaaccaaacatacaggcagaaatggtcctgcctgtgcctacttctctgttagaaaagaaacactcctcttactcacactcatcggattccagttaagccactgtttgcaggggcattccctgaggaaattcgggctggagaagagagatgaaaatatctttctcaattctacctttgtataggaactccattctttgtctatccatagactattggattcccttagcctatatgtgaagaaggatctgatacagagcctaagtcttactgagagccttagaattgtctttagtgaagtgttaaatagtcgctttcaagcattcacttttgtagatgtcttcgcaggatttaaagaaagaataaaacatgccaggatatttatgaatcatgagatttaatagagaccaaagtagatcttattactgatgtgcttactgcttcattaaattccctttaaggtttgcggcttggatatggatcatttgcaataataattaggcagtgatcgattgattgggtctgacattgcacttgtcaccttgaaatgcaaaatccatctattttcaacagtgaacatttctcgctaatcttgcacaccagcatgtgatagtttattttatggagaaagtacaatttataaagtttggagacttaacattaaccttttactaagaatgaagtatcacttgtcattttacaaagaaatgaaaatcatccaaccagcaatttttttgagattagaaaacacagcctaatttcaaaagaatttttcaaatccaaaacgcatgcacttcaattgagtgctacaagtatattgtgagtattggagtttactaaaccttcacatggagtataaatgataaaattgtgagcttgagactagctctgctgtgtgtacagacacacacacacacatttagacacacacacgtctatttgtctatctatttccacatttaattccctaattctatctttgcctcaaaaaaaaaaaatgcaacactctgtttctgaaaagtgtgggtgctttccaagctgtcggaccaaagtattactgaaagttattccatttgaggatttgcacatttctttccaagttgtgatttttaaagaggggataaaaaaccaatgacctcattcttttgcatttgtatcaactttgatttccagaactttaactgttttgagtttatgacgtgtccagtctcaagtcagtatagcaatgagtaatcattgtagaattgcctattaaggggcaggcatcgttcctgatgctggaataaaatagcaaatgaagctggcctggcccatttctacacagaacctacatactagctaggaagcagaaggccaccttcagtcctgctgaatttagaaatacagtatatgaattggtatgaaaagacgttcacaatgtattggtatgttaagagatgatcagtgacaaaagctgtgtatcaaatgtatagatagattgataatctacacaccaagatgctaaaagtgattagtttgaatgatttctcttcttcacctctctgcagtttatagttttttgttaagtacatgtcttgtttacataataaaaatgacttaaagaaacgtaaataataacgaatatgcctcatacaggacaaactaagcaacaagtctggtggtatcagaatttgtacagaaaaacctctaaggtacccagcaatatgtcagaaattaccagactcgtgacttcaagtgcctttaactcttagtcatgagaaagtactattacctagtgataccatttgcaaaagaacacacaaacagatgtttctgttgtttagctgagtctctctttcaaacatccatggacaattgaaatcttccaagtatccgttggtttacacaacttgctccctattattaacaacaagagtaaaatagaatttaaattttgttttgtgtttttccacatataaaatctaaaatagttcgttactaaaagcaatcctgcaatcccacagatgtcagaatagtaatttaagaaatatgtacctatctgtatctgtatggaaattaaggccaagataagtaataacaaagtagcattgatttgttaaatgtctttgctagtgactgctgtctggaactactgaaaactgcagtattaacctctaaattgtatccctgagaccctcttcacactcacacccattcactggaattgaggatataagacagtcctgttagttgatgtaacttctcctaagggggaccagtgtagcttgaacatctacttaatcagtctggtacctcatccccatcaggacagtatgcccctctgattaaaacagactattgtcatcctgagatggagggaaattgattctaattcatggacaaggaaagagtaaaatttaaaaacataatctattcaagatcctgactttaaaagcaatggcttacctaagattacgcaaataatttatgataaaggtgggctgaaaatgttgggcttctatagtcaagtcaggacctcttgctgtgatattgctaactcctcagcctgggtatttacatcgggacaccagaaagacacatgttttcctgttggttacatattcatggtcagtggagttaaggacaattaaccaaggaactctaatgttcattttcttcaaccacttcatcctttcttgagtattgctctaccttttttgttgtgacttgcaaaaataaccaacacaaagaggctcagacaaaacacattcttcaagggagaactcactggtgtacaaaacagaaaagtccaagagatggatctcaggtacagccccaaccatattcagaaaatatactcagaaatctctgtgcttgtgtgtgtgtgcacgtgcttctgtgcttgtgtgtgtgtctttatgtttctcagctctgctttctttgattcagtcacagaaaagcccttcttggcacctacagatctccacttacattcttctagctgagccctttgagctgaaagagagcacctctgccactaaagcttggatgtttaagcaaaagtctcaggactgcctgtcattgcttcagcttaaagtataggcccatccattaaccagtcacattggcttggcagtagtctatggagattggccaggtctgggtcacatggcaacctatggaggccaatccttaatctttttctctggaaccatatggtctgattttttttttttttttttggcttcacctattttcttttttcttagttttttattttcataggtttcggggaacgggtggtgtttggttacatgaataagttcttcagtggtgatttgtgagattttggtacacccatcactcaagcagtatacactgcacccaatttgtagtcttttatcccttactgcacttccaccctttcccctgagtccacaaagtccattgtgtcattcttatgcctttgcttcctcatagcttagctcccacttacgagtgagaacatacaacgtttggttttgcattcctgagttagtctgcaatctcatccaggttgctgcgaatgccattgacccattcctttttatggctgagtcatattccatcatatctatctgtctatctctctatatatatctatctatatatggagatatataggtagatatatagattcagtcacagagatatatatctatatatctatgtagatgtatatagagatagatagatagagatatcacaggttctttatccactcatttgattgatgggcatttgcgttggaggaaccatctgatctgagaatggaggaggtattgtttcactcaggagaggtatacgtagacaatagatgctaaggaaggaaagcaattgttctttgtccagtctttgtctgtgctaatgacaactctatgaaactactcagtccaggaggatttcttacagcacaactctctggtgttcatgggactgacagttctggaatatttaaaactattcagtacccccacctcctgtcttgaattcctccttgtcctttgaaactcctttaccgtgaatctatagcagcatcatgacctgtgaagacacagtgcactttgagttcatttttcctgtgggctcttttttgttttcgtgtgtcaggttcataatgactgtgtgtgcatgaatgtgtgcatgagcatgtgtgtaaacacatacgtgagtttccatctctagaaattactgtcattcatcctggtcagagaatgtacagctttgtttaattaaatggtgaagctagttgagaattggcaaatggagtcagattgaaaaatattttacagctctttattcttcattttgtatttcttgtgttaaacagagaaagaaaaaaacacccttgggattgtaagtgatgaacttaagtctttgggattcctttataattcagtaggtcattaattctgcactacttgttgccttttggcttaaacatttgtgttttctatgtgcttagggacttctttttaatcttttagatatctgtctatctcaaggtcctggcataataataataattttatttcttgtgtaatgatttgatttaattcaaacattgtggaaatcctacgatgtgtgagctccatgctaggtgcttgagatatgaattcatgacacataatccctgccaccaagaagcacaaaatttttaaggagaattagagagtgacgtgaccagatgccctaaaaggtgtctgctggacagcattaaacagatacacaagcaaacaaaatagtatattaattaattcatgaaacaagtatttatcatgcaccagacactattcttggcagtgggcatgcaacaaggaggacatggacacgtccctaatcctacgaagcttgcattcccatgtaagccacacagttaaaacacacacacacacacacacacactaaatgaacaaatgcataattgcagcctgtggtaagtgctatgatgtcaggaaatacttctataaggaactgatatttaagcctgtttcgaaagttgggaggaccaactatgcaaagagtcagaatgcaagaacattgtatccagggagaacagaaagtgcaaagccatcgaggctgagagagattgctgggttcaaagactgagtggctggtgggtattaaacctgtgggagatcagcacactgtgagctggagagcaatgtggaaacctttattcagggatgtaaatgccttctggggcagacagacagtagatattctcatctaatgcagcatattctggggtattattagctcaaactggaagggggccactctagggtggaggctggacctcaccttaggattcctcgattcttgtacaacactcctctccttactcaggaggctttattttcttaaacacagctttattgaggaaggattaactgtacatatgtaaagtgtacattttgataacttgacttctgtgcatacctgacaaacttgactgtaatcaaggtagtgaacatctgtcaccccagaagcttcttcctacgtcgctgacatccttctttccgctcctccccttccaccctccccaaaacaaccaccaatccactttctatttctacacactagtttgccttttctagaattttatataaatggaatcatagaggaggtggagttactttttatagcttttaagcccacacagaataaaagtattctaatcttttttccatatgtctttttgtgtctgaaaaggatcttaaacatctctaacaataacctccttgttttctctacccgtggtctaaaacctgtgtttgcttgatgctaaacggtggagggatttttctgacttgaaaaaggcagagtttacctctccttttcttatctccattattattttgaaaaatgcaattgacctaggaaagaaaaagggggatgacagtgacataagattgggggggagagggtagagaggtgaaaggatgaatcaagcaaagatgctgcttcatcgttctgatcccagaaattagatgtgtggatgaccaattttcagctaattagcataaaacaaaatacatttcaggaaaattgtgctcgacacaatttaatctctgatggttcagaacagtctctgggtcatcatgagcatcagctctggaatcagaagcactggggagaaggattaatggggaactggtattcagggagctcaacatatatgctcacaatctccccattaacaaacaagaacttctttctattttatttcagtacagcttgtcctttgtttgcttcctgaataatttgaaaacatgtacaagttgaagtgtaatgcaatataagactttcagatattaaacattacatagtttaggtatacaattgattcatccattcattgatctggtaaacatttattaaacatgtactgtctccaggatatgtttctaggtactgagtatatggtggtgcagaaggtgattctgtatgtgcctgtaattgtttgtgtttgcgtatggttcagtgggatttgttagagatatgattaattgcttgtaaaataggaaagtctaccctgagcataggagtttaaagcaatgcaacaattttgcaacatccaccacagttaaaagtgtccatactctttgatcctctgatagcactagtggaaatttatcttggagatacactcacccctgtgctcaaagatgcatgtattacgaggctcatgaaggcttgtttgttgtacctaaatccccgtcaaggatggactagtgaaacgagtcatgatatatatttatggttgaatactatgcatctgtgaaaagaaggaggttggtttgtctgtactgacattcaacaaactcagacatatggtcaaggaggagaaaagcatgaagcataacgttatgtgtggtaggtttgcatttgtcaatgggatggaaaagagggcagtatacgtgcagcataggaaaatacaagacactgctaacttctgaaaatttattgatgagcaggggagtgaggatggaaaaagagccacctctttgaattactttaaatatttccaaggtgaatgtactggattttcagttttggaaagctaatcttaaaagtggaaaaatagataaaacaagtataaaggataccagtagattttctaatgttaaccttgggacctcatatattattggatgcaaacgtctacaaaggttgctattctgtcccccttctcccttgaccatgccgtgaaacaaagagaaaatgaacaaatccctgcaaccaaaccctctcaccagatttgactactgccaatgagattattgagttaccaactgcctctcagaaccctaaggcaatttggagcccagaaggaaagtgaggcccccaggtggatgtatggaaggaaggtggtgcacctttgggcccttgtgatccaggtgagtgacagagtgactcacctaaaaagagagggaggtctctgcagttggaagctgcaaatgatgatggtagaattttgcacaacccagggatcacaagcccagttttaggggaaagggctctaagagtagagacatccatataggcgcagatagtcctcctttatttaaatacaccagcagctgcaaggagtaaagggtcttgaggtggaaaagaagaggggtcattccagatccaaaaaatcgagatgactcctttgagcaatttcattcactcgtttgctgaacaaacctgaattgacaccttcttggcacagccttgcactacgtgatgaggtgaggtgctaggaccaggtcactagcattcactgaacttttcatttcatgcaagggaaagagccccctatcaggtaatctcacagacaaatatacaattaaaaactgtgataggggttattaaggacactgcagagtaaaacaaacaagcctgattatcttacagggaggaggagttataattcacctgtttatttagaaacctgctaatactaatcactaagaatctctgtgtggtggctcaggcatgtattcccagcacattgggaggctttggaaggaggattgtttgaggccaggagtgtgagaccagcctgggcaacatagcgagaccccccgtgtctcaaaaaaaaaaaaaaaaagaaaaaatagccaggtgtggcaccaccctcgtgtagtcccagcttctcggggaggctgaggcagaaggatccccggaacctaggagtttcaggctgtggtgaactatgatcatgccactgcactccagcttgggtgacagagcaagatcctgactcttaaaaaaaagatcgttcccactttacagttgactacattgaggggttgaaagatgaatttgcttgcaaaacacagcaaatatgagtggagacaagacttcagccaattaacacagggctccggcttaaggagagcctgagcacagtagttgcatagttggttattttaacaataaaatctaagaacttcgagtacacagtggctaatagctaggagggatctctgggcacgaagattagtgtagttgctctggtgacatttggcatattaacatgagacatgaagaaacctaaaccatattcattcaccatagttaaatgaggcaggagtcaacaaaatacagcctggcattaatagcctaaaaacaagatttttgagtttttcttaaaattgtgcacgtaatattacaaagtggtcatgtcacaggagaaaattttagtgactaaaggctggaatgtctgtctatatttattctagtatataactggtaaagaatatgtgttccctcccatcccagggtcagctgtgatatagaattaagatttttaactttgggtagtaaaaggacaccagggcatccatgctctccctgaaattgtgtatcgtacagtatttctggaaagaagtcttcatttgtttgttgtttttttctcctagaagggcatggcacacacacacataaaggttaagaaaaaatactgtttttgaaaagccaaataactgtggttcactatgtcgagacatgtggccaatctcattttcctacagatgttgttggacataaattgatgatttcaagaagcaaaaagaatattctgcaatgctcagtattaaggagttcagtgtgatcagatgggcctttgtcaaactgaagtattttaattaacttacaccgtaaaagtgaaagtgtaaagctttgcttttcttcctagctaatcaatgaagattaatattctatgggaacccgactttgcagacggagctgagcggcactgttttccctaccattttttcctcatagtaaataaatcatttttattatactgtatgaatttacttagctcttttaatagcctttgtaagaataatgcttcctttgattatattacatttttaaatgagtgcagtgtggaatacagttctgctgttgggggaagggtggtgagaaaaggaaagagatactgattatatcagttttatcagcttatcctgtgtgttttaaaccagataaagcagtgtctgagtatcctgggagtcttaggagtaaattactaagtatttgctaggattgaaatggctcatacctgtgccttgtataaaactacttctggggaagatgaggttagtctgaaaggacctggtctttataaaattattctgattgttattttgtacttttttttttttatcttcaaggttctggccaatctatttgattttttttcccccaaaggagagaagtaaactttataattccagggctaacatccacttgtataaattgatcagttgaattgaaaagctgctgactggctgatttagcatgttcttcaagtggtctcattcacaattgataagctgacttgtcaccctgaattattggaggcttaacccttgaaggacagatacagtttggcctatacagattgtacttttcatgagacaggaaaagggaggaagggaggtaagtgtgtgtgtgagagagataaattaatttcattagaaacaaaaatatcctgtgatcttatgcgttagaccaagtgttgaaatattaaagttcctgatgagaaaattcagaatcatacaaactttgtttttctatgtcatccatcttgtacatagtcagcaaaccaattcatttttttgagatggggtctgtcttccaggctggagtgcagtggtgcaatctcggctcactgcaacctccaccttttgggttcaagtgatcctccagcctcagactccaaagtatctgggactacaggcacatgccaccacacctggctaattttttgtatttttttttttttttgtagagacgtggtttcgccatgttggccaggctgaactcctggcctcaagttgtccgcccgcctcagcctcccaaagatttgggattacaggcatgagccaccgtgcccagcctaacaaacattcttttaacatatattgtccatcaagtcagaacctttaatagctcctattcagaacctataatagctccacactgtttatggaaaataaataatggctgaggctgaaaatttaaggttatcttaaatgcagcctcaatatgtaaactctgtgtgtgtgtgtgggtgtgggtgtgtctctctgtctgtctgtccgcaaatgggtcaaagtgaaaagctcttgtgaccttgattcacaagactcaggtttgagcttcatttctgcagtttgttagttgtgtgcttactcatctgttctaggcctctgttttatgatttgggtaacaggaatattagtaatgacagcaataatggggatgactgggctataatgctacttacctaatttaactgatgttttctggaaagaatgaaatcagaaagcatatctgcaagtgctggcaccctctgtaaggcgctgccgaattggttggttgttcttacatgaattcaggggtgagtcagacccatcgaactggagtcagagaaagccttgcaacctggacagaatggaaaattaatttttcctattgcttcaggcacatgttgaaccacggtcaattcaagtttgagatctctgcagatatatacgtttttaatttgtcaactaaataaatacacagatacataaatacattgagctttctgaggagacctggagtctgcatattctgtggagttgatttgaatggagacccaagagtgtacctctgagtcattttgggtaagagtaatgctctatagttttttatctttttttggactttgaggacttatacaatataatgaaaaacactgtttttaagtctttccgcagtaaagattcttacaaagcaaaagataaaaagtttcccttctttctcatctacttgccatgttctcctcctgttgacaatatcctcccacttccctttcgatcttgttatgtatttggttgaatcagattccattgctgatatttgactacttagatgtattgtaacaggaatatattatgcaattatgcacccgcaccattggagccacatgatgaatgtatgcaaattattatgttagcatagagtgcaatactacacagtgtcttctgactcaatatccttccacccaagaaacacatcttggagattgttgcatgtcaacatgtggagatctattttgttctttgcaaggctgcataatgtcctatgttatagatgtgttctcttttttttgtatatttgctcccttattgatgatgggcattaaagttccctcccgtgctgatggacattaaagtggcctcccactaccaagttttcacagttactcacaatggcactctcgggtcatgcatctcagtgtgtgcatgggtgatttctttttataggatatattcctagaagtagaatacttgagctttaaaaaaaatcacttgtgccttttgcatcgtgagtgcttagtgaatttataattatttgatcaataatgaatgtgcaatgaattttatgagcaaagaactgtcacctcatatttggcaaaattttctctcacctcagacttgggctattttaagaaaaaagaaacctgaaacctcttgagtttttaactttcagttgtacttaagagatcagagttggtgttcagaggcagatcagtctttacgtggaggtgctaaggttgcaaattacaaaataattaggaaagtgattgtgtgtgcacatgagtgtacttgtgtacacattttggagattttatattcaaactgcaatgaaaaaaatatgaatacctgggtagctgccattttgctatggaggtccaaggtcacatatttaatagttctaaatttatacccctgggaaggaagtatatgctcactgtaccctttaataaaggcacagaaatgtaccgtgcagtctgcatgaaagcatgagtgagtgctattcattttaagaagcactcaagcactgtgaaaattagcagtggaacatggttccaaatgaaagtgacaccatgagcctaatgagaaattgaataccatctatttatctcctctagcccaagatctttctcttctgtcatttgaatgtttctgaaacgccttttcttcctgggctgagaagtgcctcatgccttcttcccctgcctctctggaaatgagagtccttgtgctgttttcctttctacgctcatgaagagtcctgctaggtgcatggaaactttgctttctgtttacatgtgcttctctgtcttgctaactcgttgtcctaagttttaggtgtgatagctgtagtggttttcatgaagccaaatcgtaaaggtctgagaaatacacactgtgtgttgcttggcttgtcttagagcaaaccaaaatttggaaaattgtctgggaagggtaagatcacttagctgtgaagcctctgcttttaggaactggagaagtgatttgagggtgaaaatagggtaagcgtatttactctttagctccttaaggaatgcttcttcaccttcttcaactcactgagtttgtgtttgaaaaatattccaaagcctttgcttaaaaataatgtattatataatatccttcgattaagtttccaacgtgtagattcttgttagcacttagtggtgcaacttttataaagaaacctggtatttttttaattaactgatgaaaatggatgtaagtaaggggtggacattcccatgtcaatgaatcttgatggtggcctccggtcactcatggaaaaatgtatttttgattacttgtgtgccagcaacgttgctaggctttggatgcatggaagcgaataagaaatatgaaagtcctacctacatagagcttatattctaatggaaaacagaaactaattcttttgccttagttacctattgctatgtaattaccacctcatagttgctgtggactgagagtccgaaagcatgtttgctgagtagttttggcaggtgttggcaggagctaaaatagtgtcaaggctctctttgagggggaccttcactgagctctctcacctggctgttagcaggctggaagtttgctgcccacagatttacctctggaaaggtgtcttgggacaaagtacatagctcctccagaataagcaattcaagagagaatgaaagaggggacacccaagacagagaatccagtcgcttttattgctgatttaggaggtgacattccatttctcatgctgcattcttttcatccctataattaattaatctagcctgccccgaaggggagggagttacacatgaacagggatcactggggaccatgttacaggctttataccacatttattaaatgcctacgctggggagcactgagaaaagcataaaatagcagtgatgcgtataataggcaatgacacttattgggggcttcatattgtatcagctgtgtaccaagggtaaggataatgaaagctcacatatatggagtaaccattgtgccaggcactgtactaagtggccatgtgccctttctcatttggttttcataacagccctttctcagtgggtaccgatcagtacccattttacagataaggaaactgaggcacagacaacaatggcttctgaaattctcttctccgtgtcatgcactgcatttttctcccgttcaccagttgcatcttaggtctcagttcattttcaccaccttcctgaatatatagagagaaagcccatgcagtaaaccaatcaaatcctggctatccgagctgctctatctgcctctgaaagcctaggagtaaaggaaaattgtcctcatgagcagttcatgaggtgtcattcaaagcacttttgaggcaaagtattatgtttcacagccatggttcccagtagggacagcaatattgcagtgaaatgcaccaacatctctgcccatcccaaactctcctctcaaaccagtttattgaaatgaggcctcacttcacaagtaaataagtagtcaagctctggatttgtctctgctccagcttactgtatatttccactaaatgagtccattaaagcttaaactaaaccttttggaaaagaaaaacaaagcccacagcagctgtccagggctgcgggagttagaaaatgcaattcatgtgacttggtggaatgccagtgaagctaccattagattattctgtttactgttaaggtacgtggagacagacaggctctggagatgtccgacctgcatttggatgacaggtattgaccacctccttgatgccaggcatggtgctatgcagaggcatataacagcacacacaggacacagaccatcccctcaagggttttgcagtctcgtgggagtcatcaacacaagatttaaataatgtgtcatgtgtgctagggagaggaagtttggggttctttgggaggatataaccttgagaagaatcaggtagggaaagtccatagagaagggtttgtttcctctgagatacgtaggccaagaaagagttagggaagtgaagacaagaggggacagttttgtcaaacatcagctataaatactcaaaagcagctaaaataatgatatatctgcaaaactggaagcagttcagtagggttgaagaaaagatagtaaagtgagggctggaatgggagggcagagaggtggcaggttggaagactagctaagcattttgggctttgtaacaagggcattgacacatgttaaactcgggaaaaactgatcgtttcattgtacgaacagcctagcttataaagttatttaattagaaaattttcagaatacttttgattcggtggtaatgtgtcaacaaccctaaaatgttatgtgtttttctgtaaagtatgtggatgtgaagggaagcaacatggggcatgattattaagagtacagcttctggaatcagagatcatgtaagttggaattctagcttatccaattacttaatgtgtgagtttaggaaaatatctattaacttaccaccaattacttaatgtgtgagtttaggaaaatctattaacttaccacaatctatagtacctcatctgaaaaatgggaataattaattaatactgagctcatagagcttttggaagaatcaggttaggtttttacgctgcatagcacattaccacctgcagaagcttaacacaacactcttttgttatctaacagtttctgtgtatcagaaatttgagcatggcttagctgggttctctgcttaaaatctaatagactgcagtcagggtatcagccaggactgggttctcattagagactcatctcgaacaggatctgctttcaagctccctcaggttgctggcaggattcattttgttgtagctgcaggattcgtggctgcttgcttctgcacatccagaaatgggtggagagagagacagagacagagagggagagagatccagcaagagagttgctataatcttatgcaatcacttaggttgatttcctctctttgcaattgtgaattgtgctgcattaagcatgcacatgcaggtgtgtttttttatacagtgacttgtattcctttgggtagataaccagtagtgggattaactggatcaaatggtagatctatttttagctctttgagaaatctgcatactgttgcatactgtttgccatagaggttgtgctaatttacattcccaccagcagcatataagagtccccatttcaccacatccatgctaacatctattgttgtttcactttttaacagtggtcattctggctgggtaaggtggtagctcattatggttttaatttgcatttccctgatgattagtgataagcatttttttcatgtttcttggccatttgttggctattctcatcttctgagaaatgcctgttcaagtcagagactcagaaggagggaggcaaggaggagggtaaaggatggaaaattacctatcgggtacaaggtatgcaattcagttgacaggtacactcaaagccaagccttccccactatacaattcatccatgtaagcaaaagccacctgtgcccccaaagctactgaaattaaaataaaccttatataatcacatacatgtaatcacacttatcttatcacctctgtcatattccattggttagaaacaagttgtgggtcctgctcacattcaaggagggattagtaaaggcgtgaatgttaggatgtggggatcatggtgagaagaatcctcaaggatgcacaccacaagaatttggtaaaattgtacacataaggacagaatagaagcatttagccttgtgaagaattaccagggcaccgaaagagagaatggaagcatataccaaatagagcacatagagaacttgctcagatctcttaactgttgttgttctggttatgatatgatttttaggaacatgtggcagagtgtttctgtgagtttggtagcaaatacatattggatgtacttgcttagtcagttctgtgtgccagaggacactcatggggagagatcaaggttactttttgcaggtggggcattttgtaactgaataaaacccagtcagtaaaagtaagcaacatgcggaatctaggcaagtgttgcaatgtatgtgtgctcttgatctgaggaagaccatgcatttgactcagactagaaacctacaccacagaaatcccacccacaagcaatgctctattactgtaggtacaaggcagtaatttttttgtgtccattcacatatgcatgtgtgtttgtgtgtacataattgaccaactatcctcaggtttccctatggtgaatgatttattgagtcatcagacttgtggaacacctactctgtggtggccatgatgccagcctctagagataaaaagtacaataaacgagctatcttaaggaaactcaaattactttggcagacagaactagtaaactgaccactgacaattcaaaaatccatggggggagttccatttcgagttagatgggatatatttagggcaattcccatcctgtttcacttagatatgtttcactacatatcaaagtaaacttcagaggaaaaacaacaacaaaaaaccacccagacatacaggaggacattatataaggataagagggccaagtcaccaaaaagacaaaacaatcttaaacaatcatgattatttatgcacaaactatgggacttttaaaataaagccaaaactgatagaactgaaaagagaaatggagagtctacaaacataagtgaagtctgtctcactatttgataaaattaatattgagaaaattaacgaggctgtagaagtactgaacaacaccatcagccaacaaaacatagttaaaatgtgtaatcaacaccatccaacagcagcaggatgtccgttctgttcaagtccacatgagatatttaccaagataaaccatattctgtattataaaaaacttaacaaatttaaaataattgaaatcatatagttgctttcctctgacaaaattgagttaagctggaaatcagtaacataaaataaactggaaaaaatctaaaagcacttggaaattaaaccgcaaagtctaaatcacccatagttcaaagaggaagtctcaaggggaattatagaacttaaatgaaaatacattttacaaaatatatggtgggaagcgaaagcagtgcttagagggaaatacataatgctaagtgcttctattagagaataagaacgttctcaaatcaacaatgtaagtgcatatcataagagactattaaaaaaagcaaatcaaaaactaatacatgcaaagagaaagaagggaatagtaaatgtaagattaaaaaaatgaatttgaaaatcaaaaagcaatcaaacctaaatctggctctttcaaagcatagaagtgatgaatctattctagcaagactgacaaaaagcagagatgacaaaaattacaaacatcacataaattaaaaagattataaggaaataatcaaataatctatgcacatgtagtcaacaacttacatgaaatagactaattccttgacaaccattaccaaaacttattcaaaacaaacaggataagctaaatggttcaatagacttatttaaaatatcctgccaaaataaaaattttcagacacaaatggtttcattggctattccaccaaacatttaatgttgggaaaaaaaaaaaaaaactatacacagtctcttacagaaaatagaagtggaagatatacttctcaactcaatttatgagtctaacattaatctgatacgaaaaccaggctatatgtaatattttatatatgtatatatacacacacacacacacacacacacacacatacgtaaacatatatcatggaatacatataatacagaaaaataataacatagcatgaccacatagtattagtcccaggagtccaaggctggtttcatattgaaaaaaatcaatgttatgtaccatattaacacaataaagaagaaaactaacacatgaccctgtaaaatagtcctgaacagtattggaaaacaaaagctaatctacattgatgataaaaactctcaactaactagaaatagaaggcaccttctgcaacctggtagaggatgtcaacaaacaaccccacagctaatatcatacttattggtgaaaaagtgactgctatctccattagagcaggaacaagggaggagctccactctcaccaaacttatgccacatagtactggaaatcttactcactacaataaggaagaaaaagaattatagagcatatcggttggaaattaatatataagggcatctttaatcacagataatagaattgtctatttataaaatcccaaggaactctaaaacctcttaggtgaaaacataaatatcaatcatatatctatatactaggaaagaacatttggaagtcaaaacttaaaaacaaaccatttacaatagctccaaaaaatgcaatacttagctataaatataacaaacatataagagatctttatgctgaaaactataaagtatttgtgaaattaaaaaagcaaatctaaatatatacatagattcaaagactcattgtagtaaaagtattaattctgtacaaattggtgtataagtttaacacaatacaaatcaaaattctagcaggtatttttgtagctataaacgtgaagattctaaaaattataaggaaaaacaaaaactagaatatccaaaataaagaagaataaaattaggtgaatatatctaatttattttatataagcctatagaagtaaagatagtgcaaaccagtaaaggagaagacacattaatcaactggacaaaatagagactccagaaatagacccacaaaatatacttaattaaatcttagaaaaggtacaaaatcaaaggagaaatgattttgttttcaacaactggtgttggaataattgcaaacacatttgccaaatcatatgctttacaaaaaaattaactcaaaatggatcatagatctaaatataaaacgtagaactgtaaagttttagaagaacacatgggtaaaatattcacgtccaaaggagttaaaataagaatttttggccatgacaccaaatgcacaatctcacctccccaaaaaggtttaatttgacttaacaaaattgttaataaattatatgtgaaggtctctattaaaagaaagaaaatacaagaatctgtaaagaaatatttgtaaaccactcttgacaaatgttcagtatctagaatatattttgaactctcaaaacataaaagtaagaaagcaaacaaactatcttaataatgggaaaaagacttgaatagtcacttcacttagagtatattcatactcctttcttattgggtcctgagtggggggaaaagaagagaagaggatattcatcaggcaaaaacctaaaaaagaaacaaaaaaccgtgaaaaggtatttaacatcattagctattcagcaagtgcaaatgaaaactaggatggaataccattaaacacctagtagaggcataagataaaaaaaattgacaagacttagtgctgtggaggattcagagaaactggatttctcctgtactgctggtaggaacatagaacaatgcagacattcttaaaacattttgacagtccgttacaaagttaagtatatgcttatcatagagcctagcaatcctactcctgggttccttacccaaagatattgtatatttataaaaaacatgtacatgtctgtgtatagcaactctaccatagccccctagaaacaagccatatgtcttcaaatagatgaatttgaagcattacatgtacacgtggaatactactgaacaataaaaaggagcaactattgatatatgtgacaacttggatctatttcaaaagcattatgctaagagaaggaagccagtctcaaacgatgacatagtgtataaatccattcctatgacatctgcaagaaagaaagctgtaggtttggggagaaaagatcaggggctgccagggattaggggttggggggagggtagttgcaaatgaatagcacaagagagtttttggggtgatggaactcttctgcttcctaattgcacagccgttataagaatctgtaaattatgttaacatttatgaaattgtacatccaaactttcaaatttatggtatattaattccaaataaatgcaagcccatagattatatgaggataaagtctctgcatatttttgttgttatatctccagcccatagcatcattcctggcaaacattacacatttaaaaatatttgtggatggaataaatgaaaaagtgtagaattaccattgttattattatttatttattattttttgagacagcggcttcctctcttgcccaggctggagtacagtggtgccaatacagctcactgtaaccttgacctcctgggctcaggtgatcctcctgccttagcttcctgagtagctgagactacaggtgcacctcaacataattggctaattcttttaattttagtagagatggggttttgacatattgtccaggttggtctcaaattcctggcctcaagcaatcctcctgcctcaacttctcagagtgctgggactggaggagtgagccaccccacctggcaaaaattatcttttaaaagccatatgttaggagctagtttaggggaaatatggtgactacttggacatatatatttatattgtatgatgatactttacagctatagattactaataatttataaagtacattgttttatatttagaatttgcaatataagaagaagggttttgcacgagggtggggctgtggtcatttgatccagtttctgttttaagaacatgccacagtctgcagtggagaagagaaaggagagagggaaagtggaatctctaagttgtattaatgctacatcagtgactattcttctacataggtctttgtgcatatgatgtctatttaattctaaaaatggaattactaggtcaaaggttatgtatatttagaaatattacacatatattacatgaccctcccaaatgcccagtgttttatacttttaccaagtctcaggagagttttcaacgaacttgtacataaaataaaagctggtggcatggtggctcacatctgtaatgacagcacttcgggaggccaaggcaggaggactgcttgatctcaggagttgaagactagcctgggcaaaaatattttttaaaaaattgccaggtgtagtggtgtgtgcctttggttctagctactcaggagactgaggtgggaggatcccttgagttcaggaggttgaggctgcagtaagccaagatcacagcactgcacgctagcccaggtgacagaatgaaactctgtcataaataaatagataaagctgatacagtatctgtaatttgaaatatgtactgtacacttctgaaccaaccatcctccctcccttcctcgctccccctcccctcccctcccctcccctccttccttccctctctccctccctccctccctcccttccttccttccttccttcctgtaataagttgtgagttttctcataatgtcttcaccaatagggcaacacatgatagccctcatttcacattctacctaaaaacgtgaacctcacaatactcgaaaatctccccacatacacaaaaagactctatatcacatacggaaaaggtagctggctttagttcagtgatttttcaatgaggaatgctgcacttccaatgaaaacagacagccagtgtagagacagtccgtatcctgtttctactgtatgactctgattcataaattactaaagtgtattcctgacaaataaatatttcaccagccagtgacagcgttatgagctaattaaaatctgagccctggaagaagtggtgccattagctcaattcacaggactggaaagtatgtgtctgctcacggactgagaggtagacatttacatatgggaaggagggggccggcttattaagagcaacattgaggtttggatgaagagagcactctgtcaaagctgagatatttaaagaaaagccaaaatgacaatatgagaggtttcttttgcccttgggaagaaagaggtaacactgcatggtggtgttaagtgtaagggcttgggggacgggccacactgtcttgagttcagatcccagatctgccatttagcagagatagaactttggggttgtcgttcagcctttctaacctgcagcatcctcatttgtgcagtgggcatagaaatccacatagtggcaagggtataaaatcagatactacttttagatcctcagcagagtgccaggcaaatcaatagatggttgataccttgtcactagcgtcaactcttgtatccacaagaagtcatgtttaaacgtccagttttctgttaaaaatttcaaacctgtcggatgctaagcagttttctagtttgaagtttgttccttcagaaaatatggttaacacacattttttgataacttatgatgtgccaagtcatggatggttctaagcattttacggtcaacatctcatttcatcatcgcaataatatagaagatggatatcgttaactctacagaggaagctgaggaacagcagcaatgagttatttgctctaaaatttaacactttttttttttagacagatgcctaaactccctttgtttcacacaactatgcaaattgtgaggccaaggatatgactgcaaacgattaaggtttaatttacatgaatagccaggcgaagtgcctcacacctgtaatcccagcactttgggaggctgcggtgggtggattacctgaggtcaggagttcaagaccatcctggccaacatggcaaaactccatctctactaaaaatacaaaaattacctgtgcgtggtggcacacacccgtaatcccagctgctcgggaggctgaggcaggagaatcacttgaacctgggaggcggaggttgcagtgagctgagatcgcaccattgcactgcagcatgggcgacagagccggactccatctccccccaccaaaagaataaaaaataaaaaagtttacatgaatgagctttcttccccatgaaaataactgtgtcacttctcccttggtctaacccacacaaaatccccaccctgtctggcacagatacacttaacatgcaatattaagtacaatttccattttatttttctccagagtatcgtgtgtcttcagtcttgaaggactcagctccttacatgggctttggtgggggtcatggggcagcacccgcaggtctaaatcgaggtgggggtttttggtccctgtggggttcacaagatcaattcctgactactttactgtgaactgtgcagctcacacagtaacgtggcttcacatacagcttgggaagcacaaaggcatcgaagacgcttgcttcagaaacatccctgactgctgtggcctctactatgttttgaatacaaatttcttaatggccttgtctttgggcacgcgctgggcacagttcgtgcagcaaataggctgcatgtggctgcagccctttttggcatgactgttgttcttccttttcttagtcatcttggaggcaaggaccggagatcctaagttgttcttttaaatatatatgtatatatatataatattcgtctgggtacattggctcacgcctgtaatcccagcatttcgagaggctgaggcgggcagatcacctgaggttgggagtttgagatcagccaaagattttcttttagcctggccaatacggtgaaacctcatctctactaaacatacaaaaaaatgagctggatgtggtggcaggcacctgtaatcccagctacttgggaggctgaggcaggagaatagcttaaacccgggaggcagaggttgcagtgagccaagatcgcgccactacactgcagcctgggcgtgacagagcgagaatccgtctcaaaaaaaaaaaaaaaaaaattattgcagacctaagagaaaatctggttggtccttcctagaccccttttgtttaaacagctatgactgaggggagcacttcatgtggtcataaatggtggctggtgttctacccctgactgtgattataatttcagagaaagaaaagtctctgtgaactagccacaaatgcctccgaaagcataaaatcgttattcagcattctccatactttcctgtatccatggtgttgtcagcaatatgtaatattatccatagtacttatgatactgtgtttgcttggtctcaagagagaaggttaaaagtaacaatctcaggtctggttataagcattttgtaaataataacttatttgatacttattatcaccctatgcacttagccactattatccccatcttatatatactgttatgtcaaggtagggagaaataaatatgttaagaaataaatagagcagtttttgatgacagggatttacttacaggtcttttggtatatggtgtgtactgtatgtgtatgcacgagcgtgcatgtgtgtggggaatgtgtacattctgtatcatggtgtgaataagttgagagtgagagtcgggagtaagggagatgacaattgtgtggtgatgatttcaagttaagagtataaatgtggaatgaatgagtttctttcagaggactttgggttgtatatgcttcaaaacgagcttttatcttctgcattcttcctcatagccccgtggaggcaggctgaagccttggcacatcttggtaggatgacctgactgagagcaaaggtcgtttgcaagcatataaggactttattaagcagcatattaatcaggcactgttggttgcaagcaacagagtcacaatgcacctggtcttttgtttagaagagggagttcattggcttacacaactgcaaaggtccgaaagaggctgggttcagatgcacaaatacacggtttgaaatctggttctttgctgtttcttggctcagcttttcagtcttgacatcgtcctctggcaaattcttccttaatgggggctcaagtgatgcagcagctccaggcttactttctatgaaatggacagccctggtgaaaagcaaatgtctccttcctaaccattctgacaagaacaataaaatcctcaaagattttctttcaaagaataatagcatgtattaagtgccagacactaagtcctttttgtatatgaactctgttatttccttgaatcctcacaataattctgcaagataggtactatacttaaccccattttaatatggtaaaacttagttacagaacagttctgtcacttagctattgctgtgtaatgagctagtccaaagcctagtggcttgaaagagtgaccatgagtctgataaattggcaaaccaagagagcctgaatcctccagggtgacatcagcggggatagttcggttctgtacgtgtgtgtctctgatatccccagcaagctagcctggttcacttagtgaggtagagatacagcagtgagctggcacaattgtacatgcagaaggggcaaaggtactcaaagcctggagaggctcatgctaggaactgacacattctcatttctaccctattgttaccagaatatgttacaagtccagtttggattcagagggtggggaactaaactctaccacttgatgggaggatgttcatggtcatatcacaaagggctagaactggggaagaatcggaggctattttggtaatctgtctgacataatggtaacttttttttctttttactttttttttttttttttttttaagacggagtctcactttgtcgccaggctggagtgcagtggtgcaatctcggctcactgcaacctccgcctcctgggttcaagccattctcctgcctcaacctcccaagtagctgggactacaggtgcatgacaccacgcccagttaatttttgtatttttagtagagatgaggtttcaccatgttggccaggatggtcttgacaccttaacctcgtgatccgcccacctcagcctcccaaagtgctgggattacaggtgtgagccacggcacgcagtcataaaggtaattaaacttgcccaaagttagatttttagcaggattcaaaccaggaaagtctggctccagagtacaagttcttcctcattgcaatgttctttatatagtttttattgattcggcttggatagtaaccccacaattgaaccaatcattttggccaggaaaacaaagtgtttcatcggtttggttagatttgggtcctgtcttcatttctaagatgaggtacaggagtcagccctacctaaaccatgggtactggaagtggcataggaacagtagctcaaaggaaagttattttcagaagaagtaatggatagagatcaggtgacaaaataatatcccccactgatagggatatggtaggggcaattgggtaaatttcaaggataagaccttgccatgatactcttggattacaatggagagacacatttgccctatctcctggggaaaaaaattgaggaattacagttggctttaagtgtatgcatctgattgttgactagatcatgaggaggataatgtggacattaggaagaggggccttgcagaaaggggcagaaatagcaaatttcaagtgcctgggagcccccaaatcgggttgtgtgtgctatttttaaagtaccaggagacacgacaactcctagctgcaaagagacatttatcacactgaaaaaaaaaatgagtgaatggttagacagatagatggatgatggatgggtgggtgggtgggtgcatggatagatggtggatgaaaaaataagcaatgaatgaccctctagatgataagtggaaccctgctttgttttccatttcctgcttcaaatctcatttgccagcaataccaaataggatatatactcctctacttccatctatacctggcctctaatcttcttcatttttgaagattttttttttttttttttgagacagagcctagctctgtcgcccaggctggggtgcaatggcgagatcttggcccactgcaacctctgcctcctgggttcaagcaattctcctgcctcagccttccaagtagttggaattaacaggcacgtgccaccatgcccagctaatttttgtatttttggtagaggtggagtttcgccatatttggccaggctggtcttgaactcctgacctcaggtgatctacccacatcagcttcccaaagtgctgagattgtaggcatgaagccaccacgccaggcctgaagactgattatttttaagccagctgaatgggttaagtgtttgtccattgtgctctggaaattctctgagcgtattcacattattacacttaacacttttgtgaaccacatccttttaggcaaaagtgatcatctctgtctcactcattgcagtactctaatgcctaacacagagcctgacccagagagagtgcactgcaagtatattctgaatgatggagtgaaacagtgagtcagtgtgcaaataatgtgtgttgataagcatatgtagggtctgcagtggtgatgtaggttttatagccaatgacatctccagtgcctttttacttgataaatataagactataattttcttaaaagcataaataataggaagtgttctcgaagcccattcctggccaaattctttgcctttaatatcgtgcttaaattttgtcaacgcatttcttttaaaaaatggaggaaaactgagtggggaacaagaacactttctcatctcattcataatctatcaggcaatcctggggtgccatcaagaagagatgatgaggcgacagtgacacagcaatgactgccttcagttttatcatcagtcctggatagagaaggtgcaccacctataagtgaaggtgatcagtttttccatttccaaagagatgggtatcttaaaagttagaaatttgtgactttgaattgcctttttaatcataagaatcatagcttctggccgggcatggtggatcatgcctgtaatcccagcattttgggaagccaaggcgggcagatcacatgaggccaggagttcgaaacaagcctggtcaacatggtgaaaccacatctctactaaaaatacaaaaagttagccaggtgtggtatcgcacacctgtagtctcagctactctggaggctgaggcaggagaattgcttcgacctgggaagcggaggttgcagtgagccaagaccacaccattgcactgcagcgtgggcattgcagcgagactgtctttttttttttttttttttttttaaaaaaaaaaaaaaagaatcataggttctgcttagtcagtgcctacttatgttttaagttatagttggccactttacatctcttgcttctgctccggtaggtttcataatctccattttatagttgagggaatgagtacctgaaaggatggaataaactcaccataatcaacctagctggcaagtgattggaactgaggtttgaaccatgttcatttgactctgaacactgcagtctttcctgaataccatccctcaagcagagagttgggcccagatgagataggcagagcttccttagcataaagtcaatattgtctttttgccagacagtaagccaagcataaccgcatacatctgaccagaggctcttgtacaaattggccactcaggttctctgaaggagcttgatttggggcctgtgaatagtcctgtgaatattgggatacatgagattaatttttccctacatctaaacatccaaatggcttaacttccagaggggcacatcttagcttctagggggtgagaggcttcccagtatcttaaagaagtggttcttaatctcactggcaagttagaatcacctggagaactttaaaaaacattgatgactagagtcctttttttctttctttttttttttttttttgagtgtcattctgttacccagactagagcgaagtggcacaatatcaggtcactgcaacctctgccgcccgggctgaagcaattctcctgactcaggctggaattacaggcaccttccaccatgcccagctaatttttgtattgttaatggagatggggttttcccatgtcagccaggctggcctcaaactcctgacttcgactgatctgcctgtctcggcctcccaaagtgctgggattacagtcatgagataccctgtccggccagagtccaagttcatcattgcaatgttctttatctgtatatatttttaattgaactcctatgttcactgcagcattatttataatagctgagagatggaagcaacctaaaggtccattgatgggtgaaaggttgaagaaattgtgatacacagacacacacacacacacacacacacacacacacacacacacacacacacagtcactttatcttgaataacataagacaaatgtattcaggtataagtattaattcatggtgccttgcataatggtgagaggcacacatgtttatgaaggcagaagtaaactatttgtaaagctgaaaaaaaaaaaccacacacacacaatggaatagtattcagccctgaaaaataagggcagcctgacgcacacttcagcatggatattccttgaggaaattatgctaagcgaaatcaaccagtcacaagaagacaaatactgcatgatttcacttatatagctatttcaaatactgaaactcttagaaacagtgggcttatcaaaattgaaaaaaaaagatacatctttcagtaactgccataaagcaagagaatgctgccacgtggtgataaataggtcccctgacatatgtgcataaaaattgtgcccattttaacaggatacattttttcacttgtgattctgatgaaactgcaaactagagtcagaaaacaaaccgttataccaggaaataaaccagaaaataaataaataaccagaaaataaatcatgtgccttggtattttcttgcgtttcagaagtgaccttattatggcaaaactattttttgatattatggtttgtatgcatcaaaaatgcaggttttaataccaagatccatgacctagaaagaggttttagtatcagattctcaatgtttttgatgaagagggaaagagaaaacatatcatttaaaaaattattttcaatatatgacagaattttatattttgaacaagatattgttttgtatataagccatggagagtacacttgaaaagctttggcttttgagatatttggtttctggactcttgtttctgtaaattagaacattccgatgtgagatgaacatattggttgaagatcattgcaatggtcatgtttttccaaagagaagtagttgaaatcatttagtagcatgtgaataaaagcaaggtttttagaggcaattcagtaattttggtagcttttgttgcaaccaacagagaatcaatgacaagacaaggagaagagagagagcagctcttgtcttaatttaaagctgaaagatacacacatgattaataccaaagaaactttccattttattggtggaatgaaagtaaccttgtagagcttttctgtattggtagaaagcaaaagcaaaaaaattaattgtttatttaataagtggtatttttctgagttctgcttatagtttctttagacgtagaataacacatcattaagaaaaataataattgatctgccatgaaaaaaaaagaatgactgacacagcttctttgctgtcagcccttttgtactccaaaacgtaatgcccattttgaaatatcatggctaatccaaaaaatatacagctaaacagaaaaacaacatcagttccaaatatgaatacatgatctgctacttaatatgtcagggtatttgtcaggttgataacattaggctctgcggcattcaattctaagccttgcaatatttgaagtgtgatactgtgcttcagtaaatttaatacgtgggcctcagtaatggagggaatcacgttagcacttggcagtttgttatgctgtataaaattgactgccctgcaaatacaatagcgatcataaaaacggtggtcagcagagaggggtgtaatgcatttttgaggtttcagtaaaggtccagatgaaatttattgagatttttgccatttggatggtgatcaatagagctgtgctaataatttgttgtgaggatgttctctggggatatgacattttgctgtgaaactttggaaattcagaaagtagactaagtgatgatactgctccagtatatataaccgtcaaagactttaacatcgctctgggagaggatttatagtgatggtgattacttcttcaggcattgaggatgtgatgcatccaattattgatatgttttcatgcattttccagtttggactcacagtcatttgatcgtattgctgtttcagcccagagttttgtgataggtttgtttttaatttcattcacagtttccaaattgctagcctattttcttaattatatcattgatttcccctgcctcctctcccttcaccctgcccacatccagaaaatgatcgttgaagaaaagaattccgtcagctttcattcacatcaacagaggctacttagaaatcctgactgtgaaaactacttttgttgtgttgtagttgctgttgctgctgctgtagatggcttgtgtgctgtaccgaatttgcaaacaggcttctgagttaatgttaaaggagtacatagcatgcagataatgtttgtgatggttacagttttaatgcacatatgtcagtggacctgttaaatcactgtgaggcagcattctttggctttatggtggttgccgttgaatttatcttttttttttttcaattttgattagccgcgttccaagagagagagatgaattatccaatctttgcaaagtgggattccacactgacaatacagagatatcattctgagaaaaataaaataaaacaaaataaagaaggttttaaaacttcacatttggtaaaactgacttatcctgaggctgtttttatgtctgttctgtatgttagaaaaggaatttctgagttcgtgtttatttccctgttacattgttctgtttcctcagtgtatttcatgaacctgaccaattaagtttcagccctgtctaggaatttttttgttgttgctgttggattaaagcaactaagtaactctgcagtggacagaggcttagagagactccacattatttgtttgcaagaggaaatttgtcagcactttgcagaaagaacactgagactaggcacagcagaacaatttattttcaatgagcatgcacaaagtaagatttatgactttgcatcttcgatgacatttcttacattgttaccaagctacagcaaattaaagggatccgtgaatactaaggggtgtgtttttgtaatgaggaaaaagagacagagcaataagaagataattaaggtaacaacttgtgaaaaattaaagtgtttccatctttcatttttgaatctctgagcataaactttgtagttgttaatttaattgccgctgttcgcggcatccctgaagaatattgaggattaatcgtctggttcattccaacaagagataaggcctaagtgaattgaaattttaccaatttaaccctgtcttcctcctaatatgacatgattaacatttttcaattaaccacatgtaattattctgaaggcctcattccacttatttctagtctttttgactgcagattggccttttcaggtagtttggatctagaataattcaaagaaagctctgtttgttctattttgcatctggcacacaggttcatctgcattgtctttggagttgccatttcatcggaaaataaagatccataacagttgcattcatttttgcctaggtgctcttcctgtaaagcacagtgctgctcattgaagcctgaaggagtaatgtggtattgttggagcatatttgtaactgagcagagtgaaagactaaacaccttgcaggcaagaatgtcaaaggaagagattggctggaaatggttttccacagtaaatggaaagacctcaagattcgggagagtttggcatttccaaggaacagaataaaggctagttctttgtgttcgtccatatggtagccagtaatcacagtggatattgaaatgtaaattaattaaagtttaatgaaatcaacagttcagtttgtctcatattagccacatctcaagtgtccaatgacccccctgtgactagtagctgtcatattggagccaatacctagtagagatacagaacatctctatcatcttgggattttttttttttttttttttttgacagggtcttgttctgttatccaggctggagggcagtggtgcaatgatggtgcaatacagccttaaactcctgggctaaagtgattttctaacctcatccgctcgagtagctgggattacaggtgcacgccaccacacctagctaattaatttgtttgtttgtttgttgtgtagaggctgggtctcataatgttgcccaggctgatcttgaactcctggcctcaaacaatcctcctgccttggcctcccaaagtgttgggattacgggtgtgagtcacttcacctggccccatctagggaaaattatcggatagtgctaggccagagcacagtcatcaggtggatagtggttagtattaaccagggcattctaaattctgatatggcaacaaaaatctctgtaccagaggggttaatgctacatgggtttatttctctcatacacaaaatctactgcatgcctgggcaggaaggaggcatctagaagtttgcgctggggccctttcattcctcgtcatggcccatgggccaggactggatgcccatgccctgcctccctgcaacaggacttttatttcagtcttttgtttgccaactggacactaagttcctatttgtatcaccaaacactattattatttctattctataaaggagaaactgaggcccagagaagttagatagtctaaaataaatacctaaagaatgatgcagtgggtttctaggtacatctgagtccagctgcaaagtctaatctttactgagctagctggactcttctggtgcacactaggaagtcatcagaggctttccagctttagaaaacctattctgaccagcacaggtgatacggtttggctgtgtccccagccaaatgtcatcttgaactgtagctcctgtaattcccacatgttgtgggagggaactggtgggagataatcgaattgtgggggtagtttcccccatactgttctcgtggtagcgagtaagtctgatgagatctgatggttttataaggggaaaccccttcacttggttgtcattctctctcttgcccgctgccaatgtaaggagtacctttcaccttccgccatgattgtgaggcttccccagccacgtggaactgtgagtccattaaacctccttttctttatacattacccagtctcaggtatgtctttatcagcagcctgaaaacggactaatacaaaaggaaacttagaagggaacctcagattaggggcaagctccttggttagaagcctgatacgtgacaacagcaacttaactcaaaggaataatggtggtaaactcgaacacataacattatgcaacagtccctacctggtcctggagtagaaactccaaaaggggaaggttgtagttcatctgcaaatgtatgtgcacaggctcactacatgttttggctgatttttattgagcatctgtgatttgccagatattgttttaactttttagcttgatgtacattagctaattaaatactcaatatttcagtgagttagcctctattttcatggttttacagatgagaaaatgcacgtagagagaggttaggtaacttgcccgaggtgacacagcagaggagctggaattttagtcaccatcttaagaatgaagcaatgtttggagagaatggtgactcagagattcgtatcacagccaaatcatacagaaagcgctgttgactcaaatagggtaaacagataatgcaaatccaaagctttgggtgtgaggatcagatggggcaatgaggatggcgaaaggaatacctgaagtcatgagagatggtaagattgctgagagggtgcagatataaagggagaaaaataagaggccacacatgagatcttcagcaacatgactcattaaataagaccaagggtttcagtgttaaacggacttctgtaaatcttggctttggcactatgtcacatgggcaagtcatgtaactttctgggacaagatttccttattggcaacgtggaggcaaggatgctcaaagcaccagacccaaccaggacaaagaagagaatgagcatgcacatctctgcccacaaactcagtcttggaataagaagcacagttttgtgttattgtgaaacaacgttaattttatcctcatccccacttttccttcatggccaggaaatgtaaccccccattatgcaaaagataataattctcacctggggcctacaaaggtgaaggggatggggaggacctgcctaatcatctaccttcatcatctcccagatatataggctgcatttctgcaggccgtatgcttgagacttgaatatttcactaaaacaaggaacacacatccatttccctttggagagctctgctgctggataaactcagactttttttataagatggagtctggctctgctgcctagcctggagtgcaatggtgtgatttaggctcagtgcaagctccgcctcccgggttcaagtaattcttgtgcctcagcctcccaagtagctaagattacagcctcctaccacctagttaatttttatatttttagtagagacaggtttttaccattttgagcaggctggtctcaaactcctggccccaagtgatctgccttccttgccctcccaaagtgctgggattacaggcatgagccaccatgcatggtcaacttacagattttgatattcttaccagtgtctggacatctcttttataatgcagatgaaatcaatctctctctgtgtgtgtgtgtgtgtgtgtatgtgtgtgtgtttgtgtgtgtgtgtgtctgctcctcctctcttctctttctttttctattttcattatagctactctgtcactccccatgcagaacatccaacataatcacttcaacaaccagcttttggaaaagcaaaagcttcttacagacagaattgtctttctgccatgcttggcttcatccctccactaactctattccttttccttcttgagttcagagacaaagagggtcctatatacctacctgtttgagtgatggaagagaggaggaaaatcctaactaaatagccccagatagtttgcaaccaggtttttaaaatgcttaacatggttcctggcatattatctgtgctggatcaagggtaagggtaacttctactactactacttttatcagcaatggtgaggaaaggatcagagacctgagtccaccctcgacagtttcagtttttggtaaagaggcaagggagaggagaatgtttcaagaatgttgggttggtgaataaaaccaaaggccatgaagaggttgaagactgagaaatacattgattggattcttttttttttaagttcatcggtgagctttcagggggcagttttagttgctgtggacagaagacaagcattcatgtcttaaggaatgaggaattgaggaggaagctaagacccttaggatggggtgagcttgtaaaatgttggctgtggaggaggaagaaggtaaagacataagcctggaaggaagaactgacatgagttttagttgctgacttgatatccaagtcaagactgcagtggatcccaggacacctggaaaaagatagctgtctgggcattaggggattaggaatattagccaaagaatggtaggctctgtctaggtatttatggactgttctctctttctctctgcatgaaactaattcattctcattctcttattctctccttctctccctctctctctctctctctctctctctctctctctctccctccttctccctcccaatttgtccattttctgaatggacaaataaattttgtccatttttttttaaatggcttttttttttttttttttttttagttttttaaaggtcaccttctcttggttatttttctgaccacacaaagtttcttttccccactctgagtctgtatgataggattttcttcattttctgtgccacttcgctcagtttgcacttatgttttcatggctatattgtctaacttcccaaatatgtagttttgtaaggagagaaatgatttcttcaatttattgttggatacccaggacctagcatatagtatgagtttaataaatacatcttttaagtgcataaatgaatgcattgatgaatttgggggcatctttctatttttttaaaggaatgaataaaagaatgtggcatatttctaggcagagctcatcaatatctgaaccaacaattcctgtgtgaaacgctgaaagcagaacctctcagagtgatatcctgtgcaataattattggaactgggagtgagagacggagacttgaatgaggaaatatttatggggaaggtagcgttaaactttccaggatgtttccttggtatgctcataatggatttcaaagatccacacctcttggcggactccaggagcaggatttcatgaagctcttttgtgaaatgcttccattaggcgttggcatctttcccaaagggattcaagcatggtttctaagtgtctcagagcctaacgtggaattgggagagagaaggagggagtgaagaggaaccctcgttggaagtaataatgaagcctcctccagctttgcagagctctgccaggaagccaccctcagcaaaccagggaacctcctgacgatgagctggggtggtttctgaaccatgagtcatcttgtgcaaagtggctctggctttatcaggatgatgtgtctagacttgcagtcagctggggagcaagtaggaggatcctggggaggaggccgggaaataatgggtgagtgttagtgctggatccagatcgcttcctgcccttcaaggagttaagttcagggcatctattcacacccaatatttattcattattcacccacggaataccagacacagtgcttggttctgggaatctaatgctgaccaagacagataggaccccttctctgatggaccttaaaatacagcttgggcggcagctagaagaccttatcgcatgattgttaatccaagttctcaggtgtgctctaaggggaaaatgcgcagcagtcaatgagagcataaagcacggaaatggagttttgctagagtgcatcaaggatcattgttattttatttttatttttattttggaaggtggggccatttatggctccctgtaccagatgaaagattgcatgttcattaacatattaatgccatttgtagtttggatgagttaaactcatctaactttagtgtttacaagggatgagctactatagtcttttggatcccttcttctcctttacctcatcatcctatccaccagtaagttctaatccatctttcctactctgtccctgctgtcaccagcctggtcacggtccatcatattgacgaccgcaccagccttctgactggacaccatgctactgctcttgtttcttctcacctattctctgcacagcagccatagtgaccttggaaattcataaatctgtcatgtcagtccccttcccccttaagatgtttcagcgggatcctatttcttattttccttctccttcttctccatcttctccttcttcttcctccttcttcttccttcttccttctttcttctttttatctgagacagggtctcactctgttgcccaggctggagtgcagtggtgtgatcatagctcagtgcagcatcaacctcccaggctaaagggagcctcacacctcagcctcccaagtagctgggactgcgagcacacaccaccacacctgaccaatttctgtatgttttgtaaagatggggtttcatcatgttgtccaggctggccttgatctgctgagctcaagcaatcttcccacctcagccttccaaagtggcgggattatggacatgagccaccacacctagccaagtcccatttcacttaggaaaaaaatcagactggttaccatgcccgtgaaatgaggtccatgtcctgagcttcttgttgatgtcatttcgtgtcactcttccatcagcccctgtaccgcaggcgactctggcttcctgagagtccctggaacaatttaagattgtgtcctacccctgagtgtttgtatgggctcttccctatactgttctccgcatggccggctctttcttagccattgggctgtgcctcaatattattttctcactgggattttcccttatctactcatcttctggactgtcaatcagagcattttgattgataacagtttaatcagtaattatcttgtttgtatatacatgtctttaatatgtgtctccctctctaaggtcactgcattccagtgagaaccacctctactgttttgtatatgacattcccaatgccttacaccgttctgaacacagtgttgcttaaaccagtattgaatgaatgaaagatagaaagaaaatggtcagccctgagtaattttctcttatttttcttctcttttccttaatatcatctgcagacacatctgcagagtattttttttttttctgtgagaatccatttctacctatgatatagctggtttctgacccttgagatatgactccaaaattgggactgggtggttgagagtgctttaggagaggtaaaatttgtcattaatactattgtttatgtgtgcagtgtccttcatattttttcctttcatatagcatttgacatttgcaaaatgttttccatttatttttatgttggggaaagcaaaaagccgtacgtgttttttggtgtaagtgagcataaaagcaaggcatctgattcagggtgatattttttgtcattttctttgtgttttgatcagggaaaattagagagagagagaggaagagagaggagaaatgacaatgcgtccaactgttttccagccctcctccaccgcattcccgacccagctctcagggagaggactgagccactgtagaaaagtgggaacattaaacgacccaagaaaatgtgaaatggtgtggggtgtgagatttctttattagtcaatttaaaataaaatgtgcctcagtaatttagaatctgtctggagtcaagcagaaaattagccatattcccatatcctacccccgcccctggaggcagcagaagcaccaataaaaataaaaataacaataccttgtatttatggggtagctttctcccagacctccttctcactcaccctttttatcttttctgtgtccttgaaggggagtgagtgagtctctgaaacctgggagttcagctctctgcagatacgatcctcagcattaaaacttctccaaagtccttcatttgatcatacattcatccatgggtttattggttcatttatactatttagcagtgcttactgagtatctacactgtgcttactgtgtatactgcttatacacagtatatcttacaggtagtacaagatcctagcaggtactataagatcctagaaggtaagagctactactatatagtccctaggagctattactgtaatgtctattcacagacaatggaataatcttgttagttttttttctgaaaacaatcataactctctttaaaccatggtgttgtctttggaacattcatagtttggttcctgtgtagttttcaaggtccgtaaaggctgagtttcgggttgatgtgtctgtaggctttttcccttgggggaaaacgtcttcatagaatttgctcctctaggtaatagatcatgaatatctctctagtttgcaaaaatgattgtttaagaaaggacatggatagacggatagactccatttctcctcttaaagatttcctcattttgaggggtcttggaattatttgagtgtttaatgaaagcaaagaacttcctccccagaggaattgatatatgcacaaagataacaccattttgtaccgtcactttagggttcacactttctggtacccatccttggacactatccatggccacccaggttaaaacttcttcttttctctttctttttctttcttctttttttttttttttttttttgagtcagggcccctctgttgttctggctggagtgcagtggtggcacacacacagcagctcactgcagccttaacgtcccaggctcaagcgatgttcctgcctcagccgcaaaaagagctggaattacatgcatgagctactgcgcctgaatctagacctatttagaaagttcaagtctgaacatttagtgatgccatagagagccctcccttcctgccagcattcattaaatgatggttttcactctgcagagcagcttccctccgctttccccagatagtctccctcccacctacatatgagaaaataaaatgttttcctgcatcactatgaaaaagagccctaaatcaatagcaaatcaagctatggaataaaagagtctttatggcccgagaaggtgattgctgaaggttgccatttagcagtattgggtttgtgtctccctggggtctccagcagcccagtgtctctgatgtgaggcacctttgcctacatgaaagtcagcccctctccccctcccccagtggagtgcagggagataagaattctgaaacaggtcagctgacgttgttttttaaaaaggttttgttctgggcaaatcctagccggatgtgactggtctgctcttttggtaccaatcctagcttgacagtgatccctttccagacataagcacctacaagtctcaggatggttttgctgcaagcagggggtaccatcccaatcatttctttaccccctacccttttttgtttcgttttgttttgttttgttttttgtttttgagatggagtcttgctctgttgcccaggctggagtgcagtggcgcagtctcagttcactgcagcctcaacttcccgggtacaagagattctcctgccttagcctcccgattagctgggattgcaggcatgcaccaccacatctggttcatttttttgtattttaaatacagacggggtttcaccatgttggccagtctggtcttgaactcctgacttgaagtgatccacctccctcggcctcccaaagtgctgagatgagaggcgtgagccatcacacctgggcttcttccccttttgccatgtgatttttttttcttgcacttaaagcaagtgcagaacctcatatgatgatctatatgcacttactgtgttttacccctctcggttatgttagtgggggtatttaggaaccatgctcattttctgggtgtttaatagctgaattctgtttcatttagatactgataagggtcttgaaatttaaaaaatgtatctttaagcttgacatctcccagtggtatggccctgtattagggagatataaaaatcatgtatgagtctccctatacctctctctgtttgtgttcccgcacacacactacttctccatggctcctccatatggccagtcctcttccttcatatacagcctagttctctgaggttcccatcccctcaagtccatgaccctctggcggagtagccgtagtggacaggtgcaccctccttcactaccttcctttctctgcaactagtcaccccatctgtgtccacagtttgatgactggctaggggctaagagtgctgtgattaaaactgctaacttcccacttcttttgactgttccaaatgggggcaagaatgaattttaaaatgaactttgcctgtcaaagcttgtctaggttaagggatgagcaatggcacagtgtcgtttaccccagagcatgaactgtttggtcctggttcaagccccttccccatttcccatgatactgggcctcacaatccatatgcaggaacagcagatgccacgtattgaaatttctagtttctctgccactaaaaatgatagctctgcttgcttgcaatatatgttgcctttgaaatgcacttgcagtgatggtctttcctatgcaagggcagagaagaaattgtctcatcagtatactttgctgaaccagctgaacccctcgcctacccagcagctctgtcacccccactgaggctggctttctagtgacgatgaacaaaggtggtcttcagctttctgatactagagagagctaggatgcataggccatcagagttaacttttgtatttctttcaggtcttcttgggtttctcattgaaacaaagcaagaagaataagcttatgatacccagcatattcttcagcactccagaaactcagaacccagcagataacgtaaaaataacaatgcggctgggtgcagtggctcatgcctgcaatcctggcagtttgcgaggctgaggcagacagatcacttgagcccaggagtgtgagattagcctgggacacatagtgagacccccaactctagtaaaaatacaaaaatatatccaaggatgtggcacatgcctgtagtcccagctacttgggaggtggaggtgggaggatcatctgaaccaggaggtcgaggttgcagtgagccatgtttgcgccattatactccagtctgggtgacagagtgataccctgcatcaaaataatgataaaaaagaacaacgacttttttttttttttttttttttgagatggcgtctccctctgttgcccaggctggagtgcagtggtgcaatctcggctcactgcaacctctgcctcccaggttcaagtgtttctcctaccccagcctcctgaatagctgggattgcaggtgcctgccaccatgactggctaatttttttttttatttattttttatttttttgtagttttagcagagacagggtttcaccatgttggccaggctggtcaggaactcctgacctcaagtgatccgcccacctcagcctcccaaagtgctgggattacaggcatgagccaccacacctggccctatttttaatttttttttcaacttttattttaggtttgagtggacatctgcaggtctgttacacaggtaaactgcatgttcctgaagtttggtagacaaatgatcctgtcacccaggtggtgggcgtagtacttggtagacggtttttcaaccccggccttcccactcccctgcatctcatagtctccagtgtcttttgctcttatcctgatgtccatgtgtactcaatggttagctcccacttacaagtgagaatatgtgatatttggttttctgttcctgcattaattcacttagattaatggcttccagctgcattcacgttgctgcaatgaacatgattttgttcttttttatggctgtatagtattccatgttgtgtatggaccacattttctttatcctatctgccattgatgggtatctaggttaatttcatgtctttgctatggtgaatagagctgcagtgaacatgtgagtgcgtgtgtctttttggtagaacgatttatttttctttgggcatatacccagtcatgggattgctgggttgaatggtagttctgtttaagccctttgagaaacctccaggctgctttcgccaggggctgaactaatttacattctcaccaacagtgtaaatgccttcctcaaggagtaatgcctagttagaaccttgcagtcacacaagaggtatacaaaggtaagagctgccacttcaagatcagaggccaaatgaaaaactttctctttagcagaacactcaagatgagcagacaaacctagtcacagccaatctctaggaagtgacgcacaattgacttaggaaaacaaagcaaaaaatgctgttctcagggctaactcagaggatttacaccaaatactgcctggggtctgttagatcaacaattaagatgaaaacaaaactttaaaacaaatggaagaagtttaaaggcacactctggcatgctcttggtattatttacaaaggagttttcctttcaatgttgtttataaggaaactccaagaagcctgattttagcatctatacaggccattatcatattaattttttgcattaaccaacactcccctcttttgaattttcacctcatcttaagttccttctctatgtattttaaaacctcttttgctgtttacatctcaacttcggatctttttcacacgccggcaggaggctgtatacatttaacatattaaggccgcagtgccgagttccctgaacagacaacatagctgtttgatcgagaatggagattttccaagtttgattttctaacaattcaccctttcccttgtacttgtgataaattccagttgtgtagtttaaatggtcattgaatagatgtgccgctctactctctacagttttaacatggttgaatgatctcaaaatgaggcaatcgtttgagcagaaacccgaagaggcctgggaggcagagctgcctgagactaatcctgagttcggcagccccaggcacttgccctcagacaggctctgagtatgtttgtagcaaagtgaccctcgggtcaccatcacctttttcattcttccttatgctcggagatagtcatctgactttgcatgtgcctaaaatcagtttagtctgatgcatttcatttcaagaaggcacaaagataggaaacctgaagccatagtattttgcttctttcctggcttagagaatgcgtcaagggaaggggccttctggtctaccaattctgcccttgttctttttttctaaaacatttcctttctcacagtgggagacagtctttgaaaacccaggtttccagacatggaagagagaaaccaagtattggaaatcatttcctactgcccagtttccccaattctcctccttcatgtttttttattcagagtcaagactgctggacttcctggtgctgttttgatctggtggaagagagagttgcaatatgactgtttgcttgttaaggagttggcagtagtcataccactcaggatgcagggtaaagagtcaagtctcttggttttatctctcaataatcataaaagtacatccattgatcccccactccattcccactggtgagagacttttgcttaagaccactgtctttcatggattggtgcaagcttcctgtggctctttctttttcttttctttctttcctttttttttttttttttttccccgacagggtctcattctatcacccagctgtagtacagtggtgcaatctcagctcagtgcaacctcctcctcccaggctcaaaagatcctctcaccccagcctcctgagtagctgggattacaggtgcacaccaccgtgcccagctatatgcccccgcaggcctcccaaagtgctaggattacaggcatgagccaccaggcttatcctcctgtggctctttccttccctctctacacccgcctctaccccattctgacaactgtagccccagtgacttttccattaagtaatgtctagccacattgcttcctactgaagactccccaaaggctcccagtcggagcacctcttccttaatgtagccctttctatctgacccctactcactgtctcatctaaactccagccacatcccgtggcttgttatttgcaaaatatgccatgtttttctcatactcagacttttatgtatggtatttcctctgctagaacccttctccacctctgttctgactcaacagagattacaactcttaggggaagctatctgtgaacctcctgccccagccaggttgcctgttcttccctctctctttccttgtgcttattccggtcatagggctttcatggtctgttgatgtttcctattagcagcctccttctgctagaacatgcacatccgaaggacaaaaaatatgttttatttacctattggctggcaaccatttaaatgtaagaggtaaaagagacgcctccacctatctgtacaaccttggctgtgtctcttaattctttatggacctctttgtatgtcttcacggttgtgtctatattagacagtgcccaccctacgttaatgccctatgatttgagattatttgagaacgtcatgaattggtccccgggctgtatttgaaaactgctgaatcacactccattgtgcaatgtcagccacaacttccaccattattaccactcaatggtggtaacaattccataaatgatgacaccatgaagaaagtaagggatggctaccgtgtgatcaactcttaacagatattttctctattacattacgtggctcactttcaggatattttcttctctattgacaacttaattctttacgactgctgtctcctccaggaagaattattgaaaagtaaagtgatgtttagaaagagataagtcaaagattgtttggatatcagctgttaactttttgcttcttacttgcaaaatagaatagaaccagcagtgttcactgcagcatttgtgggttattaataatttactcaatctattgatgcttgttaattgaagtcgctgagaaaagttagttaatgatgtgcctgcttacaccacattataattatgatggtagttcccctattattagggctgagtaggtgttcccattagaaaccttaatttctgagctgattgtcttcaccattttaaattacattgggccacatcttggcagacactttctgaaagcagatacgctcctttccaaaattatttttgtggtagcacagaagttctctccctcaaatgacagaggctgttaagtgtattctactttcaggaactgttttattaagctccaaccagcaatgtcctatgtaaacttatcccaaaagaaagatggttgctgaactagaggctaccttggcaaaaatcagatctcactgggaaagtaaatttttaaaagtcactcatagaatgggagatgggccacatttttcttgccttcacttggattcagaatggttctgattacagtcaacagaaaccaaattccaacgtatttaaactttatattttttgacagtgagatttattggctcatgaaattaggactgcaaaagatatgttgtcttcaagcagggcagggtaaaggggttaaactaatgtcactaatgtctttacttgttcgtcatccttcaactccctcctgagtgctgacttcattctggagcagatcttcttcacagggctacttgtagcctctagaccagcactccccaacctttttggcattagggactggtttcatggaagacaattttttccagggatgggaaaatggagggaatgatttcaggatgatttaagtcctttacatttattgtgcactttatttctattattattacattgtaatatataatgaaataattacacaactcaccataatgtagaatcagtgggaagcctgaccttgttttcctgcaactagacagtcccatcttggggtgatggtaggaagtgacagatcatcaggcattagattctcataagccacatgcaacctagctccttcgcatgcacagttcacaagaggatttctgctcctatgagaatgtaatgctgctgccgatctgacaggaggtggtaatgtgagctatggggaatggctgtaaatatagatgaagctttgcttgctcacctgctgcttacctcctgctgtgtggcctggtttctaacagaccatggactggtactaggccatcgcctgaggtttatggacccctgctctagagtatattgttgacagtccctgtattgaagcaaagcaaaaccttctcacacatgggttccatatataaaacaaaagaaggtgtcaattctgtttggatcacatcctcacccctgagctgattcttggagttagaaggagagtgaattttgatttccagtctataccatgcgtccatagcggtagcacaagtaggctgtgcatagctttagtaaacccacccatggaaagtattctatcagtggaaagagagatgttgctaccagaaaaactacagaagggataatggacaaaaattaaattataaatttactactccatggttgcatccagtacctaatcccaacccttggctgacccgatagccaaagaaattgccatcaattgttaatggttatcatagttcaaaactccattaaagattttatttcaactaggatctttaaaaattgtggccttatggtctggtgctaccaaagagttagctgtgcaatcttgataaagataggcagttaggttcactggatttcatttgcatcattgatagtggcttctctgtggtgtctgtcttattggaaagatgtgagtctggtatgcgcagatgtcagtgaaaaggaatttattttgctttggaaatgcagcatgggcaaaataagttgtgtcctggttatcttgactcctggaaaaatagtttagaattgttcctaatggggtccaggtacgatattttatgtctaagcatggtggaccattttccctccctagaagagacaatggaaggtgggtggcaccgagtcttgcatgaaggcacttaatcatttgcaagactcaagtggacataaaaatgcaacagagatgttttctgagaacaaacaaaatctaggcaaggagggaaccaaggagtggccattgctggtgcataaaacctatttattcttatgaaagagagtgtgttcatttgtgattctaatatatttttttgtttgtcatttggttaattatgtagaaccatggcatggtctaatattttgtacaaaacttgtctcttaatgttataatctggctggagagaaaaattaaagcagctgaatatcctcctttcctcctgttatgaatccgtctgtgtcactggtggacataatcattttttttttaaattctgcaataactcaactttgagtctggtaatgtctctatcaaatgcatacctggaggcatgggtcagaatctcctgaactttttcatgtttattgatttatttcatttgataaacatgatctgatttactctgtggccaaactataaatgcaaccttttattttagtctttccttcctgtcccaccttccaggaaaaatttggtttagggagggaggacatgtattggattgaaaggacatctgttggccgggcaaggtggctcacgtctgtaatcccagcactttgggaggctgcggcaagtgaatcacaaggtcaagagatcgagaccatcctggccaaatagtgaaaccccatctctactgaaaaaacaaaaattagccaggcatggtgatggtggtggggggaggggggcgcctataattccagctacttgggaggctgaggcaggagaatcgctggaaccctgaagtcggaggttgcattgaactctagcctggtgacagtgagacagtgtctcaaaaaaaaaaaaaataaggaaagaaagaaaggaaaggacatgtgttttattgttctgcttgttttcagttatcatgagggggaaaagtaccatgaggaagatgccctcaaacaggctatcagatgtttttgttcttgataccaggcaggaaagagatagaggtaaattgttctagttaggcattaaacctggttttaaaaaaaacccttttaaatgacgagaatggagataaagagaaaaagcattctgttgacatctgtgtggatttgattctcaatttatccatcatcattatcatagttgtttttgttactagtatttagcaacagatttgcttaaataatgggctagaacttacaggggaatattagcaggtagaaaagcactcaagattgtttttgcacatcatagttcatcatccaaaagttatttgttgagcacctatgatgtgccaagtgttgtgagactaagaaataaccaggatcatgttactgccttggaggatcttcattcagtcggaggaagacatggcagagatacttagttacaagctctagtgctgtaaaagagacaagtgaaagatacagaggaaagggaatcactcatccatctctgcctgggagattagaaaaactaccactgaagagtgtgacacacatttcatgtgaatgtgggaggaagtttgaaagatatggtcccatcacagaaggacaatagatctttcctaagatttacctgacaagaggtcatttgcttgaatctgctcagtgacaggaccttcctacaaggcagccatttttgcaggccttgagttgttagatagtcttcctcttgttaaaactatttatatttaaacttgaaggcatttagaagatactgaaaatagtgggcagttgtaagaaaatgtgattggagaggcataaaacttagtttgggaaatggctagaccctcttcctttgtgtgtgtgtgtgtgtgtgtgtgtgtgtgtgtgtgtgtgtgtgtgtgaatatttgcatgtaccacatgttgtatacatggagcatcagtgagtatgggatacatattttaccaaatgctttatgagtattatttaatgttttcaacaactgtatgaagtttgaagtttgtattgttatgaaacccacttcataggtaaggaaactaggattacagagttttataactttgcataatgagtgagagaatagggatgttaacttttctttaaataactgtatcctcagaataatattttgacttgaattaggtagattctgtacagtataaattgctattgagctggaatattttgtgtggcggagggcatcttatgtgtgtgtgtttcttcaaggtatcaatgcaaactctccaaagcctcttgtttcagaaagataaacaactgttatcagcctacagatttttgaagaggctgagtactaccacaagatttattttaaaatcaagctgaaacaaagtttttagctttttaaaaaaattaattttgagagagtgaacttcatatcatcacctttagagttccagaatagcaagtcttgagaaaggaatcgagagttggaggattggccaggtacagtggctacttgtgatcctggcactttgggaggtcgagttcagtgggtcacttaagccaggagttcaaaaccagcctgggatacatggaaaaactccatatctacataaaatgataataatagaaaatagcaaggcatggtggtatgcacttgtagtctcagctccttgggaggctaaaatgggaggattgcttgagctcgggagttgtaggttgccatgactggagattgcaccactgccctccagcttgggtaacagggtgagcacttgtctgaaaaaaaaaaaagagtagtggaataagagaaataccaatattcccaggaattgggccatggaagagctatcagccacttgccttcctcccttctcctcccaccaaaaaaaaaaaaaaatatatatatatatatatatatatatacacacacacacacacacacacacacatatatatacagacacatatataatcattcagctattctaatatttgtatatgtaaatgtgctctatataatacctatatatgtgatgaaccatatgtagtggtcataaaattggatataaattttatgtctctataactggacattaaatctcattcctataccccattaaaaactgatctatttttccaggagccaaaataactatgtaatatacagatatgttttatatatatatctacacacacactcacacatacacacacgcacacaggtatataggtatacatgtagatagagtttcaccatgttgctcagggtggtctcaaactcctgggcttaagcaatctgcccactttggccttcaaggtgctgggatcacaagtgtgaccactgtgcctggccgatccctcaactcttgattcctttctcaagacttgctactctggaagtccatatatatatatacacacacatatatatgtatacatatgtatgtgtacatgtacatgtacatatacatgtagatataggtagtgtattatacatatatagacttgcagcatatgtatatacatatctgtacatatacatgcacatatacatatgcgtgtacatatatgcacacatacatgtacatatatgtgtgcgtatagttgtacatacacatgtagatatgcatatatgtgtacatatacatgcacatatacaggtagatacacatctatgtgtgcatatacatgtacacatgcatgtagatatatatgtgtacatatgcatgtagatatacatatgtgtacatatgtatgcacatttgcatgcagatatacatatatgtgtacatatatatgtatatacatatgctggaagtctatgtataatacactacatttaatttttaatagttttagtagttctatagtattcccttctatgagtgagacatttaatggattccttattgatgcatgttaaatggcttgagttttgttgcttttctacttcaaacactgcatctgtgtatacttctatctctctgtacttgtacatgcacaattataggataatttcttatttaatggctagatcgatttacttttcatagatattgctaatatttgccctccaagaaagttttatccgtttacattcctataatatatgtgataacctgttctctttacagcaaaaagtgcctttaaaaaaacacttcccttataacaaacatacatcctctgctgtcagattgtgaaaggctgaaggaaatttacaaggagctctcctgtttttcccctattatacttgattatgctactaaatattcagccacttccatgctattgagtgtgggagaaagcaatcgtattctcattggcacaggataagggaagcaaactcacctgagcatcgtttcagccttagaattgcaggctggaaagcctctccttgtgtgtgtgcattggctggcagctgcctgccatgaatgctacccaggctctcaaaatgggaagaagaccatatgcttgattactaaatgaattcacaggacaaactatcacagaaaacatgtgtaatatgagataccatttcaatttggcaataaatgtatggtaaatggaaggttgcagcccatgtaaaatgcacttaggatctagtgttgccatggagtcaaaggaaatgttatggcagcagataggtgcaattctgccctggaatttggcactctgggattcgttgggggcctgtggaactattcagaatccagtgaacaccaaccatggggctttgcatagcttaagtccaggcacgtgaaaatatccgaatagggtctgggagctctgaatttcaaatatcattggttatttgatctaaactggattaaggtggtggaaatgacagtatctctacacgccatagccactctacatgcagtcccacgcatcacctcattttgtggtcactgcagctcttcactgggcaagtggaaacagcttcacaaaaatcagactctaggcaagaaattggatttacatgttttccctttggttttaaagaaaatgtagataaaaatctgatagtctacttcagggaggacaaatatatttcagcttctctgttcactttgacccattggtagagacttccgaggagctgtgtttgctttttcttaattaagcatttaatgttgagatgattttagatttgtagattgacaaaaagctgtaagaaataatacagaaaaattctatgtagcttttactcaggtttatccaatagtaacatcttgaaaaactacagggttggctgggcgcggtagctcaagcctgtaattccagcattttgggaggacaaggtgggcggatcacaaggtcaggagttcgagaacagcctggccaacatggtgaaaccctgtctctataaaaatacaaaaattagccgagcgtgccggtgggctcctgtaatcccagctacttaggaggctgaggcaggagaatcacttgaaactggaaggcggaggttgcagtgagctgagatcacatcactgcactctaccctggtcaacaagagtgaactctgtctcaaaagaaaaagaaaaactacagggttagggttatcacaaccagtgattgatcttactgatgtagaaagatatactggtcttatacagacattgataccacctactgatgcaatctcctgacctttttcagatttccctagttaaatttgtactcctgtgggatgtatgtttgtctgtgtgatgtgtgtgtgtttactgtgtgtatctatgtctgtgtggtgtgtgtttgtgtggtgtgtatgtgcctgtgtcctgtgaccatgtgtttgtatgatgtgtctgcatgtgtgtgttttgtggtgtgtctatggtgcgtgcacgcacgtatgtgtgtatggtgtgtctgtgtgtttgtgtggtgcatatgtgtgcatgcatctgtttggtgtgtgttgtttctgggtggtgtgtgcatgtctgtgagtagtgtgtgtgtctgcatgcatatgcgtttgtgtggtgtttgtgtctctagtgtcagcacttgtttgtatggtatgtgtgtgtgcatgtgtgtgtatggtttctgtggtgtgtctttgcacacgtgtgtgtaattatttgtattacaaacatttatcacttgtgtagtttcatgtggccaccaacacagtgaagatatacaacagttccatcaccacaaggatccctcagattccccccatttctctcacccctacccccgtccctacctgctggcaaccactaacctgttcttcacttctgaagttctatcatatcaagaatattatataaatggtatcatacaggatgtaacctttggagactggcttctttttctctgcatactgccctggagattgtttcaagttgttgcatgtgctaatagttgattgtcttagattgctgagtagtattctatggtgtcaatctaccacccaagaatcttttttcagtagacaccctgaggctgagcaggagagggtgccattgtcactgcgtcatgcctatcccagagacagggattgagaggggtggcaagcccctggtgaacctgcttggcttacatgtatgtgctgatatttgaaagagaatcagaaacgggacaggattagcatctatgtcactctagagatcagtatccaggattcagaagggtcatgagggctgtcactaaggggactagtgataggctggaaatcacgctccatgcgctaggactatagcttccatggcagaaggcaggatttgaacatgagtccccagccactttttcagtgatctctctactccgctatagcttcagtcatctcccgcttatcgtgtgtgtttgtgctggttctggagagcgcacaatttgcagaaggcagttttgtttggatctgccaagtacaaatgtggctggctagtctgttggatagcctgacaagacccagaaatttctgtctttcctccctcccatcaaataactgggctcctccaagagccaacgcatacatcccacctgtaccaacagaatgttgtagtttgcatacttggaatggaaaaataatatttggcttggctttgatcatatatactaattattgctaatataggcaccagatgattgcattttattatacctttgtttttcactaaatatcagaattccttccttgaggggggagttgtcatactacttaattgttttgtgttttcttgacatatctaagcattatctgtgcaactgtgtcagtgtgcctgttgctgtaaatattcaagggactcataacagtattagaactaatttcttaccacaacagaatattatccctttcataattttcaattgtttcaaaggaattctgaggattcttggtttccaaacttcatatgacttttgactttttttttttttaataaagtacagcaaagagttttatgactatgtgctttagaggccagatggcattgttttcttcctgtctttggcaggtttcaggcaagttgcattagtcttctggactttgactgcctagtgtgtaaaatggcaatgaaaaagtaaacgaataaaccagactttgtttcttcttctcttctgtacttttcatcttcttcctcctcccttttccttccttctttcgtaaggttgcacaaaataatgtacattaaatgtgtaacgtgcagcatgaactacattttatacatatagataaaaactgttatacatatttttttatttgtgtcattaacttgttcttgttgattcaatgaagattacctgcagttagctgaaaagtcgtaatacaaacaattattttatggctttcttttttcagtatgatttacactgtccagttatgtctttttgaggcataatcttcatcttagttttcctggggggtttttctgtaactcctgtgctacattttcaggcagtttcttaacataggtacctatgtctattcctcctcctcctccgcctcccccttttttctccctcctccgtctccccctttcttctccctcctccctcctccctcctccttcctcctcctcctcctcctccttctttttcttcgttcaatcttggaagctttccaattcaactctaacttcttcagcccgtcttttacttatgtgtagctaataccacatttatatcagcgacaaaccttcaatggttaggaaaaagaagctaaccctttattttctctttagatgtgttggtccatttgttgtcagtgttttggttcaggttgttcccagctacccagatgactacctttcatcatatttgcagagtgtatttagtgtttacatcaagaccaacctctgggattacaaaataattttataccactttctatctctgggtgattggaagtggctatctgcagcaggactatgtggatgatgatgaggtcataggcaggttcgtggagaaagagtgctatgattgattaatgatgtctgctgtgaccatgagataggggaatgcagtatgtgtaaggaatatttgctaaccgttttaaatgaatgttctttatgcttttagcattgctttaaaatggataacaaaattcatcatatatttgctaaatacacattatacctaagtgtataaataacatttatacctaagtgtgaggcacttgaaaaactcttctagtcattattgcctgtaattctttcttcactcttaggggttaggaatcatttttaattcctattttacagattcagaaagagaggtacatgtcagtgaagtcctttgctaaggctgtgtacctactaagaatcagatttaatgtttgaatctcggctaagtaatcccagggagctttctatggaggtaaggaagaggatcaggttcacaaatgcagaaataagtgagtttttctagtgagggtttctgtccttcatttgagcagcttcctttatgactcatctttctagaatcttgcaagaatacaaaccaacatttatagaggtgatttcagcacaagcactggatgtttagaagtttctagtcagtcctaaagtgagaagacagaacacgttcaattgatttccatttgcagtgcccagaatgagaaaggtgatgtttattctccctggtaaacacactcaaaggttttggggttacccaagttgagctttccaggcaatgaaccactaaaaacatatttgttcccagaacacagccagctagtaaggttttcccactggggctgacatttactgtaacaagagcctgtttccttctctcagagctgcagccagctcctcacaagggagttggtgtcttgccagagaaacccctctaagctccaagagacgtgccagggaagccagtgcttttccctttagctgaatgtgccaataatggcagaatgatgtctgctttttaaagtgacaagttaaaatattatctacaatttatctgtccactcatccatcatctacttatatttcctctctctccatatgtatatatatgtatacacacatacatgcacacatatgtatgtatatatctatttggcgaaatgaatatatttgctcatttaatatcacagtaattctataaatataatttagcaaattttatgatgctccattgtgcaggttctaaaaatgataaaagaatctagacttctgggcgcagtaactcacgcctgtaaccccagcactttgagaggttgagggggatagatcacctgaggtcaggagtttgagaccagcctggccaacatggtgaaaccctgtctctactaaaaaaaaaaaaaaaaaaacattgccaggtacgcgcctgtaatcccagctactggggaggctgaggcaggagaatggcttgaacctgggagacagaggttgcagtgagctgagattgcgccactgcactccaccctgggtaacagagtgagaccgtagctcaaaaaaaaataatccagatttcatgatttctagataaatacaaggcaaattgaaaacagctctcctcctcctcctctttctccttcttcctcatcttttgttgttaaagaattatagacttcaaagctggagaagcagtgtggggtattccctggtcctccttccaaatgcatgttgaaatgaagacatgtgggttttcttcccgttttggccatcacctgacctaatgaccttgggccagtcacctggcatctccacgatcctgttacattgcatataaatgcagacttctttgtatgatgtctaaggtcacagagcaggtattatgcccatcttgtttatctgccaagcacagtagggcacccataaataattcctaagttactgaatgcatctgcagctcaacacttttgacatttttttttctcattttaatattggccaactgagatttgaaaaggttttgacttgcctgagttaaagcagggggagtctactggccaatttcttttgactattacgttgtttgatttggacgaaggggcagggggttgtataaacgtcactgtggagagcccttgtcccctggtgatgagtaaccttatcaatccagagcaaagaggcatgtgaggagattttgctttggaaaatggcacacagttgaggaaatttcatcaatgtgtatgaagcggctggtctggtgacgttttgctttgcaagtgggtgactgacatccttcaccctctgatctgcccattctctcctttggtccttctgttcccgttagcactccctttaacatcagtctctctccctcttcttccacctagaatctcaataagctctttcatcatctcagtttctacagagcagaataagctgaggacttttttttcaagttttatttatgtgtttttctgtttttttaatttaaaaatttaatttttttagacagtcttgctctgtcacccatgctggagtgcagtggtgcaatctcatctcactgcaacctctgcctcgtgggttcaagcgaatctcccacctcagtctttcaagtagctgggactgtaggcgcatgccaccacacccagctaatttttgtattgtttttggtagagatgaagttttaccatgttggccaggctggtatcgaactcctgacctcaaatgatccatccacttcagcctcccaaagtactgggattacaggtgtgagccaccgcacacagcctgttttttctaattttaatttcagcaggtttttggagaacaggaggtgtttggttacacgaataagttctttagtggtgatttctgagattttggtgcactcttcactaaagcagtgtacactgtacccagtgtgtagtcttttctccctcaccccctcccaccctttacccagagtccccagaatccactgtatcattcttacgtctttgcgtcctcatagcttagcccccacatatgagtgagaacatatgatgtttgcttttccattcctgagttacttcacctagaataatggttttcagctccatccaggttgctgcaaatgccattattttgttcctttttatggctgaatagtattccatggtctgtatataccacattttcttgatccactcattggctaatgggcatttgggctggttccatatttttgcaattacaaatagtgctgctataaacatacgtctacaagtgtcttttttgtatagtgatttcttttcctctgggtgaatagccagtagtgggattgctggcagaaatgatatgtgtcttttgcaaaaatccaaaccagaaaagagtaaaatttatatactatgtgtgaaaagccccctctaaatcctcttgtctagagaaaaccacttttaataacgtgtaatttcttttctgtgtatacacacacacaaatacaaacacacacaatgacatttcaaaatcgtgtgcacatcacatttctattcagttttcccctacctcatggctgtatagaagtctgttgttaaggtggtattataatttaatcaaaaatccaccttctgatcaactaagttgttctcaaccttttgcttttaaaaacattgctgttgtacttctttgtagacattgtcaggtaactgcaggagaggcaataaattttaaatggataagagaatgaattgtttgcttcttgaattaatgctttgaatcatcaactggaataggatatggagttggcagcgtgtatcacagtaacctctccctgaatttggagccctataaaacaagttgtgataatttcagtcatttcagaaaagcttctgggtcataaaggagagctactattccaaattcccacctttgtctttggtagccaaggatgcaatcctgtcagtagtcatccattttcgcaggtatctgctgggtccctacttgtgttgaatatcatgtcaaaaactgagcaggaagggattagcaagacagtctctatctctgccacaggtgtgacatgcagtcgtgaggttgtgcattgctccaagatgcctaagcaagggggcagagagggtgacacaccttgctcacaagccatgcaccctggaatgggctgtgcccacccagggtgaaaaaatggacttaatggctactagaggcccagatcataactcttctgtaataataataataataataatgataataatcattattattattattattttaccatttgagatggagtttcgctcttgttccccaggctggagtgcaatggcatgatctcggctcaccgcaccctccacctcctggaatcaagccattcacctgcctcagcctcctgagtagctgggattacgggcatgcaccaccacgcccggctaattttgtatttttagtagagatgaagtttctccacgttggtcaggctggtctcaaactcccgatctcaggtgatctgcctgcctcagccttccaaagtgttgggattacaagtgagagccactgtgcctagctcctctcctggaatgattagatttaactttgttctccaattcttagacctgtgactctgaatagggtggggatgttcatcttgatttgccttctgctagaccaggaatgaagagatggatgatattactccttttgatgtttttattcttgaatagatatgttggattctctgtctcttgccccctgcaccccaccgcatgcacatacacacacacacacacacacacacacacacacatacatacatacaccccagatttcctttgaaggagtgcatagtctatttttgttgttgttgttgttgaggtggaatctcattctgttgcccaggttggagtgcagtggattgatctcagcccactgtaacttctgcctccgggattcaagtgattctcctgcttcagccttccgagtagatgggattacaggtgcatgccagcacacccagctaatttttgtattgtcagtggagatggggttttgccatgtaggccaggctggtctcgaattcctatcctcaagtgatccacccttgtcggacttcccaagtgctgggattataggcgtgaaccaccgcacccggccggagtgggtagtctttattcaagaaaattcccaaatcagcaaatagcttgtgagcttacaggtgaggttctgagggagtgggttgtaaggaaagatagaaaactatagaggagtccatgaataaatgtgattcagaggggagggggaatatgaaagagaagaacagggtgggtaggaagatcagaggttggagaagaaggaacaggatggcctcaaagaagcctagagctgaggtggccagagcatggttaaggacagcctcgtcatcggttatgggctgtgtgccttgttgttgtcatggactggccctccttcgacacccctgagcagtctggtgaggaaggggtgagtgtaaaccatctttgccccagtctgctgtcagccgatgcactaggatgactctaaccggcatgtcaaggcagacttcagcagcatccttggatgagtgcgcactgggtggatacaggacagacagccaaaggagtgctgctccaacccatgcggcatctctcccaggttgtgaaacaactcgggggtggtgcaggatccacgctggggactgcacagacacagccaccagtagccttgctctcatttgagtttttctttctttactgatgacatcagagagaaagccccagattgctgcattggtgttctttttttttttttttttttttttttttttttttttgacagtttctttctgtcgcccaggttggagtgcagtggtgtgatctcagctcgctgcaacctccgtcccctgggttcaagcgattctcctgcctcagcctcctgagtagctgagactacaggtgcctgtcatcatacgtggctaatttttgtgtttttagtagagaagggatttctccgtgttggccaggctggtctcaaactcctgaccttaagtgatctgccagcttctgcctaccaaagtgctgggattacaggtgtgagccaccacacctggctgaaaataggatttttacggatgtcactcattaaggatctctaggtgaaatcatcctggacttagagtggaccctaagtccagtggctggtgtttcaataagagaaatggagggagatttgaaaacacagagactcagaggagaaggccacgtgaagaccaaactagagctaagagtgatgcagccacaagccaaggatgccaggaccaccagaaactggaaggaacaagaaagaccctcccatgcagtctttggagggagtgcgaccccgccagtaccttgctttaggatttctggcctccagaactgacagagaatacatttcttttgtttcaagccacagtttttgataagttgttactgcagccctaggaaactaattcactagagggctgcaaactaaggcctgagagccaaatccagcctgacacctgtttttgtagattttattgacagaaacacagccttattcatttacgtattgtctatggctgctttcactctgcaagggcagagttgaataactgcgacaaaaaccatctggcctgcaaagcctaaaatatttactatctggccctctgcgaaaaaagtgtgccaaccgctcttctagggaggtgtttaatttatgtgcttgtctggggatgctgcggggtaggggatgtttgtagtgagagtctgtctttaacagcgcagaaccacacaaggtaaggattttttttaaacttacatttcaatttttatgaagcaggttttttcctccttagaggaaaaacatgaaatgttccagaatagttgacagcattagctacatttaaaagattcaaggaagcaaaatggttttccgtctgttgaatcagtcagcattaaagttcacttatcaatgatggcttttctatgagcagcagctttgtattaaaatggctaatgggaatgtggttcccctagcaagctttggtttgatctagaatttttggagagtctgagtgggttttcttcttctcagcatgaaatggaccaaggtctgttttgcagctgagacataaaggaagtgaaaccttgtctgatatgtgctagggtgcagagccaggtaggaaatgggaaagagtgtacctcaaacctcaacagccacattgtccaccaattctcattgcatgtgaattcgtgaacctcattggcgagctcaaagaggtggctataggaaacctaattataagcatcatttggctcatactggtacagaaaaccttcaattaagttgcagaaaaatggccacacacagaagaaagaagttagaagggtttttctggtattcttggtttacatctcagtggaagcaatttttatgtcttctgcatatttcactgagaagcctccaccacttctagccataacttcctttccttcctgttacaaattttcttcctagatttactcttcagtccctaaaaatatccataacacattatttattcactccataatgtacaccatccaaatacaacaattttgccaataaactgttattctaatgaataattcatgcagtcttcattctcctgacatgaacaaatatactttcaaataggaggagtgtgcctctatttttgtcttaactccatttcttaatgtcatatatatttttaaaggtttgtgatgtccttccttggatgaactccatggggaataattctgatactctaattaagagcaataaactatagcacagaaatataactagatttatagacagtgtttgttacagtgacagtgtagtttgcatgtggagggaggaagtaggcaaatcattcagtgtctcagggcaggaaaaatgtgaagttctcacctattaagaaggcaacaccaataattgtttcaaattttgacaatattcatggccatagtttcctcatatttatatgaacaggatgtgatgataatggtgacgatgaaaatcataataacatattattatgtgatgtaatgctaagaattttgagtttctatgagatactagccatttactaaaagctttgcatatatcagggtttctgaatctcagcactatgggtatattgggtcagataattacttgttatgggccaggggttgggggatccactgtgcatttgcacgatgtttaacggaatccctgacctagggtatctgctagattcagtagcacctgcctcttcaagttgtcacactgagaaatgtctatagacatggcctaatgtccccaggagggtaaaatccccttgtagaaaaacagtgatgtacatgattaattgcatcttcaacacattcctaccaggtaggtgcattatcagtcccatttaccagtgaagaaacagaaattcagagtgaatgacagaaccaaattttggtgcagggtttactactacaccaatgtcaagactattttgttgcatatgatgatacagagcattaattcatctgccttctcctcttacatgggtattttcacattttaaaaatgtataattgcagggtgcagtggctcatgcctgtaatccctgcactttggcagggccaaagcaggctgatcgcttgagtccaggagttcaagacctgccctggcaacgtggcaagaccctatctctacaaaaaaaataaaaaaaatagctgggcatggtgacacacgcctgtggtcccagctacttgggaggatcaggtaggaggatcacttgagcctggggaggcagaggttgcagtgaaccaagattgtgccaatgcactctagcctaggtgatagaggaagaccctgtctcaaaataaataaataaataaataagtatttggtgtatgcatgctgggtaattaatatatcttatgttttgcacagacagaacttcaaatttccaaaaccccttttatagaaactgtagcatgatgaccagattaatactttttaaaacaatagcaataataacagtaacaatttatcctcctgctcctcaccactgttaattgagcactctgtttttagagatggtgtcttgctctgtctttcagactggagtgcagtggagcagtcacagctcactgccgcttgaactcctgggtgcaagtgatactctcacctcagcctcctgagtagctgagactacaggcacaggtcaccacacccagctaattaaaattcttttttttttccaagatagagtcttggcgtgttgcccatattggtctcaaattcctcagctcaagtatgagtagatgggattgcaagtgcgagccaccacttctggctaatttagcactttccatgtgagaaactaaaggatttgactggatcacctgtttaattctcacatcttagaggtacccactttgggtatcttttagccctaagctgtataattcagagttgttttgttttctttgggtttggtttctgctgtatcctcacatacagtgaagtttccatacaccttggttgaatgaatgtcttcatgagcagctacagtcttagggaaaacatgtagcttattaaggtggtgacagagcttccacttaaatccaggagatcccttgcccttaaatcctctgctgtctgctctgcgcagttgagggtttcatcaaaacgtccagctctgctctcagccatctggttgggtctgtcttttatgactttatttgtatatcaggtttccttttgcaggtgatcctaaaacacacactctcccgtcttgctccagtctgctcaccctctgcctctcacctgcgatgtctccttcatttccatttgtctgaatcttatttcttgttggaggtccagctccatcccagctttcttcccaaaccctctccctatgtcttgggcactctcaaggccttacttgccaccattgccagtcggcaattggcgaggagctgcacaaatcacaggcacccagtactaactcccaggtctaaccctccatgaactatgctcttaggaaagcagcttaaagtccttgaaaccccaatttcctcatccctatgatgaggactgcagtgtcattgtacatcccaatttgctgtgagggttcagtgggaaaatgcttagctgagcacttgacacatagtattttcttgatgaattcctgccaccgctaatgtcactttatccctgttttgtatgttccctggttgctttatgtatgtgtgcttttgaactagattgcaggattatagaaagagatttctttcagtgtgaatccttaatgtgacacaaaattcagcacaaggggtaaaactgtggccaagaggccgcctcagtgtttagaatgtaattttctctctttatgttctgaaccgtggtgtctttatcaatgacatggaaggggccatttccatttacttcaccatgccagaagggccattgcaaatggatttagttatagggtaagcaatgagcttgtgttttctgaacagctaagcctcagaactgtaataactcattatcaatctgtctccatacttcatcaaagttcccaggtgctttgaattttggcttggccattgtctttttttagctataaaattttgcttatcgcatagtttaaagtgggatgatgactgagacacatctctgcttatgagtaccacttaagagaggatatatcctcaggtagaacaatttccagagaggagatgtgggcacggggtctgtgcctgccctggaagctgtgtagtatagtaggaagaatcctacattcacagagaggctgatttttgcttccagttttgtcacaattcacatgatattgggcaatttagaaaaaaatattgatttgctttaacgttctcatctgtaaaatgaaacatcccaattagataagttataaatgacctttcatttttagaattctgcatcctggaattaaagtgcattggaatgagccaataattccatattttcttatattacctaaaatccacatactcttcaataaatttaccaccatagggttttcaaaccccatcaaaaaaaccacttctttcatgtaaatgcccagcagtttatctctttttactcctcagtaccctacacatcttcctaataaagtatataataaaagtaaatcttcccactagtgtgtttatagtgtgaaacacattgttattcccaccatggcagtggtggataaaatatacatatttctctgtctcccacaaccaccctttgatccccagccttttatcagcaaatccaaagtgctaccttctgcaaattagcactacctcctgagaaattgtgccaagttccattaaatgtaattagcattcctgttgtttccttcatattggagaaaaaaaaaagaaaactctctcttacttactgggaacacacatcatgccaagttgtagcaacagaggcagcacaaggctgaaagcaggaggcagagggggatcttgacacacaatgatgagttcacctacatgggggctcaggtggcagacacagaggtgtcagtcttggcttttaaaagtaaaagttggcttcccaatgtagagttaaacagatggcagagtgccttctgaagtgagggtttagagaacatggggagatggttatctgcctcaatttgaaactgacctgccatgagattcccaaggaagagacttgaatatcctagagcagttaactacaaaactaaaatttgccccctcagtatggttttcgtgtaaaagaattgcaaaacaaagaaaaactaccacgtgtgtattttccctagaatttcctggtagaaataagatattagtacccaacaagtagaaaagaatatgagttcagaagaaagactagggtttagtatcagacatactttttgattattcatatttcataaaatcttattttcttgacttataacaaaaatcatacaactgttttattattaacgtaaaattaaagaaaaacatcactacttttctcctcccccttttatttcaaattacgccactgactacgaaaacctggtcaaatccaacgtgcatttagaaaccataatttgaagaaactaatagctggagctcagtgccaccatccacaacagatgtccttccaaactccattcactgtcatgctataaaacagaattcagaaacaacagggtatacgtatatatctgtgcattcagtgactctgaaagggaggcactggtttcgaatgttttgtgtgaacacgagttccatttgacacttttttttttctctcagaagtcattttgtctcattccttgcttacttcattgtatttcagcatttgtcatctcaattacagtagtgcatactacttttacacttcaactgcaatattcagaaacaccagggaaagagcagtaaagatattaggaggtggtaattaagactgagaatggctccagaagggtggaaacacatttaggatgttttttattttaatcatctgtaaagaaactaattccataggcccatctacagttaagttccacttgcagcacaaagcatcataaattgaatagtaatattctttatcccaatgtcatacaactgttgtcctataatactgtgacgttgaatcataagacacacgttaaataacctattatgctcagtggtttctctgacagttgaggatgagaccaaaacgtatcccaccctgggtgacgcagagaaacgaaatgaaagacaaaccatttggtcttccaagaaagagttcagtcaatcacagtgaactggttggagtatattcattaaacaaatatttattgagcatctgctttgtgttaaatgctgaatggtgatttaagctctagatttgcctttcctggacaggttgtagaaataaatccacacaatgtgtgatctgcatctggattatttaatttagcagaaagtttatccatgataaacttttttttttcgtgaacatgaggatgaacatgaggttcatccatgtggatgcatgtatcactactttgtttctttattattgagtaatattccatggtatggatggaccacattttgtttatccatttacccatttattgatggatacgtggattgtttccagattttaactattatgtagaatgttactatgaacacttgtttccaagttcttgggtggatatatgctttcacctttcttgggtagatatttaggagtggaattgctgggttgtatggtaagtttaagtttgagcttaagaaaccactaaactggctgggcgcagtggctcacacctgcaatcccagccctttgggaggcagaggcaggccaatcacttgaggtcaggagtttgagattaacctggtgtaggtggtgaaaccccatctctactaaaaatacaaaattagccaggcgtggtggtgggtacctgtaatcccagctactcgggagtctgaggcaggagaatcacttgaacgcgagaggcggagattgcagtgagccaagattgcgccattgcactccagactgggagacaaagcgagactcagtctcaaaacaaacagacaaacaaaacaaacaaaccattaaagtatttttccaaagcggttgcgttattcaatatccccaccagcaacatacaagcatccaggttgtgccacatccttgacaactatttgtattacttatctatctttcaaattactgccattctagtgggtatgtggtgatatctcatcatcatggctttaatttgcattttcctgatgtctaatgatgttgagcatcttttcaggtgcatgatctttatgtttgtttattttttatttttaattctggggtacatgtgcaggatgtgcacgtttgttacataggtaaatgtatgtcttggtggtttgctgcacctatcaacccatcacctcggtattaagcccagcatgcattagctctttttcctaatactcttcctcctatccaccccagcccccaataggccccagtgtgtgttgttcctctccctgtgcccatgtattttcatttttcagctcccacttataagtgagaacaaagtgcatgatctttcaatgaaataaccttcttcgcctgtgaaatgggtctcagtgaatcttgaggaatcttacattactacctataatttcctttcccttataagtcagcaaaggcatgggcaggggcctgaagtgggagaaagagctcctccccctttaacgtggattcagaaatgtgtgacagggagctgagactttcgctgcctggtcatactcattgagcctatgggctggttgtgtgaacatgccacaggtaggcacatagggctcataggcaaaggatcccatttgtgcataaggcacactttgaaaggtagggtttggatccattatctcaccccaacagctgtgtgcctccagtgtgcagcttgaaagccacgtgttaccctgtcagttcaagcttcccgaggttacctcttccagccacgcagtagttggtattatttctttcatttttttgataaaatgtcttcctctctccttctcagagtaaagcaagtctctgcacatgtttctcagctgggttgcagtaatctaggaaaaggtcactctttagaggagttgaaaggactccaggttcttatattagccctctgagcatataaaggcccaaagaaacagacaccaattcctctgctgcacagacttttaaacctggaaagctgtaaatgcagaaacttaagtatctgggaggtgcgtgcttagcagccatccgatgtgagtgtcagttcattttgacatgtaaccaagatggacctcagccaatagcagtctccactcacagaccgctggtgtggttaggagcatgtacttttaatcaaattttttttattggaatcccggtgctacatgctaggtgtgtgattttggacaggctccttaactgtgttagctttggttaatgaaactgtaaaatgagattaataataattcttggttcttaaaatcatggataggattacatgagataatgcatgtaagtgcttagcaccattttgcatttctttagcttttatcgtttttatgttatatttgattttacatctttggcactgggaagaatgcctggcatatagagtgtactttgtgactataatttgaccacacacagttaagatattcatttatataatagatatgtacgaggtatctattatgtgtacgaggtatctattatgtcagtaaactatacctctcgggaaaaatccagctctcctcttgtttttgtaaatacagttatagtggaacacagccacaccccttcatttgcatatcgattatggctgtgtttgtgctacaacgacacagatgattagtgacagaaactatatgggtggcaaagcctgaaatatttaatgtttgcccctttactggaaaaggtttccgatccttgttctaggtattgagaatgaaacaatgaacacaataaggtgatattcctacttttattatagtcaaggtaagacagacacgacacatataaataaatatgtacttacctatacacatatgcacaaaacatctgtggtaataaatgtaaagaaaaaaatacagaaatgtaagacagagagaaagcaggaatggggggagaggaaaattttttagatatttcccatttaaatgcctctaatctcagaatagaattttatagtatcgctttagtaattcatttacaaggtagttttcaatagaaaaataaaaactcactaccccatgaagtctcattgagcacaaaattcaggaaccaccccaggttgcaaataaattcagacattgcctgtcataaaaagctggttcggagacaactccatttagtattgtagaactgtgcaaagaacacgacactttgctgactggcatgcatttttgtccaggagtagttttccccacatggagaatagcgacaatacaaccgcttccaatcaaaggggaaatttgtgctccttatctagcttgattgtccatggataagaccaagttcaaaagtgtcagttctacaagcaaacaaacaaaaagccctgaaggcctcaagagctgaggatgcaaggaacaagtagagtttccaacacagaggaatgataaatgctggaggtgatgggtagtgtaaataccctgacttgatccttaaacattctatgcatgtaacaaaataccacaagcacactgtaaatgggtacagatagtatgtatcaataaaaaaaaaaaagaatacaaaaagaagtagatcagggatgctttatatggttttctaccttgtgtcttattttcaggtgtgttttcacaggcactacctttgtagaacaggttgcttgctgtgacagctcctatctgagcaaattgcattattaactagattgaaccaggaggtagggcacttccacaaaattctaggacaggggtcagcaaatctcttctgtgaggagccaggtcataaatattttagattttgcaggtcttttggtctccgctgcaactcctcaactcttctgttgtagcacaaaagcccctgtggacaatgcataaatgaatgagcatggctgtattccgataaaactttagttacaaaagcagacaggatttggcctgtgggttgtggtttaccagcttctgttctagtgtagtttttccttttgtaggtgtgctcagaagatcaactggagagcagacacaacatgctcacgctctggttcctttcttctgacctattgattcagaatctctgagagtaaaggccagccatgtacacttgtactgttgtacagatgcagaaagtcagtatgtgtcaggatatgctgctgttacaaataacccccaggatgtcagtgacagcagcagcagcaacaacaacaacaaacaaaaaacatgtttattccttgctcatgcaaagcccaccatgggcatctctagggaaactttcctccacacagtgacctagtgattcaatttgtcagaggcactatcagcctgtcgctttagtttctgcaacacacagccttcttgattgacgtcactgagaaaaaccaagaggagaaggtcttccaatggtaattaaatgactgggtcactaacaatttgggcatagctacttgcaaggacatggcaaacacaatcttcccaagttcgcaggaggagagagaaattggatatgggtaaacactaaattttttttattcgttcataaattgattcaattgatgtatcgattgactgataatcattactaaacaatgtgatgtgtgcatggcaaagaacctatctgcatggtatttatgggtatatttctgtttccatcaccagaatttaaccagttatctacataagtgaaatctgaaaggaaactactctttagacctggggtcaggcaccttttactttattatactcttctacttgatggtaaaagtcattatcagttttgttaatcacatgccggacctcagatgtattgctgtcctaaaaagtcaagcacattatactgaccaaatgtgctttgatcacaggtgagacatcgggtttcacacctgttattctgcaagttatgtataaggaacatacttcatacttctttacttcctgtactgatccagtttggttggttttactgatttggttaacaagatcgtaaataatagtgaagtctctctctgtttatggttaacactgctggcccattataattttcggtggcagtgcatatggcgggtgataaactaataaagctgcagtaggaagaatagttctgcttttatttttatggctatttctttaatctgatgcataattaatgtacaaagttcaacttcgttttggtcagatcccagattactcgaggcatccggaggggttaatattttttggtgcatttgggggtaggaggttgggataaaacaacaaatttttatctatatggaaggatgcttaaccgggattttttttttttttccaaaaagaaaatacttaagttatccttgctttcagagttcatgtccattggaagtgtcaagagattctgtgttcaaacattctcaaagcaccgctttccccttaccccttacctaagagaacataattctaaaaatccctttggggaataattttctctgccttccatctctctcaatgatgtgtccaatctccacaatttgtctggcctcctcttgaactgatttacggttcaccaaaatctgtgagaggatttgccaggctgcagaccaattaattatgtttgctgttagacctgttaggtgttggcatttccattttgtcagacattttaaatttaacgtggacacatggtttccttttttttttatatattaaattaggaagctgaccacatagggggagattccaacagcaacacaatgaatttatttgagatgcattgtccttcatttgtatatagaactctttaaaaagaaattcaccatcttcccagatttttttttctttttgtttgagatggagtcttgctctgtcactcagtctggaatgcagtggcatgatctcggctcactgcaacctactcctcccaggttcaagcgattctcctgcctcagcctcctgaatagctgggataacagacatctgccaccacgtccagctaatttttgtatttttttttttttagtagagatggggtttcgccatgtttgccaggcagatctagaactcctgacctcaagtgatctgcccgccttagacccccaaagtgctggaaatataggcttgagccactgagtccagaccttcctagatattttgaacagagcctgcttttctcagagaaaatatttcttcttttgtccacagcagccctgatatccatggtgaatagtgtgttagccattttctgccttgcagaactattattataatataataatatccaaagaacagtagcaatttttatatagcatttactgtatttcagataatttttaaatgcgttttacatatattaactctttatgtccttatgtaatgctctagggagggtgctataattattcccatttttcagatagaaaactgaggctaagagaagttcagttacagataccacacacaagaaagggacagcatctctggaagtctgactcctaatcatgggtcactcttgtcatcagatgccgggcaaggtgaagccctacattctacagacgtgttttcagaaagtctacaccacgtttatgcactagtattcatttatctggtagggtcctttgattttattgggtagtgctttatgggctgataaatgaggtgacattaaggatagtaacactgttttcttcccttttctgtaaaaggtgagatggttgcctatggtgttagaaaggattgcaaaagatttacttggggaaaattagcttcctctgcactcccctgctccatttctactgtaagttattatgatgaaaaaaaaaaaaaaacctgccagaacattggcttcaaggtgaaaatatttaggcaaaatattaccacagggaaagtttattttaagcatcaaggttaaaaagacacatgtgtcagatttaggattttatgcttaaagctcatgacattgccacaaagtatttggttggcaaacttttcctgcagagggtcagataataaatattgtagggtggtggaccatacggtctgtgtcacaactactcagctttgcagttgtagagaaaaagcagtcataggcaatgcaaaagcaatggaatgttgcggcattgcagtaaatgtttttaaccacagtcagcgaggctgatttggtccacaggccatggcttactgaccccctgctatcaaggaatgaccagggatttggagataggctttcaatccttccttgtcatgtgccaggtggacggccttgtggttcaaagacttctttgaaccttgcgtagtcacaatctctctagatgttaaatagggaaactgctatgccccgatgagcatggtcatgagaactgaaggagtaccagaactgaatgaatgaagtactggattcagtaaaagaaattccatgtcatccttctctgccctctccaaacccctttggttctacttttccctaccttgtaatatttttgttaacaagtggtaagagttaattaggggtccctgagatttttagggtgcttttacattttggtaaggctagtagtagaaaagtactacctaaaagagaattaactaaattccttccttccttcttccctccctccctcttccctcccttgctctctctctctttctctcatctctctttctctcttcctctctttctcgcttgcttgcttgctctgttgcccaggctggagtgcagtggtgcgatcttggctcactgcaacctctgcctcccaggtccaagcgattcgtgtgcctcagcctcccgagtagctgggactacaggtatgcacgatgcctggctaggtttttgtatttttggtagagacacagtcttgccatgttacccaggctggtctcagactcctgagctcaagcgatctgcccatctcagcctcccaaagtgctaggattaaaggtgtgagacaccatacccgggccccagaggagagctttctgagtcaccatatgtgaagtggttcttacgtaatttctacggaaaaaaaactcagccgtcgaaatacaggaaggaaaagggttaatttctttgtaacagagatagtgaataacaagcataccactgattccaccaatctaatatacatgacacaaatcactgaaagataataatcttcactgataaactgaatgagtcttcagaagcttgttcatgacagttctttagtcattgtcagtgattcgtagttgtctcataaaatgaaacctattaggtatctttgacctagttaccttttagggtcagagactttggagattttttcagattataagctacatgaagttgttacagggttgctagtttaccttcgctttgtaaacagtgatgctcctctatagggatgtgaggttgaattccgagagtcacctgcccccctgcaaaaaaaaagaccaaaaagtaaaaagcatcttccattcttcctgaagccccctctcttcatgaaatgtcctcacattgaagcctgatgaattcgttcatgttcttggctcgaaagttcttagcagcagcagcagctgaatttctgttgtctgttcttgttttccttgtttttaccattttctagatattttatggtgaactgttgttatagaaatatggaaacaagggatagtcctaatacatcctgttgcaaagaacagaaacccagtttagactcagttaagcaaaaagggaaaatttagctttaaaatattccatagattccagaggattccagaggaggaagagcggcaggaagtacgatgaagcaaagaccaggaaagggatcagcaccctggacagcatctctttcatttctctttggaaatggagcccatcagatttgcctcacccctgacttagcactttgtactaaatcccttagaaatgccttcccttaatctccacattcctgagttttttatggcaattgcattttagctcaacttctatgtcttccaaagatcttccctgttcacaacaattacatgccctggtcataaattatcttattttctttgttgcttgtttatcatatgcaccttcccacactggaatctaagcttcctgagagctaagccttatttagaacaatgcctgacacataatgggcacacaacaatatttttgcttaaacacatgtataagtaagcgaatgatcccctaactgccaatttcctaggagagagaattgaattgccccagctgggatcagtattcaaccctctttttattagttgaggcagagtgggttgagtcagatagaacagccacttctcctggctgcctgtgtctgaagggaggtgtacttgatttggggagaaaaagaagccatggtgaatcacgaaaacatattccccaatgacaagtgtatcgtgcttgtcaatttacagagggtagtgagggtaggggttgatctcaaatttgacagaagaaacagaggtaatttttttctacctgaaaatctttaccagcacttgaggccagtgggcaccatgaaagtatcctgaacgaaagtgttttatttctctattgttattaaatagtgaaaccttcgttgggttcatccaaattttagctataagagatgctttatctattttttctttactttgtcaatagttctgaataaatgtgtgtgcttaagtgtgcttgcacatgtgtgtattttttttccaggctttcagaagcctgcattaataatctcttagggtcccgaagcaggaacatgtatgagaatacagaaccagatgatatcttcaggcagaaatttaggaagagttgactcacactgaacacaagctagttcttaggcttactgtcagaacaaaattgataaagcttaggaggacatttcatctcctttcagtgtggttcagcaaggagctatttaatgcctcctattgtcaggtgtggttttaggtaccattcgtatcaggtctctgccctcatggaaccaccattctaattgagggagtagtttaaaggggatagatgggaattaataaaccaataaagagaggctaaaatttcagactgcaatgatgacgtcattaaagaactgaaataggatgatgtgaactgaaatgatgaggggcgatgcagatggctggaggtggcctaaagcccaggaaagtggtggtggagaagaaggcaggattggtgagaagagcctggcagcacaaagatgtgtgtaaaatcactgacaggaaagggctttgtgtatttgaagatcataaaaagagtagcacagggctggaattagctccgtgaacaagtggagagaaggaagtggagaggcagatcaaggaggacttctttgcttatagcaagggggttgaattttagttttaggacaataggaagctgtggaatgaccttagagggaagacatcatccaaatgacagtgtactctgttccttagctgaagagagaaaaaaacagatgcaagtgcaagaggttttagtagaagtctaggggatacatgatggtggttatagcatatccacaaacacctcatgacccagggtgtctgttcatctgcattgcatgcatgtttttacctcctctgacatagttatttgcagccctgtctcatggtcaaaagttagccaagtgattgaagtatgacatattggctgtgcctttgtgacaatccttagtcttgtctgtttagcaaacagtatggcaagttggaattctagagcagtcacagtataccatgcttgatcacatgggtatacctaaacagttacaaacccccaaacctgattatgagctcttgtgaaacttctctaaaaatttggggcaatgtggagttacaggtagaacttgagcttttcaagtcagaaaccttagttctgaatgtttgtgcctctatgtatcaactcagaactttagaggagatccttgccctttaggtgtgtttgtgtgttgaagtgttactaacactattaataatgtttacacatgggtaatattaaccataataatgcttacttggtgcccaaagtacgtttgatactttacatatgttacctctctcaagcattacagtaaacatacaatatgcataggatagccccactttgccaataaggaaattgatccttagattaaataacatacttgaaattgtgcagtaagtacatggaggaatgtccatacaatatatctatttaaaccacctaacagtggggtattatggaagagcatatgggagcactttgcaaagtgtcaaccgcagaataagtgcttgataaatttcacattatacctctctctctctctctgcagatttcagtcacttatgaccacagaattaattctaaagaaagcaaattgaaggaggtgtttgcacgtatttttttttccctaatgattctactgtaccctggagcattttcacggtttgtgtttaatcacagaatctcagccatgatgtttctgacaggcaatttccttaatgcatttgacagagatggattacatggagggccattggacgccatggttttgtctgcaaatggtaagactagattagagctatctgggtctagtgcctccagtgatattgcatcctaataattcttatgataacatggatcacctttgtggacacacacattcttggccagatgggatacagtggttttcaagaaaccctgccacttttattacactttgagaaacatctggactaatatttgtgtgtcagaatcataaatcaatttagtttgcggagataggcctagttatgcggtttatcttcaaaggcactcttttttgctaccactgaaagtggtaaatgaggcacataaatgtcgagatattgaattccttctgaaactgtaaagtctttacactggcatatgaagatctgagcatcagtcagactctcaggtacttgatgaacaagagtgatttggattccatggcattttatccctagataacaacaaacccaacccattcttgagcaatgatacaattcccactggtgactcacttcctgaccctttctccccgtcctctgaagtatgtctcagccattagttcctatgtttattggcgcactttagtatagatcaaaggcacacagacaggttcagcgatatttgctaaccctgggaaacatgaatgctactattttgaaggatattctttatttgtcactggtatttaattgcacagatatgtacaaccattgtaaaggagattcctagatatcatgatacttatctctaatgacataaatatgtatataaatatacataaatataaatgtgtatataaatatttatataaacataaacatatttatataaacataaacatatttatataaacataaacataaacatatttatataaatataaacataaacatatttatataaatataaacataaacatatttatataaatataaacataaacatatttatataaatataaacataaacatatttatataaatataaacataaacatatttatataaatataaacataaacatatttatataaatataaacataaacatatttatataaatataagcataaacatatttatataaatataagcataaacatatttatataaatataagcataaacatatttatataaatataagcttaaacatatttatataaatataagcttaaacatatttatataaatataagcataaacatatttatataaatataatatttatatacacatttatatttatgtatatttatatacatacttacgtctttaaatataagtttcatggtatctaggaatctttgtgtccttagagattctatatgaagcaatgacattattataactaacagcattaacttaaatctatcctgccatcaagtatccagtctgtattaaaatgtattcagtgttttgaacaatattctttatgacttatttttaaaatatagctctctaggccaggcacagtggctcacacttgtaatttcagcactttgggaaactgaggcaggcaaattgcttgagactgggagtttgagaccagcctgggcaacatgaggaaaccccacctccacaaaaaaaaaaaaaaaaaaaaaaaattcagaaattagctggacatggtgatgtggtcccagctacttgggaggttgaggtaggaggaccactttagcctcatgaggtcagggctgcagtgagccatgatggtgccactgcactccagcttgggcgatggagtgatactctgtctcaaaaaataaataaaaaaataaataaaatgtagctctctagtcattttgaagtactgaaatcatatgtaagaagagtaggaacaagtagcataacacaggatataaataattaaagtaattttttcttaaagtgcatctgtccttccttaatccttctgagagattatcgatcacttaaaaaattgtgtgaagtcttacaaagaagtatatacataatatgatactataagaaagcccttggccaggcacggtggctcacgcctgtaatcccagcactttgagaggccaaggcgggctaatcacgagatcaggagatcgagaccatcctggctaacacagtgaaaccccatctctactaaaaatacaaaaaattagccaggcgtggtggcgggcgcctgtagtcccacctactcgggaggttgaggcaggagaatggtgtgaacccgggaggcagagcttgcagtgagccgagatcgtgccactgcagtccagcctgggcaacagaatgagactctgtctcacaaaaaaaaaaaaaaaaaaaaaaaaaaaaaaaaaaaggaaaagaaaagaagcgcttttaaaatcttagaaacaaaaatcgctctctgtaaaataatattcatcagcatttttcttaatggtgagaaattagaaacaacctaaatttctgacatagaaaattgcctaatttatggcggtcatattggaaaatgttcaccatgtattgtcaagtgaacaaagtggtttccatgaccgcatgggtcaaatcacagcactttaagaatcaactcacagagagaacaaatctcgagaatgtatctgactgtgtgctagccatagttatctctagatagtgagattataggccatttttatttcattttaacttttctctgtttctcacattttttgcatgcaatgtggaatatttggtaattgtgtttaacaattttggaagatcagccaactcagcaagaggtgtattatctaactggaaagaaaaccagaggtataaatacgatggaatgaaacactccctgagcctgtgtgcattctgcataggcttcttgaaatagtccatggctgcagagatggaaaagttaacataagtgctttaagttaaaatgaagaaactgttgtacatcttcctatatttcctttggctatctaagtcctgcattagaatgttctgatattttctgaatggggttttatgaaaaacctagagttaaaatttgcattgcagttagtttcaaaatgctatttagaggaagcttttagctgcatgttacagaggtctaatatggaccctaactgaagttatgcagaaaggaaatgttttgctgtgtgtgtgggtgtctgcaccttttctccccatcacccacctcgttccctgaatgctattttatactctaagcaattaagagtggtttatgctgcagacttttccaataagcattgactcattataccagtccagtatcattatcctgagttgaacatgtcctgcagcaggtttcatttattctgctgcagtcttcatttctaccatatatttggagattcagatacagatttgccttgtaattgtcaaaagtaagaccgcaagagctggtatagggcatgctacgaaggaaccaaagaatgacattgagttggctgttaaaaatgcaaattttggagttggaaaggacatcaagaaaaaggtttaaggaacagaggatacagacagctaaggattggggaaagttctttgacaccatgaagactataattgcagcctgggtagcttgataaaccactcaaggaagggttggttcaagaacatcaggctagaggcaagtcaagaccttaaggcatttggaggtgatacggagtgatttctcgaaaaggaattctcaatggatagaatcctcataggaagacctacactgattcaggtaataaggagtgatttctagaaaggaatcctcagggctgggcacggtggctcatgcctgtaatcccagcactttgggaggccgacgtaggtagatcatgaggtcaggcgatcgagaccatcctggctaacacagtgaaaccccatctctactaaaaatacaaaaaaattagccgggcgtggtggcgggcgcctgaagtcacagctactcaggaggctgaggcaggagaatggtgtgaacccgggaggtggagcttgcagtgagctgagatcgcgccactgcactccagcctgggcgacagagcgagactccctctcaaaaaaaaaaaaaaaaaaaaaaaggaatcctcaatggatagaatcctcatagggagacccacactgattcaggtattctctccagtttagaatacattgcccccactccaaaacactatgtcccccaaaacacacacacacacacacacacacacacacacatacacacacaaaatagagcacataagccactctatgcagcataattatctgtatctcattttcccttcatttgtaaactagcctaccactgggaaaaaggtaccataggttataaattactgatggggtctaggtcagcagttcccgtggttcccacagacacctgcaggcaatcccttctataactttccctatgcatccagcaagtaagttttctttctttcctccagctttctggaagaatctgttcaccattgtacatcttgatcgcctttatgtctgcaataggcccaactcacatccataagaaaaacagatcattctcctaattgaaatagaagagcttgggcaagacatcaattagtgatgcaaatgtagagttcttcattgagcaatgacaaaatcccaagacttattagaagaccaataagaaatggaaaaccatgatttactggcagggctagcacagttaaatttaaaataaaaatcttggccgggcacagtggctcactcctgtaatcccagaactttgggaggccaaggcgggcagattgttctaggtcaggagttcgagaccagccttgccaacatggtgaaaccccgtctctactaaaaatacagaaattacccaggcatggtggcacacctgtaatcccagcgactcgggaggctgaggcaggagaatcacttgaacgcaggaggcggaggttgcagtgagctgagatcacaccaccgtactccagcctgggtgacagagactccgcctcaaacataaataaaataaaaataatataaaataaaaaataaaacttccctcattgtttttgttgtcagcctttacaagcattgatgcttccaactcttccacaaattcccaacaggtatttttacatatcatccaggcattttttttttctttcctgagtgatactctgatctctatctgatgagctggagagtgacctaagttagaagggaaagtagaggaggttgctaagagggtaggtgtagtactgaggtatagagggttggtagagtggtattgctactcagaaaccagtaccacatgaaatcagaaattcagctccccagaaatcagtgccattccatcaacaaacagatccactgtgttctcctggccttgcatggttctaggtttgtagagcaagtttttaattcgggtttatggcattgctcatattcgccatttcagtcatttttggtaacagttacgttgagcttatctgcatagacgcacatgatgaacaaggattgactattcttcagaggatgttaactgtttagagaatcatgaaggaagcatattttacaaagaccttttttttttcctggacttctccctaatcatctcaatcagaaccttgaaaaaggggcccaggaatgcgaagtgtatgcctgtctcccacccccacatagtgtctagatgatcaatcctattcggggaccccttggatgtgagtgtgatatcattagaacataatgaaactgtgattcctaacccagaggaaaatccatcttaattcttcaccatcatactttatagttagtgctctcttccaaaggaaacccctttcaacccctctcattttttaatatggaactttgtcttaataatggatttcttcagtctttaatatttgatgggagaagtaattccagtcatggcacatcagaaagttgctttttttcctctttctaataagacgtataatccgttgctgacaaaaaaagaaaaaaaaaaaaacagcacattgctacaatatttcctggatgctttacaatacactgtgacaaatggcgcctcatgttgtacaattgtcctcatggcttgtaacacatcatttaatgaattgatcacagtggaatgtaaagatgaagcagcatttattttgtatgttatattgcatataatttttagagttgacatttataaccatggaagctgttattttacatatcatcttcaaaccatatcagccttaaacacatttaaatttaataagcaagtagattagatttgcttttaagctaggcatatcattacagtgcgtgtttccgtcagaagggcatgctcacgattaaatactgtcttcagttgttttaaagaaacaaaaattttaaagaagggggttagagcgaaagctgaaataattgagtatgaagccctaagaattctctgtggtggacaactgtaagcatagccttctaaccattgaggcgaaagagtccgtttggttttattaaccatcaccaggcaactttgaggcagaatgtaagccttgggaatgaaatgcaaattctataataggaacatcattgtgataataatttattaaatttcctgagccgtctccctctaaggagggctgcacaaacggccctggtgattaatgttcaacatcgtttaacattttattagagggaaacagtttttaatctattgatgccctgtctgtagaattctacgagctgttttcaaaaccagagaaagggggataaaaaaagaagcaaaaaataattggtgggggaagggggtaggtagtagaaggaattcgcaatagcggttctagttctgatgccagatttctcagaatctcctgtgttttactggcattttattgttttagcctcttggtagcctgttgatgttttgtgcaaggagagagagtttccttgtgaatctgacgttagggaaaatgtcatattcagtggagaggttccatctaagagagttggggtgagaaattggctgaactgggtgcttctctgaatcctagtagtgtttgcttaggagctttagactcaaatgcctatagaggccagaagggtcccttcaatggagattataatacgtggaatgtagtaaagtacttagcaagcactcttcactttgaataaatattgaggtactgaagcatcaactgtgagaagaccaaagacaaataacagcaaaatactatgtgaaatcatagaggagatccagacacacgaaaagggggccaaatggaaaaactaatgcaatagacagtttagatcatagtattgtttcgacgtcaatttcctggtacccatcattgtattatgattaagtatgatgttaaacattaggagtgactgggtgagagacccaggagtgctctatattatttttgcaatctttctgtgagtctaaaagcatttcaaaataaatacaacatttttaaaaagtaaaattggaacatacaaaacacactaatacggaagatgaagtccgaggatcatgtgcttacaacattgttacttcgccagtctcacaccctcttctgagaacaatgtaaaaagcagagagaaagatctcttcccctcctctttgtgtcgacagacatctttgggttggacaaggtggtaggcaaaataatgcccttgccttacctatggccatgtcttaatctctggaacctgtgagcatgttgggttacactgcaaaggaaaattaagattacatgtagagttaggcttgctaatcggttggccttgagataggcgcattatcctggattatctggatggatccaataggattacatagggttgttataagtgaagagggaggcagaagagagagagtatcagagcagctcttcctgaaaagaactcaacacattattgctgtctgtaagatggaaggaagccatgagccaaaagcagcaggctgccgctagagtctagaaaaggcaagaactcagattcttccctagaacctccagaaaagaacatgccccacaaactccttaattgtagctggatgagacctgcatcagatttctgaactacagaactataagatgggttgtttgtgttgtttaaagccatcatgtttgaggtctttgttacagcagcagtatcaagctaatacaggcaagtaatcaatataactgcaaatgcttttatggtccttacacgtgccagatgctcttatgagcattttacatgcattaccgtccttgatccaatgaggcaggtactacattgtgtattctgctttataactgaggatactgcaacagtgtgatgttaacttgctcgctgtcacagagctggtatgtgacaaagcagatgcttagtcagaaatacagagcccatgctctgcaccagcaaccatggtagacagctcagaatattagtactagactctagcacaacaggtcctagaagatattatggtaatgtatttacgtaactcaaaatgatcagacatgtcacaagaatgaaagaatgacagactaaaatcttcttggagagttgactggaaggataagatattctagtagcagttgaaaatatagtagcatctatctctagctatcttttttttttttaaggattggctaaaaatagtctttcccaagtataagccgtatcatattattatggatttagacgggtatacatgatgctattaaataacattgaatcaattattgggagaaggagttattctctttccatttctctttccattaccctattcgtgtcaatgagaaagtctttatttggtactagagtgtcttaaacatctctctaatactttgtgatctctgtttttagtaataaaatggaagcctccggctcagtgtctacaggtaatggttgttagattttaataacttgtgattgcactgtatttattttatggctaccttttattcagaataagtgatattgttattttatcatttacattactgatatccagttgccttttaaaaataatgcatttcaatttaaacaaagcacatcaatgtaaaaagatactaagcagctgacaatttatgattatggtacaggatgaccgtctagtgactttggcagtggaacggctagagtttgggaaaatctagctctttggggctaaagatttcaaaatgtacatttaaattaccaaacagatactcattactaaaactcaatgcctgaaaccatctttgaatccattctgttttctacccctttcccagaaacacttcgttttattacatttagaaagtggtgaatttagcccaggcacagtggctcatgtctgtaatcccagcaattttagaggttgaggtgggtggattgcctgagccctggagtgcaagaccagcctggggaatatagtcaaacctcatctctacaaaaactacaaaaattagctggacgtggtggtgcatgcctgtggttctcgccactagggaggctgaggtgggaggattgcttaagcctgggaggcagaggttgctgtgagccgagattgtgccactgcactccagcttgggctacaaaatgagaccctgtttcacaaaaaaaaaaaaaaagtgaagaattcaaagacagctgaataacacctttcaatattttatcgaggttaataaaattgattggttcttaattagttgtttattgttcttctaattctagcaacaaaactttaaaaaattatactctctgaattttaataaagagctcttcagtctatcaacacccttaagtctgtcaacttcaccatgttttgtgcctcatattgcatttcttgttggaccagccatattaggagttggggtggactctgttcatggactgagtttcccagaatagccttatatttggtgataatgtctctggctgagcctcattctcttaaattaatttcatcacacaggcttgcaaaataaggcttcttgtgaaagtcttggttgcagtgtcttttctagccagtttcaccaatgacctggtgtgcaaatttgtccactgtaagagtatcaaagacatattgagaggaggtgatcattattacacgacctgggcaggtggctgtcctctaatattggcaaggcaaaacagaacaactgacccaacagcacagatttgaaagactgtttgaggacctacgatgcttgctcttgctctctttatttatgtatttatttatttgtttgtttatttattgagacagagtccaactctcttgcccaggctggagtgcagtggtgggatctcaactcactgcaacctccacctcccaggttcaagcgatagcctcagcctcccgagtagctggaactacaggcctgcaccaccacacttggctaatttttgtatttttagtagaaacgggatttcaccgtgttggccagactggtgttcaactcctgacctcaggtaatctgcctgcctctgcctcccaaagtgctggggttacaggcatgaaccactgtgcccagctcgatgctcataattttagaaaggtgcctggtttatatttcttataaatgtgtcactgaataaaggttagcccacgtgatatgattttttctttcattctctactgccacactgctatttgtggcaagatctaaggagtttcttccaggctgtcaccgtctgaaaaaaaaaatgtgagtatcatatttcccagcctcccatagggagttttaattattattattattgttattattattgtttgctcttttctcttcatcatcctactcctcctcatttttctaaaggaagtaaaggaacaggcttggcccaataattttgaagtataaataatcagtatgttccatagtcagaatggtaataatgattccgttaactcagtttatttagtgcttgtgtgcatggtgaatgtaatgttcttgttatcgactgtgttatcttcactctcccctttcatcctgaagatgtctcagggaatttctccttcaacttttcctacccaccctgcttcactccccctctccccagccccatttgccactgacttgcttagcagcacaaaatcaagaaacatctttcattcagaccattgccaacactgatagtgtaggtacccaaaggtccaatggcttcccaaacatttaagaggcgtctacaatgtgcaggttagtgcaaccggctctttaaatgcacaaacccacttcaccctgacaacaatcctgagccatgaatatttttattcgcattttttagaggaaaccagggtcaatgccttcaaagaacttgtagttaggcaaaggagacaggcatgtgtgtataactataagtaaaatgcaaaggcatctgtgtacagagggtcaggagtcatgctgcaaagtgagtttttggaaggtttgcggaaagaagggaagcctgggcaggcttttgaggatgggtgggaattttttcacacagatgatttatggaagggtgtttcaagcaaagaggacagcatgtgcaaagggaaaaggaaatggaattctgagccaaaggtaaatatgcacagctaaatataattagagtggtgtgcagaggggaagttgggttatctgaaatatataaatccagtggtctaatctttgcacgcaagtctgggtaattttaaggagagtttaaaagactccatttcgaaggtgcacaccatagccatctttcagccagttgctccttgtgtgctagacacctgaacacatgtattactcctgttccatctctcccagttattccttctctacccatctccaatctgtccttcattctagcgttctctggtttctccaggctgttgaaactaagtacagatgtggctcttccaagcctccttcatagccgttgtctttagggatgaagaaaatgaataaggaaaactgtggctctgagcagctattgcttcatgtcgtggttgaagcaggaagcgactgagcttgctatcgattttaactcctgatcttgggaatcccagagcttctttctgtttctggagtgatgtttttctttgaagctaagttaaaaggtagtcatggggagagagcctaaaaacctgtgagtggaaaaaaaaaaaaaaaaaaaaaacatcaagctgtgatactgcagaattatcacagatagtgtaaaactgtgtggccatgccttaaaaaaagttaaacataaaattaccacattaccaagcaattccacttggaagtttatttgcagtaacattgaaaacaagtactcaaacaaaaatgtgtacagaaatgttcatcacagcattatccacaatagctaaaaggtggaaacaactcaactgtccatcaccaggtgtgtggataaactaaatgtggtatatccctgtagtagaacgttattcaacagtaaaaataagtggagtactgatacatgctacaatgtagatgagagcattatgctaagggaaggaaccagacacaaaaggtcacatgttattccatttccgtgaaatatccagaataggaaaattcacagagacagaaaacagaatgggggttgccaagggagcaggaattgggagtgtaactgaaaaatgatcatgtgttttctcttttttcccccgttccactcagctcataccttgtggttttctttctttctttttttttttttttttttttttttgagacggagtcttgctctgtcgcccaggctggaatgccgtggagcgatctcggctcactgcaagctccacctcctgggttcacgccattctcctgcctcagcctcccaagtagctgggactacaggcacccgccaccacagctggctaatcttttgtatttttagtagagacggggtttcaccgtgttagccaggatgttttcaatctcctaacgtcgtgatctgcctgccttggactcccaaagtcctgggattacaggcgtaagccaccgcacatggccaatatacccggtggttttcttctggggtgatgaaaatgttttgaaactagacagagggtggtagttgtgcaacattgtgaatgtactaaatgctactcatttgtacacttaaaaatagttaattttatgttatatgaattccacctccattgcaaaagagataaaatcaaaaacaggaagacagagtgttttagtttgttttgtgtttttgtaacagaatatctaagactgggtaacttaaaagcaatcaaagtgtatttggctcatgggtttggaggctggaaagtccaagagcatgacactgcatatcacatgggctttcctgctcctccatcacatggtggaagggcaagagggaagaatagatgaactcacttttataacaatccactcacatgataactaactcactgcagcagtaatgactttattcgtgaaagtggagttctcgtaatctaatcacctcttactgggcctcacctcccaacactgttgcaatggatattaaatttctgacacatggactttgggggacacattgaaaccatagcacactatcagaggcaaaatatagtgttggttcccaggcaatgagttggctgccttgttcacagtttgctcagtatgaaccatgcttgcaggagaacccctgaaatcaacccttagagaaatggtgtccatctgggaaagtagaaaaggagacagctccaagcaccaggactgagtttcagttccaagggacaagggaagtaagaatatcatcaccacaggtccgtcctcctccccagaggaagaacacaggctgcagaggtgacagctcacaatgttagggactgttgatgagaaaattggaaatggatggatttttatggcaatgcatttttaactgcacttcagcatagagggggacattttaaggagctaagagcttaaaccagacaagatttccttcagtgtgataataaatacaccaaagtgcccttttatgtttaataattcaggatccactgagtgtttaaagggttttttttctgttttatcatttgaaaaatcgaatggtaatcatttaaaaagtagtaggtgagaaatgttttccaaataggccctgaatcatgcacttcaaaatgtctttggaaatgaatgactgagtgtttcaggcagcgtacgcctgaaggtttggaagttttaacacagccaaacacctgtcattgctgtgtatactcatgttcagaggaatggtatctacttccatacacagaatcagccaataatctgatcagggctgggatgaaattagacaaaaaggctgggcagtgcagtagctcacgcctgtaatcccagcactttggcaggctgaggcagaccaatcatttgaggtcaggagttcaagatctgcctttgccaacgtggtgaaaccccgtctttactaaaatacaaagattagctgggcatggtggcaggcacctttaatcccagtttgctcaggaggctgagacccaagaattgcttgaacccaggaggtggaggttgtagtgagctcagatctcataactatactccagcctgggcaacagagcaagactctatctcaaaaaaacaaaacaaaacaacaacaacaacaacaacaaagaaattagacaaaagaacaaacaacgtgttggggaacacttttgtaatctcattcttgaatgtgctcagaatgtggatagtcacaatcatagagccagatttctgggaaattctagagtgaaatctaaaagtcagatactagtcataatacataatagtgtcagggacatgaacacatagcaccaacaaaactggtttgaattgttctgggctacaaattgggcctccacctggaatataatgcaaaatcctaggaagtagtgacttttagaaaggaaactcgactgtccttgtagatggtaaggatgatactgtggttctgagatttaaagcaggtaggttttcccagggagtggagtggagaagtgaataacttaatggtgacactaagttggcctgtcttatggaagagcctgaatgtgacaggaagcacgcatgtgcatcgttaagtatcatcttagaaaatataacccacaactgtgctctctccatattcagcaaatgtttattgcacctctatttatggtgtgcctgtcagacactgcagtaggcactaaggatgatgttgcaatataccccacagacaacatcactgcttgcatggagctcatattttctgctcgaggaaaaacattcaagaaggagttgtgacagaaactgccagctgtctacccagtatccctttatgccttcttttaaaggaatagagtgcttggaaatagttcacttagtcagagtcagtatgccccaaattaaaggataataatgctgtgttcctcggcttagcagagagggatccccattaagatggcagtgaaaattattagacatgcatcctgggaaaagcctctaatagggactaactcatcgtgatgaaaacaccataggccctttcatgctttctccgcgctgttgtatgacattatgtgactttgaggcaacttcgttggtggaatctatgttctaaggataatggaataaaaaagtgaatgaggcaagaaggtttaagatggaatatgtagccctgaacttcttgtatgggagagaaaaattaatctatattttgtttaagccaccattatttggggactctctaaatagcaaccaaattgaattttatgagatcagtgtgggaatcacaaatataaatttatttctgaatgtaaaaattgctctgcaggcaacaaagctggaagatatgagagagaggaattggggcaagggttggagagaaagacctctctgaggttaaaacaaagtctggtatatgcacctctcagggagaaacatcccaaaccaaaggaatgccagataccaaagtgagcaacacagcatagcagagaaacaacggagagccaggtagtagaagaggtgaagtcaccagctgaggtgaaggaaacaggagagatcaagtcctgtgtctcctattgtgggctatgttaagaagtggggattctattctggctgaggcaggaggtccttagtttgatctaggcaagagaatgccacgatctgattcttttttttttttttcttttcttttttttgagacagttttgctcttgtcgcccaggctggagtgcaatggcacaatctgggctcactgcaacctctgccccactgggttcaaacgattttcctgcctcagcctcccaagtggctgggattacaggtgtccaacaccacgcctggctaatttttagtatttttagcagagatatggtttcaccttgttggctaggctggtcttgaatccagacctcaggtggtccacccacctcagcctcccaaagtactgggactacaggcaagagccaccatgcccggccgatctgattcttatttacaaagcttacccaggctggtagagaatgggcacggcaagcgtgaagttaggaagctcatttgggcagtgactgtagactgtagatcagagggagtattgatggtggggtagacttagatggcagaggagatgtacgagggatttatttcagaggtaacactggcagaacttgcagaagtttgggaagccaattaacacctaagtagcatgtgttaggaggatatgcataaatgtagaatttgcattgactttggaagatcctcccatggtctttctcctagagccgcttaactgtctccaaaaatcaatatgggttactcaacaacaacaacaaccacagcaatataaacaacttgattaaaatggttaaaggacttgaatagacatttcttcaaagaacataaacaaatggccaataagcacatgaaaaaagatgctcaacatcattaatcattagagaaaagacaaataaaaattacaatgagataccacctcacacacattaggatggctgcaaataaaaaaaaaaaaaaaagaagcacagaaaacacgtgttgataaggatgtggaaaaattggacccattacgccctgtgggtaggaaggtaaaatagtacaggtgctgtggaagacagcatggagattcccaaataattaaaaatagaactgccagatgatccaacaattcttattctggatatatatttaaaagaggtgaatgtagagcaggggtccccagtccctgggtcatgtagtggtaccggtgtatggcctgttaggaattgggctgcagtggatgagcaagcaaagcttcttctgtatttacagccactcctcattgcttgcatcagcacctgagctcgacctcctgtcagagcagccacggcattaggttctcacagcagcacaaactcttttgtgaactctgcatgtgagggatctaggttgtgcacttcttatgagaatctaatgcctgatgatctgaagtgggacagtttcatcctgaaaccatcccctgcaacagccccccaccctggccattagtttatcttccacaaaactggtccctggtgccaaaaaggttggggtctgctgaagtacagcctcaaagaaatgttctttttttttgagaccgagtctcactgtcaccctggctggagtgccaggctaattttgtttttatatttttagtagagatgggatttcaccgtgtgagccaggatggtctggatctcctgacctcgtgatccgcctgcctcggcctcccaaagtgctgggattacaggcgtgagccactgcacccagccaaagaaatgtttttacactcatattcataacagctaaaatatgggactaatacaagtgtttatcaatgatgaacagataagcaaaatgtgatactcacacacgcacaatggaatattattcaaccttagaagggaagaaaattctgacgcatgcttcacaaatgagccctgaggacattattctaagtaaaataagccagtcacaaaaacacacgcactgtataattccactcacatgaagtttgtagtgaaaagcagagagtcaaggagaatggtggtggctggtggagaggaaggtaggggaaaggacagttattgtttaatgggtacacagtttcagtattacaagacaaaaagagttctggaggttatggtggtgatggttgcataacaatataaatatacttaatgctactgaattgtatgcttaaaatggttaagatagtaacttttatgttgtatttgtgttaccactgtgaggaattggaaaattatagaggtgggccgtgcccaggattgcagtgagttttcagctggcacagctttgtccatgcttctcacagctcagatagggtccctctatgtgtgagccctagtccacattttggttaatacatggtctcttccatttctctgtttccctttgcaaatatctgcttggttagtgactctttctcgaaatctcctcataacccaccaagcaaaggcaatcttgtgccttcccagcaagtgattgtcttaccggccacggatttaaccagaaatctaagtttgtccagagagccagtcctcagaaggggctgaagtcagaactagtcaagaaggacaggtgcacatttacatatgatttgcatctgctttacatagggctgtacaagctgtgctgtgttctcaaacatcacttacgttatattttaagactgtcgcaatctttaactaacatttcgatctgcagccagggtgcccctgacttctccagatttccatatttaaactggctacaactctaatccatgggaggtgggaaatccacggcacccacagggtatctgcagatacctgccagaaggctttactttctcagagtaaccattcattccaatgatccattctcaatgaaccatctcatcctacctctcatctcttgcctctatctcaggcccaccctaaacttgcagcatcactcaaggccattgtgtgtatcccattttaatctgagggaggacaggattgcaaacactttaatattagcattcccatatttataagttcctggtcaggtgtaatggcatatacctgaaatcccagtactttgagaggctgaagtgggaggatcacttgagcccaggagtttgagaccagcctaagcaacatagtaagacattgtctctataaaaattataatagtaaattagccaggcatggtgatatgcacctgtagtcccagttacgcaggaagctgaggatggagaatcacttgagcctgggaggtcaaggctgtagtgagctatgatcgtgccattggacttcagcctgggcaacagaacaagactgtgtcttaagaaaataaaaatgaaaaagttcctcactgttctaagacatcagggattattcactggcatttttccttgtatttttagagcgaggcttccttcatctccttttctccccctctccccaatcctttctcttttccttcttttctcccttaatgcaaactgattggtaactcctcattttcccctccgcacagtttctggcattcgccattctactccttggttttctgttcttgactgttttggatatattcatctttctatgtctcttgcactgtctgggactatgcacttcaacttgaaattccttgtcttttttgtcccaaagaatattgtgactttctctttatcctacactctcttttccatgtgtaacaaggggaggtgggagtatgatgccactcctctatgagatagaggtagaagttacatgtggaatatttacttccccttttatctgattttctcctcccacctcccttcactgatagtaagatagaggctgagagaccaagaaaaatagtgagagagatgaggcttgctcgatgaatattttggaaaactccagttgagtgaaaatgtatggaaatgggcggggcgtggcggctcacacctgtaatcccagtgcttagggaggctgaggcaggcagatcacttgatgtcaggagttcaagaccagtctggccaacatggtgaaacctcatttctactaaaaatacaaaaattagctgggtgtggtggtgctctcctgtaatcccagctactcgggaggctaaggcaggagaatggcttgaacccaggaggtggaggttgaagtgagatcatgccattgcactccagcctgggtgatagagtgagactctgtctcaggaaaaaaaaaaaaagaaaaagaaaaaaaagaaaacttacggaaataaacatgaacctttcagtagaatgttcctatccaccctgttttcacttctacaatctgtgtttacaaaatacgatacattttagaaaccaaaattccatgccttcttggtcattaataacattgacgtaaacttggtccaccatctgcagtctttggtgatgggcagaaagaaaacgaagtccctgagtctttgaaaagggcaaaagtgagtgcagggactgcagtgattatctgtatgaggtgaattgaaaccttaccactgagagaactgtgtgtagtaattactgaggagccaattgtgctctgcttaacgcatccaaagcaaggcagctattagtggtgtccccacttcggtgtttatgctagaatacaggaggacagcctggttttctcatacgatttgatctacgacatgatgagcctatggccgatgttgtgttctgaacacaggtgtggcttgcccacccagaggcgagtaggatgtttagttttacttagactgacactaggaactcagtaaaatgttaagcaggtttagggaagtgcttacctgatagtctaatttagaaacataatcttgtacacacagtaatatttattattggagtaagtcagtagaaacagactcataacctttctagggagacccagtaggtaaagtggatttaccagacagtaacatcttagtcttttgtgtttgtatggcaagtatctaagttaataatgggaagtaggtgaaagttttcaggttgtgtaccatgcaattggtttgactttgccttgccaagtaagcctaacataccccttataaatacactacatgcatttttagcaattagaatatttacttactgaaatatatatatacatatatgtattatatttccttattaatatatataatatgcgtgtgtgcatatatatatgcacacacacacacatatattttagaaagacacttgcaagctctcaaaaatgagttgctgcaataccattccctctgccaatcatatgggttaaggctgattttattgccagtcatatcgtactcaagttgaagtgctaagaatgctgtcttatccctcagctagattagttttaaaaggtgatcctgaagtcctgacaagcacagagtgaggatttacgaagtgacaaacagatgccgacgacatttactgtgagatttctcatagctgaattcccagtcctggccaaggagaaatatgcaacaggggagagtgaaaggggcattttaagttgggatttataaacaatcaattctcttcttatcagaaaaaaaaaatggagaggctggagaaaccgtcttaacttgaaacagtagtttattgcttcttacagcatggtctgtttctgttctgtgtggtagtcccacttacagtgcacagagcttcatggccttttgcagccaatttagccccttgcagctcagtgcaatgccatgcttcatcctggcaacttcaagggctttatggaaataccctacagatgtgtaggtgcttttgtacagttggtaactgaggcttcaaatcaccccatccatcttcatggcatttcttagctgatcagcaagaggtgtacgctgtattttcttttatagcatcttcattacctttgtgtcttccgtagctgctcatttttatgtatatggcatcattggccgggcgttatgggggttcctctggtcacgttccggcccttcattctgctagcttcaggttggtgagtcatgcatgtttctgaccagatggaacatgatttttcttatttctccactgtcccttccaagaatctttatttctctctccgttaggttcacatgaatggtagagagaggaactcaacagcacaaaatagtcaaaacataacattttattaaaaccacatccagtgcaacccccggactggcccctagcacagtgcctgctacataatagatgatccagtgaatattgacagaatgaagacgtgattggattaacgactgatcttgccacaaaaaataatgacatggaaactatgacagcaaaacagtgctccttgctgagaacagtctctgcaacctaaagaaggatggagcggaagaaatgttttatctttgtttaaaagaatgcaacaactgtggagctacctagggttctctgtaaggcagttgcctccaacacagccagggttaatttgcctgttgcacccagttcatgtagcttctcctagaatgtgcagcaatagaacgagcaggccaccatctatcaccagagaatatcttacctttattcaggagagagagctaaggagaagataaatggtgacagtgagagttgaactccacagggtgcatcctctccttcctctcaatcttagtcctggggaagcttctcagttacctttattgtgagcctcctgtaagtggggtttcttttttccatcactcactgaaaccggcgcatggtatcttctctggaaaactaggactttaggcaacatcaatcctgcaacagggaagcaagagcaactttggtggttacaggaaaagctggagatggctgtttatgtatccctggagtttggtttttggaggcaggtatcttacttgggctgaggtatgaaactgtagccaattatgtcaccatctataatcggccagattgtccctccaccaattcatatgttgaaatcctggctccctttgcctcacaatgtgactgtatttggagacagtttgtcttagttcacttgtgtttcagtaagggagtagctaacgctggggaatttataaagaaaagaggggtgttttggcttatggttctgcaggctgtgtaagaagcaggcaccagcatctgcttccggtgaggacttcatgctgcttccactcgtggcagaaagagaaagggagctggtatgtgcagagatacatagtgggaggggaagcaagagatagtggggaggagccaggctctttttcacaacctgttctctgctgggtgcagtggctcatacctgtaaccccagcaatttgggaggctgtggtgggaagtttgcttcagggtaagagtttcagagcaacctgggcaacatagcaagaccgtatctcaacaaaaaattaaaaagattagctgggcatgatggcatatacctgtagtcccaactaatagagaggctgaagcaagaagattatttgagtccaggtatttgaggctacagtgagctgtgattgcagcacttgcaatccagcctgggtgaagagtgagattctgtgtctgtaagcaaacagataaacagacaaaaagcccaccagttctcctaaggactaagagagcaagaattcactcaccctctattcccttcctggcgggcattaatctattcatgagggacccatctactcttcacttcatcttccctctatgcatgtctgtgtccaaaatttccttttcagctgggcacagtggcttatgcccataatcccagcactttgggaggccgaggtggtcagatcacctgaggtcaggagttcaagagcagcctggccaacgtggtgaaactctgtctctaccaaaaatacaaaataataataataataataataataataataataataataataattgcagggtgtggcagtgcatgcatgtaatgccagctacttgggagactgaggcaggagaatcacttgaacccaagaggcagaggttgcagtgagctgatatcgtgccattgcattccagcgtaggcgacaagagcgaaactctgtttcaaataaataaataaataacaagatctccttttcttataaggacaccagttagattagattagagcccaccctagtgacctcattttaacttacttacctttttaaaagcccctgctatcatttggataataacctcaaggcctttgcacttgcagttggctcctgccagcttattacatggctggctcttgcccttccttctgctctcagtgcaaacattacctcctcaaagaggccaaccctcaccttctcatcaaaaatggctcctcttacccattgtaaccactctattaaatttttcctttttgagcacttaagtcgcatttaaaaaaatttttaatccgtatttggtttgctggttccctatatgcctcccttcactgagtgtaacctttgtgggggcaggagtcttgtctgagtcatcattgcccaggggcgttctgttgtgttcagccaaatgttgaatgaatggatgatgcaatagatgaatgagacaagagtctctccagggaagctgaagtggcacacacactctcaaggtcttgaaaatgcctgacccctagtgcaggggttccatgatgcaccatagagttgatggtaggcaggcaaaatgaaagcttttaagccccattgattcacctgtgcttattaaactgccttgcctctaaaaatgatcattctccagtgaaaaccagggatagcgacgctcagtgcagatttcccaaaggaagaaaatccaatgaagtgcatctttgcagtgtgtgcattgcttgtcaacctgccctgcaattgtgtgtattcaataagggtgataatgatgatgacaatgattttatcagtcaagatcccacacaagaaacacaaccaataggatacttctataggttaagagatttattgcaagggagtacttataggattgcgaggctgactaagcaattcagaaatccatgggccaggccatcaggaagagtatgttggcaactcttgggcaggagctgacagcgtggaccacactgtggtcctcaaggatcacatggaccacggtgtggtccttcctcacagttttgctcttaaggcctttttccaattgcactacactcaccaagatttcttaagacaatctactttacttaaagacaatcaatgttaggtgttattcatatctataaaatgccttcacagcaatacctaaattaacattttatggaataaacggatactgtattctaaccaggttgacacttaagactgaccgtcatactgatgctaatgttgatgatgatgacaactgctactctgtattttgctcttagtaggtgtcaggcatgctgttaaagttcttacatgtgttttctaatttacaacattgttgctccaattatcattctcatagtatcaataagggggttcagggaggttaaatgacatgtccaaggtcacacagggctgaaaagtacatctgtgtgtgagcaagtctagagatccaatgtacagtatgatgactctaagaaataataatgtattgaatactggtaatttgccaaaagggtagattctaggtactctcactataaaagaaaaaaaaatttcaagaatataaaaatagaaaggagggaagaaaggaaactaattttatgagatgatgagtgtgttaaattgcttgactacataatcacttcactctgtatgtggaagtcaagataagtatgtcaaagtattatgttgtataccttagatacatacacttaaaaaaaaaaaaaaaaggactctgggccgggtgctgtggctcacacctgtaatcccagcactttgggaggccgaggtggggggatcatgaggtcaggagatcaagactgtcctggctaacacagttaaaccccgtctctactaaaaacacaaagaaattagccaggtgtggtggtgggcccctgtagtcccagcttctcgggaggctgaggcaggagaatggtgtgaacctgggaggcggagcttgcagtgagccgagattgcaccactgcgccccagcctgggcgacagagtgagactgcctctcaaaaaaaaaaaaaaaaaaaaattggactctggtttctaaatttaaacgtttatccagtgggctggtagctgtcatagggatagaaattctaggctctaggactctatcactagtaaatacagggaattaaaaactccaaggagtatttttcatgtaaagcaaacaaacaaaaaaggccttgagtcttaaaagagagagaaagagttgttgaaatctagaggcacacctagtaagcaagggtaatgtattgcatttccaggagaaaatgaacaagaatgtaagttacactgattcctgccctggggtaatgggtgggtttccttttcagctctcgtgccaggtgggcattcgcctgaactaggaggactcggggggattcaagccccctgtctctaggttgctatgagctttcacatcttcctctggtttatcccccgcccttagcacgaggtggttgcagcgtttcctaatataaatgcaagcaaaataaaattagaaatgtgctggtcgggggaagccagctacccacaggcgccgtaaattgccttttcctctcacccctactccctcctacccaccccttctcactcccatcaagccaccccaaataacctgccttgcctggctgagtcacggtttctggaaaagtggggccaagaaggttcctaacaagtcactggagtgatgattagtggatgatcagcggtcaaaagagaatcatgcatggaaggaaggtggataggattcattggcatgagtggcagatccgggaggactgcttggggcagactgtttgagtgacataggtcttttagggtcaagggagagaaaccagagaatgagggaagcacaagctactaaattttgccatcacagcagctgcctttgtgtacagtccctttgcctctgctgttccaatattgggatggttccctaccctcaggaaagtattcgcttgcctgtagccgcgttgaccctagcgcttgatgactgaggaacacttgtgttattagcaacccctctttcccactattttaaatgaataggcatacttgtatccatgcagatgctgctttagagtttagggaattacaaaatcaggtacaccctagagtggggtttctcaacagcaccagaataatgggatcagtcctgggcacgaacatttttccaagcagagtagtctcacatcccttgaaggctgagaactctcatataaaggcattccacaagttgttttagaaaaaaaacgagaaaatagcctcaatatttgaggagtgtagttattaggaataacttacgctacatgaggacaaatacctaaagcatgtgggccttaaaacctagatgacaggttgataggtgcagcaaaccaccatggcacatgtatacctatgtaacaaacctgcatgttctgcacatgtatcccagaacttagagtaaaatcaaaaaataaaaagaataacttaggctacaatgatgatgtcggtgctggtgttgatgaaggcaatagtggttacatgtaacctagtatctagctcttaccgtgccactcatattttgagaataattctatggaacacttgacttgatccttccagtcatcttgtaaggcaaatatgattgtgcctacccttgcttttatagatgagcagaagtaaatgaaagccagagattggaataggttgccaagactttactgctaataggggttgagaatggagggacataggttatccagaccctgaagcccgaactccctaaccacctcaaaacactgtcaggatcaggagaaatgcagattacacggaacaatatctggggcagaaaaacaatgaggcatcagtttttccccctttatcagtggttccccattctggctgcaacacattcgctgaggttgccttaaaaaatcacgttgcatggatccaagcccaaaccaattaaagataattttaggaatacgggactcagtgatcagtatttctttaagttcccagtgtaataggcagccagagttgagaaccattgcctgacattaaagattcacaaaatgtggtccatgaatcagactttaatagatctgttccaagttttcatgaatgagtatttagtaaagatgtggtgcatggcttttcctaattctcaaagggatcctctaatgccaaaaaaaaaaacacaaacaaggtgggaaatcattcccttggagtatgatgggagcttaccgtgtgcctggaactgaagtggatcttgagatgagctatctcatttaataatcctaacagccctgatattgtcccattttatactcaagggaccgaggttccagaaggctagggaatatgcttgatatgtcatcatgaataacggatagagccataaaccaactcaaatctacttaatgtcaaagccagttattcttaatagacttctctgatggatgagggttgaaaaagtcctgcccagcaatagggggaacgactcaaagacagctagagggctttgccagccagagggcatgcaggaactctgaagtggtgggttgttaagaactaaaatattccatttgcaccgcagagctcagaattaatttccactgtcctgatggagcaggtgggaaggaatttgacctctcccctttgcctagaaactggtcctttctggaagcttctgagcttgctatggaaaaaaaaaaaatttttccacttctttcccctgctaccttattttcttgttctctgaccatttatctcaaacaaggaattattatctttctaatgaagccacagtagacccttcatttatcctaggatatgtcacccctacaattttctgtgaagtgtttttttctcaaaagacttctgaaattgaatttcttacgcatatgggaggagaatgatctttatgatgacacgatgatcttatccagcaaatatatttccctgtagatccctactttagcagatggcatgatcggggtgctcaagctaaacacttctttgtcctccttaattcctctctcatgggcagactgctcccttcctattctaaatcaccgtgtcttgccatgcctctccgatccatccactgcctccatctccatcatctctctggtccaaacctcatccgtctctcagacaggaaaccgctgtggtttctgcttggtcaccccactagctgtgctcctacctcatcgtctgcagccagagtaataacttttagtacaaatctgatcatgtctgagctacttaaaactcttctgtggctgctctgagccctgcacataaaatccagaacccttcacacaggctaccgtatactgcgcgatctttctttttgctctccagcctaatttttctccatggtttccttcactgtctcaatctcacccctgcaaaatgaagtagacacatgttcctcacatttaatgtctgcatatatgagattagaaatgggatagtctgggtgtctgtctcacagtgaaagagttttgtttattctttttattttattttactttaagttctcggacacatgtactgaatgtgcaggtttgttacataggtgtccacgtgccatggtggtttgctgcacctatcaacccatcatctaggttttaagccccacatgcattagctatttgtcctaatgctctccctctccttgtctccaccccccgcggacaggccctggtgtgtgatgttcgcctccctacgtccatgtgttctcattgttcaactcccacttatgagtgagaacatgtggtgtttggttttctgttcctgtgttagtttgctgaggatgatggttcagcttcatccgtgtctccaagtgtaaattagttcaaccactgtggaagaaagtgtggcaattcctgaaggatctagaaccagaaataccatttgacccagccatcccattactgggtatatactcaaagtattataaatcattcttctataaagacacctgcacatgtatgtttattgcagcagtaattacaatagcaaagacttggaaccaacccaaatgtccatcaatgatagactggataaggaaaatgtagcacatatacaccatggaattttgtttattctttaaagagctttatgagatacgatttacacagtgcaaaattcacccattttaagtgtacagttcaatgttttgtaagtacatttactgagttgtacagccatgaccacattctaaatttacaccatctttataaccctcaaaagatcctcgggcagattagcatttcttcccccagttccccaatgctaggccaccactaatctattttctatctctaagaattggcctattctggatttttttttttttttttgagacggagtcttgctctgttgtccaggcgggagtgcagtggcgtgatctcggctcactgcaagctctgcctctcgggttcacgccattctcctgcctcagcctcccgattagctgggactacaggcgtctgccacggcacccggctaatttttgtatttttagtagacatggggtttcaccgtgttagccaggatggtctcgatttcctgaccttgtgatccgcacgcctcggcctcccaaagtgctgagattacaggcgtgagccaccgcgcccagcctggatgttttatatcactggaatcatacagtatttgttcttttgtatttgccttctttcacttagcataatgcttacggggttcatccatgttatagatgcgttgccagacaacatactgttgtgtggatataccatgttgtatttacctctttactagttggtagataattgggttgtttccacttattggctattgtgaatcatgccactatctgcatattagttaagaacatcggaaagtccaggttctctcattgaccatgagcagaaatccagctagtcttttgacttgtctaagccactgtttttttcttccgtaaaatgggaataataatggcatctaccctagaccgggcgcagtggctcatgcctgtaatcccagcactttgggaggctgagggaggaggattgcttgagaccgaaagttctagaccagtctgggagtcagagtgagaccttgtcgctaaaaatttttaaatagcgtctacttcatgggttattgtaaaacttaaatataatgataggagtaaagggtgtagcacagaattgcttgaacctgggaggtagaggttgcagtgagcccagatcgtaccgctgtactccagcctgggcaacagagtgagactccgtcaaaataaaataaaaattaaaaaacccacaaacaaaccgagacaatgagtgtagcacagcacatagaatgtaattagcactccagaagcctgagctattgttataattcctcttttcattacagaaaaattcttagggtagcagttcctggtagttactgttttttcacaaatatgtatttactttttaccaagttctagtcatttattcattcttttcaatcatcctgtgttgtaatcattactttcccattttatacccaaggaaacaaagtcagagtattcaggaatgcacccagggcacattggtaaggaaaagtacagcaggattttccttccttcctccctccctcccttccctccctccctccctccctccctccctccctccctccctccctctctctccctctcctttccctctcctcccctgtttccctttccttcccttccctttcctttcctttctttttgacagtcttgctctgtcgctcagggtggagtgcagtggcacaatctcagctcactgcaacctccgccttccggattgaagagattctcctcccacagcaggagtagctgggactacaggtgcgttccaccacagctggctaattatctttttttttcttattcttcttttttttttttttttttagtagagatggagttttgccaagttggctaggctagtgttgaactcctgaccttaggtgatgtccaccttggcctcccaaagtgctgggattacaggcatgaaccaccacgtccagccaggaaaactacagcaggatttatgagcgaaagcaaccagtgaatatttggaagctttgttcctggtgttcgggagtctgctgtcctctgacctcttgacttccaacccctcgtccatcactctttatcttatccctcaaaaaaggcatgacaaagggtcatgagaggcctggttctgagaatataatcaattacttggcttgaaaaggaaaaaaaaatgtcagtgtttatttgtttttaatcatagggggaaggatttttttggtgaagagtcaccattcaatttcttctgagaaaaagctttatttacatcagtaaagattgcaaggagacatcagaaagaacatttttatagtgaaggttttgagatcctagggagttcatctgaaagacttacagcattgtcactactcactgcatgtgtgtgggcatgtgtgtacacgcgtgtgtgcatgtgtgtgcatgcgtatgtgtgtgcatgtgtgtgtgtgagtgtaggtgtgtgcgtgcatgtgtgtgtgtgtgcacatgtgtacctgtgtctgcgtgtgtgcatgtgcatgtgtgcacgtgcatgtgtgtttgtacgtgtgtggggtgtgtgcgcgcgtgtgcgtgcatttgcatgcgtgtgcgtgtgtgtgtgtgcgtctgtgtgtgtgtgtgtgtgcccctgagtagagctccctctgcagaagtcaggctgaatcatcccaccttgctgactctttctaaccctatgatcctttgcctgagtaggtggggagtgagtttaaaccttatgtcttattttccttcattaatttggccaaatcatctgaaaatcactattctctacctctcaaagatgtagatggtggtactaatttaaaaattgctataatactctaagccatcatcagtatattgttttctggttttcaccttcttcagtatgcttcctatgagacagagttagaagtggaaagaggtgaagatagagatggtgaaagagggtgagagatttaaagccatattcgatcccagtgagagagctcatacagaagaggcatagttgagagagaaaatagcaaaacagtaactaggtgtcactcttttaccagcattcacagtaattgagctgagaaagaggtaaaaagtttttttgagtgattttgttaaccagaagacgtgatttgacttagggtttgtgggggtttgctgtgtgtgtgtgtgtgtgtgtgtgtgtgtgtgtgtgtgtgtgtgtgtgtgtgtccttttgttcctaactggctgtgagactttggtaagtcatcttaaagtgttttttttttttaaagtagttttcagcagagattgccttttattttttctcttctactgcacgatgcaatcaggaacctgtctagaagtatcagaagttgctgctacattttggtggacttgcacctgactcacccctccagcctcgatgcatcgcatgcagttagcatgttcagcacaatcttctctcttgggtttgggcaggcatatggtctgtgcctagcagagctgatattgctggttccaaaaaactgcctgttacatgctggtggtcacaagagaagaagaggtgagaagggctcggagccagacaaagcacgcctttgtaaatgaatgtggagttggccaccagcagtcttcattatccccgtcattgcaggcagctgagctggctttgtgtcagccctgctcggagtagccttgttaattcacccccatgaaaatggaagtttcatacacattgacataattaatgaagaggcaggcagcatgctctaccaattaacaccacagggaaaagtaaaatgggctttcttttggcatattgtgccaaagttaaggactgtaagacacagcaaataaatagagatgcttttaatgagctgcaagatcgagctgaataagtcagaaaggagtgttgggtaaacactgccaactctttgcaccgttaagagtaattgatgagcatagttgaaagtttggggggaaagagaaccgtcggctgctccaaccgtgttcatttataaatgcatctttccctgaaagctactgttaggtgtgtttaagggtgtaatgtgcaagaggaaacaaatatgacagacttgctattttgtagtgcccagaaaatatgaggcatagctgttgtagaaagaacaagcgtggcggatttttcacacttgatgggattgtttttgtcaaactcggagtaaaactggctcctctgccgtatagatccctgctctgagtacaccctggaaacaggaagcagggaatctttaagagtggtattggaatgactccattccttttagaaaagccagacggataatttaatttttgttctctatgtttgtgatatgaaagcatgaccttccaccaaaggatttcccattgtttctgagagtgagtgtatttatataaagaagttttctaaccaaagagaaatctgttggatcaaaaaatagaatgatcagtagggtttagtagctatttaggaaattttctgaattcaaaccaattgaatctgagttcagttggtttttgttaatgtggtgtatcttgttcgattaagccttcattttaaaattaaaggtgtcttaaatggagttgcattgtttgaccttagagagatcaattgtgtgtatcagaccaaacaaaattcaccatattcaacaattgtcctagcacccatctcccctccccactcccgacaaccatcatgacaaaagtgcaggaggaaaattcttgacattagcagacagcatgctctgaagcaagtaagagaaggataattcaatatagtactcgtcagtgggcgtctggtcctgcccatttttcctggctctgacatttcatcatgctgagtgagattccatttctaaacttggtgtcattcatgcaacatggccccaagtataggacaactacttaatctgttgttgctcaaagaaggtgcaatgcattacaatgctagagagaaaagtgttcataggaacctaaagagacagtgtgttgacaccaacatgggacctccctaagcaagttgctgagatttgattatgtgtgatttctgccttatgtgcccactttggatgtaaccctgatgtcaggtgtggctcttggaaacgacactattttctgttgtgcaggtatcattgctgcatcttcctctggttgaggacttgttacctggacttttgaattatcttctttgtacatggggggatggcagtatttctctgattgtgatctgtgaacttgccacaggatcatcttggatcctggctgagtgtggaatttccaggcccacatctgacctatcagggctggccgtacaatcagcattttaaataggcatcttggtatttccatgggattctcttgatctctatccacccttaacatcccatcctactttctgcttgttaagactcaggatacttctgggactgctctatggaatgggttcttaggaattctaaatgcatttgcatttcaaagactgatgagaaagggacacctgtccaggtaagacaagtcatcggtttccaactccagcaataagaacttagtttatcagatgtactgtctaactagtagaggtgtgttcgctgtcttcattaaaatgaagccaggttgatgtgactaaattttgatttgatttgctgcgttttatgtggtggcttatacttgaatgtctctataatatctccctgtgtattttagagagtgtgaattaaaacagctgccttgtacattgtaagtgttcaaaaatagtttgtaaagtgttagaataagggcttcatagccacaaggagggtctcagaaggtgatttggctagattataaaacacaaatattaacttttgacttgtttattctttatttttatttgattatttatttatttatttatttttttatttatttatttatgagacagagttttgctctgtcgtccaggatagagtgcagtggcccaatcttggctcactgcaacctctccctcccaggttcaggcgattctcctgcctcagcttccagagtagctgggattacaggtgcgtgccatcacacctagctaatttttgtatttttagtagagaaggggtcgcaccatgttggccagggtagtcttgaactcctgacctcaggtgatccaccaaccttggcctcccaaagtactgggattacaggcgtgagccactgcacctgccgttgacttatttatttgtaaattatcctgttctccacatatatacttttaaaaagcacttcaaaatttcagtgtggttattcaatggccatcaaagtttgttattctaccagaatggtcttatcttttacaagcgagatctaagaaagcacatacagaggcctgaaaagttgatttccctccttggaggagttcctgatttaacttcataaatccacaagagctgacatctcttcatgtccaaccacaaaatgggtagaaaatgatgaaatgcagaagaggcttctaagtcttggtctgcttctgtgatagaacaggagagaggcagcattttatttttaccattattagccagcctgtcagtcacttaaaatttttccgtgaagacacaaagctaagttttgaatactctgtgtcactgcttccagctgatattataaaaggcagtggtgaggatttcagctaaaaaaagattcgttgtttcaaaagcccagcctgaagtaagacagtgccatagacacgaccacaccagagggcaggtggttcacaaagggccttgcattcttctttgctcttgtttactttacatgagggcaaggagtctcagaagcgtaagatataatactacactagacaggcaagcagacctaatgtgcaaagtctcatgttggctatataggtagtttatatgtcagttccaattatgaatacattcctcagcaactagagttttctcattcattcttactgaactgttagggcatgtggcagcccagagctctgtcaaaatgaattgtcccccttgaaaagttggcaatgcaaggaagtgacaacctaatgcatgttagcactcttgataacaggacccagaggagacggcgaagcaacaattggatatgtgtctgggcactggctgttgttcctgcctgggttcaaatctcctctctgccgcttatgatctgtgtgcatttacaagtttgttagcccccttacctctttgttccttataaggttgtcgtgcaaattacatgaaatgatgttacaggtgtaagccaatgcctgacacacatatgtattctacagtaatcattatcaaagtggtaagcaggaaccagtgccatttcacaactatcaggtactcttctgggtactcatcatgaaagactgcagtgttccatttacaggcattggttggtggtttactaaagagtgtgtttttgtccaagaagttcactcactacattttgctcaaccagtcctctcatttgcagcgatttttttttctttgagcgtcccttgttgtgcagcataaacatctgggctgcatggtcagacccatgaggcttctcttccatctggccacctgttatataattaagcctgattgcagatgcgattctcatttagctgtcagcagcagcctgggagactagcaactgaggtgaataaaggtagctcaccacatctacaagggtagaagggctgaagcgaagggttgaccagccaggacaacaaaggttattgcttatggcagtgtcagcctaagagctcaagttcaagatcagaagcatgagagggtaagacctctaggggagtctgcataggtccaggtgaaaccctgggtgtctcttgattgtcagagcatgtaaatgatttttccgtgaggatagaatttgacagtcagtgctagaaagggcttcagagtttggtaagtctctttggtggactgcatggatagatgtgaaaagataaaccaaatcaaaatgtatattccattgaatcatgacaaattcgcattggtaatgcgaatgatagaatattataggttatgcttaagtgctttacctgtggaagttacttatcagaactccaaattttcaggggcatttgcacagccagtaattgtgcaggagatccaactcacatccacctcagcttaactgcctcttgatgctttcaagcattatgctatttatttcagtgtcttatgtttcagaactaaagaaatgttgaattaaattccccactatatgccgtcagtgtttcagaaaaaaaaaaaaaaaaaaagaaaaagaaatgagcaaggcaggtggatttctggcaaagttttgttttcatttctgtctgatagaaatgggagcacttcctaaaccaaaagagcattttttttttggtagaaatagccatttattaaaaaccataaatctgttatggctggttggtgagcataccttacagtttaattgtaccaagttgaaagtggacacataccaggataggcacacctcattgttccacatgtggcttcagtgctttaatgtgaattataagtacataagtaaagtacatattatttatgcatatgttgtatttatgacctttgggatgcatcagaggttgcttaggctcgttgttctgggtctttcaggatctagattttctatcctgattcttcctttttctaaaaaaaaaaaaaaaaaaaaaaaaaaaaaggctcagttgaggaactcactcagctcactcagtgcaatactataatgggaagagttccatgatgctgccattccagttataaaatggcttcttttagtcatcgtacaagccagcagttatggacagtgtttctctaaatgttagtaataaagtgtagcaggtttcatatcagtatactaattctaccaaaagccattttcagtcccattgacatttgaattctgcccatgcaaattagtggaacttgccatcacccttggcctataatgccccataccaagcatcaccagcccagtgcttctcagtcttggctgcaaatgatcgagctataaaaatactgctacctgggacctgcccctcagtgcctctgatttaactagtaaaatcagagggaggtttgagcatcaggatttctaaactttcagattttcagttgggcgtgtagtggggtgggttagggggaggtaatgtctccaaatggaaatgtctttttggttaaaataaagtagaaagaccaaataagtgatatttggggagagcaatgaatattctaaaaccaatcaatgggaattgtcattttatggttctcctgaatgtgagtgtccaaagtcctcgttattcaaagtgtggtccaaagaccagcctcacttggtaactgttagaaatgcagactgttatgttccagacacacctactggatcagaatgtgcactttaccacgacttccaggtgatttcatgtactttgagttagagaagcactgtcctagtcacagtgatgaggagggtgataagagtggcagaattcactttattgagcctctgctatgtgtcaagcactatgctaagacatttttgtgacatacttctccttaagttgttgccggagttaaataaagtgatatgtttaaaacactaagtgtagtatccaatatcaggtgttccaaaaagggcttatcatcatcatcatcacggtcattgtcattatcttaaatccatggtcaccctaggacaggaagcatgaatctagtttgtaagtgcacgtgatctcctttccatgggtgatatgggttggctgtgtccccacccaaatctcatcttgaattgtagctcccataattcctacgtgttgtgggagggacttgatgggagatagccgaatcatgggggctgttttccccatactgtcctcatggtagtaagtttcatgagatctgatggttttgtaaggggtttccctctacggttggttctcattctctcttgtctgccaccacatcagatgcacctttcaccttccaccatgattgtgaggcctccccagccacgtataactgtaagtccattaaatctatttttctttataaattaccagtctcaagtatgtctttattgcatcatgaaagtagactaatacagtgggccatgtgagatgatgagattgtgaccttacattcaaagataactaagctgtggtggcaatggatgatttgttctcctgaaatctttaggtggcacgggacagaaatccaaatagaattggcgtttgtcaaaagtagaatatattgtactttaaaaatgtgaatgtcagacatttgggggtggggggaggggggagggatagcattaggagatatacctaatgtaaatgacgagttaatgggtgcagcacaccaacatggcatatgtatacatatgtaacaaacctgcatattgtgcacatgtaccctagaacttaaagtataataaatatatatatatataaatgtgaatgtcatgtttctgagatgggtgtcaggaatagctgaatcaaggtgaccaaatggcgatgctctaaggaatgggccttgctgaatctgtacactctgcttttcttggcgtccactttatttcatgtcatattctctccaaatagtggcaagatgctcaccctcaactcaggactgagatcctatcactttgtcttgaccaggagaaaaagagcacctcctttacaatcatgaaaggtaacatcccagggataactctcaggtaccctgtgcacatccctgagccagttactcaagtcagaagcatggatattctgatcaggcaggttggcttcaaggatgaatcaggcctctcatgaactacaagctacggagttctctgaaactggagaagaggttcttcttcaaagaagtgcagtgtgtaatgcccacctgaagagggaaggaatttccagcaggtgtaagggactaatgtccactacaggccctcagttaaaagagttgggtagaaagaggtggggtgtgtgtatgtgcagcctgcattgactctccacttgatgctgtgtacattctgagggcaaaaccctgaattttccttgggtctgccgtaacaaattctctcaatggtgcctccatagggagaaaggggccaacatctgggggttctttcctggaacagtgttaagtgctttcagagttaacaagttttatattcaaacaactccataagatgagtctttcagacttaatttctaaaaccgcaaaaagtactgtagaggagttcagagatacgtctaaagtcacagttaatcaagaggactggtaggattcccagctcacttcaaattcatactcctgtatattcctctttataaataagtcagtgagcaaattatctcattaaaatgtaagtcagagattgccaacttcaggctcacaggcaaatggactttataacttgcagatacagtgggggtattttcatctgtgtgtctatatgtatggatgtatttacaaaataacattttatgtaagaatatgaatttctggcttgtcttcatctctccaggataaaaaatggctaaagttgagttgtggttgtcctctccggcattgcacactttcttcatttcccccagcattcttacctggccagtttctgtcatttatagaacctgtttggtcctggagatatttgagtttgaaaatcctggagtaatagtaccccattatgtcactcatgtacatggtagcctatgcaatgtgtcattccattcttctttaactgttgcaaaacatgccatgtgctctatctgtatatctctctctgttctcactgtcacataccacacacaccccaccccacccccacacacacacacagcaagggaggaatttgcgtttgctttgctcttttctttccctgccccctctcacttagctcactgcataatcctcctctcgtaaccttcaactccacaatgcaggaattttgcatgctctgtccccaaccgtattaataaagcacttaaaagtatgcgattttattcagggttatttatctaactgtctctactgaagtggtacttctgcagctcttcagacgcagtggtttccctgggggcagctttcggagtccgaaagcattgactgaaatgcaaagcccggatgccagctgcacgcgcaagcattccaagcccagtcattgtagccactggagatgggggtgggggatttgagtggatgggtccttccagcgggcatttgggtcatttggcccgtcgccctgcctgcaggctggcctgcacgcagcacctggcctaggcaccctggaatctctcccttcctgtggcagacacaggaaactcctacctcatcacggcagctgcatgtgtgggtaagcccacggtgatgatgacttctgtactggctgtttttactccttgctttaatgatattagctcacgtggttatcctttcccttctagcaggatttttccacagccagacaattctttgcggtgaggaggccaccctgtgctctgtaggatgtttagcagtatctctggcctcaatccacaggataccagtagcacccacccaccaggttgtgatgacccgactttctcctgatactgcctgatatcctctgtgggtgaattttcctggttaagaatcactatcttacaggaaggtggcaaagatgagagtatcagactgtaagttccgcgagagcaggcattgtgtctggtttggtcgtggttgtgtgccaacagatagtagattttcaatacatatttgttgaatgaatgaatgaatgaatgaacttccgactgatcagagctgaggactatattcatcctcaaggtaatataatgattattattcacatattaggaggaaaatcaagggttcctttttatcttctcctactaccccccgctgtcattatcaagtgagttcaactaagatttgcttaatgaaaacctaaatcattatggctctcttaatcagagtacctactatgtggctattctaaataggtgttctcattgaacttggttttctcagtgattcataaagatggttaatagcaatgaaattttacagattgggaaactgaaaaccagagaagtgaaggaatttgtccatggccacacagccgtaagggagtagagacctgattcaaatcttgggctagaaggattctcagaatcttcttttctctttgcacctgattggctgtgcctctcgctttattcagtcaaagctcaattcaggacgacgtgaaagaacattaattccaaggtgaaatgtgcaagaggttaagtgaatttgaccaagtttcccattataatttattttgggggaaaatggattaaaaacataatctctcggttctaacttcacgttcacttgaaaatgaaaagtgagtgttttacagatccacagcttcacgttatctgttgcattttgagagagaagaagatggatgcattggggtagagagtataataatattacaaggctttatatggaaggtcaagtgaggggaagatgagctggaaggatggggaatagcaggctaagaaagaacaatgcataacagatgtatctaaactgtttttaaaaatggttaatagactcaaggagaaatataaagaagggagcactctgaaaggtcagaacaagtagtcaagtaagaagcaaagtaatttaaacataaaaaggaaaatccgcagatatttctttcatgcttcagaaagcgtcggccttaaacattgcagtgtcccagtgatgcattgcaatcttctgcaagacactgaagtattttatgaaggcatactttttcctcctaagttgaggagaccctgagatggcccaaatttcctttaaaaatgaaatgaaactgctcggctttccttacattaaccttaaagataatgaagttttggtccttgccctataaaggatagacagaaagggcctagtcacatcttcctgtcatctatgtagatgatgtccttattcagaagtcattatatgagaatatgagtgttatgggaaggcaggaaggaaggaagggaaaggaaaggagaggagagggaggaagggaaggagagagagaggaaggaagggagggaggggaaggagaaagggagagagaggaaggaaggaaggaaggagaagaaagatggagggagggaagggaaggaagggagagagagggaggaagggcaaaggaagtaagggagagagacgaaggaagaggggaaggaaggaagggagagagaggaagcaagggagggagggggaagaaggaagggagagagagggaggaagggagagagaggaaggaagggagagagagggaggaagggagagagaggaaggaagggagagagagggaggaagggagagagagggaggaagggagagagaggaaggaagggagagagagggaggaagggagagagagggaggaagggagagagagggaggaagggagagagagggaggaagggagagagagggaggaagggagagagagggaggaagggagagagagggaggaagggagagagagggaggaagaggggaaggaaggaagggagagagaggaaggaaaggagagagaggaaggaagggagggaggggaaggaaaggggagggaaagaaggaagggagagatggaaaggagggaaggaaggcctcctcatcctttttttctgcgttcgtttactcatttcacttttttttttaattggacatctgtatatgtcagtcactgtggaagacatttgggaaatgatgactagtaaaaacccaaacaaaataaacaaacagaaagtacctgccgtcgttgtctagtggacaaggcaaaacatcaataattcaataattactccgtgtgttggggcagggtctgttttcttgcagtcatgcctcagttttggcttaacatatcagcttccatagttaacttattcatctgcctgcctctaaatcccacagattttgagatgtagatcagctttgtcctctcaagggtttcacattcaggaaagggctgacccatcaggcatgatgaagcactgcttgacagattcagcctccccagtcaatgaaggaaaggaaaggaaagcaaggttcgtttcatttcccaatcacgtgatggcattgggcactaccactagcttctgatgcattcattctggaacttgtttgtgaaaatcagttgagatactaaatatagaaggggagagccacttggagttgaaagtgacctttaaggccacttctgtcaacttagcaccaaatgcatgaatttacacaactgaatttctgctcttcggacataaactttccccattcttttttggtcagtttgtttttaccctgcagagctgatactgcagagggcagctcattttattcctggactatagttcctcattttgtagaaatcaactttgtcttcccaaggttactggtgttaattttaccttctgatgttaggtaaccagtcactggtttccgaagctgggtctgagtcccagaattcacattgatcagccatggtacctgaacaagcacctctagccccctgagcatcagggatctttccattaagtggagagtatcctccagaatctacctctccagaattcagggtaagataagtatggttgtttggatcagataggttttgtctccatggtagacaagagaccactatagcttaaaactcccattctgccaacagaacaaccgaaagagctagaatacgcttgtttatgtgtttgttttctggtagctgggcaaagaaataagggagggcttggctggtttgtcttgtaccatgtgtttatccttaaaccaatcagaatgaatcaggaatcgactactatcgttcacgtgactaaactggagtattagagaatcagcagggttcatgatgagggagtatagctgtgttcactgcaacacagctcctaagagcaaacagtttaatcagctcatttatcatcctaaccaaacttttaaaaggcagttcctcgggaagttaagcatagaattaccatatgacccagcaaacccattcccagttagatgcctaaaggaaagaattgtaaacagattcacttgaatccacatacacaaatgcttataacatcaccattcattacagccaaaaagcaaagacaacccaaatgcctatcaataaatttatcaataaataaatggatgaacaaaatgtggtctatccatacaatgaaatatcattgagccataaaaaggaaggagctactgttacatgctacaacgtggatggacctcaaaaacactgtggtaagtaaaagaacccagaatcaaaagaccacagattatgtgatttccttcacctgaaatatctggagtaggtaaatccacaccaacagaaagcagattggtggttgctacaggctaggaggaaggggttggggaataaccattaaataggtacagattttgtttcggaatggaatgatgacgtattttggaactagataggggtggtggttgcataacatttgtgaatgaacaaaatgccactgaattgtttccttttttttttgagacagagtctcggtctgtcacccaggctagattgcagtggcacaatcggctcactgcaaattccacctcctaggttcaagcgattctcctgcttcagcctcctgagtagctgagactacaggtacataccaccaggcccaactaatttttgtatttttatgagagacggggtttcaccatgttggccaggctggtcatgaactcctgaaaactgtttactttaaatggttaacaaccaccacaacaaaaaccatggagaccaagggagaaaacttaagtgagatatataacttgcttgagctatgtgttcattttataaaatgggcaaaagatgcctatgtctttaggttataacaagcttcaaacaagtgaatatttataggggaccaggttcctggcaactattaggtgctcaataaatagcctgcatgcaaatacctccccacacacatatgcccacttgtacccacgtaattcttatttaatggtgttcttttaaagaatgagataacaggccaggcataagcggctcatgcctgtaatcccagcgctttgggaggccgaagcgggtggatcacctgaggttgggagttcgagaacagcctgaccaacatggagaaaccctgtctctactaaaaatgcaaaattagctgggtgtggtggtgcatgcctgtagtcccagctactgagaaggctgaggcaggagaattgcttgaacctgggagggggaggttgccgtgagctgagatcacgccattggtcattacactccagcctggacaacaagagtgaaacttcatctcttaattaaaaaaaaaaaaaaaaagaatgaggtaacagaaacaaagaacttacctagcacatgatgttagcaaaccctgtcaaatttgtattcccatatttctcaaaacttgttcttctttccctctccacaccggtgattgttgtcaccctgctttcctggactgctaaaataggctacatttcccttttcaatcccttttgcttgctcttgatgttcccaacagcggccaaagaacccatctcacaatgtacataggatgctttcccttcccagttaaaaaccccactgtacttagagttaatcccaaccaccttcatataaagccctggaagtctggctcctgccaaccttgctaaactcatcctttttttttttttttcctgattcttatcccattgactttgactgtttctaagctggctctatcccaagtgaaaagtcacctcttcaaagaccttttctatttaaaagaattatcccagctcttctatattcttttccatgacatgttattcacgtgcttccaagtcctgatcaccatttgtaattttaaacattgagttgcttttccttgctctttctcttattcatgaaggcagctctgctgttgaacacaatacatggtagacagcaggccgtcgatcagcacttgttaaatgagatcaatgtgtggaaattattattaaagtcctgaaaattttacaaagtctattttgctctaatgtgtacattggtggtatagtctggggaatacatgtatagtttgcattgtggacatccgattgtttccctggatgctgccctttcaacaagaaatgcgaccttagcaaaagatgggggccccatgaacttccaactcgtcttttatttatggtatatgtgtcagagaaacataacaacatttgggaatttattaaatggcagttttctcttcaaattcttgctctagtttattgtgcctaatggagtcttactaagggcaaagctaattgacaacaaggtttatttctgccgatcttagccaaaaagtcaatcaccactcaacgagagctactctgactctttggccaatggacaaatttccatcttgactggcttgactggtcctgggagaatagaagtgaatgagcttaattctattttgatacttttcattttcagcaaaactgagacaacatcaaggagttacattatcatgagaagagaggggttgcatggaaattatgtcacaagaatgcttggtcaattttcattgcattcagctctattcacaaaggcctgttttgctggcagacgcttttgtcagatatgtggctcacggcaggcaatcaagctgtggcatgttgcagagggacagtgagggctcacatgctggaggcagaggttactcaggccaggtaatgaataaccccactggaagagcaaaagagctcatttctcagtggtttatcttccagtgggttggtgttgtgtataatacagtgagttgagatgaggaatctatttggttttggttccacccctttgccagcaaaaccacaaagtgggaaaagctaacctttgggaggtaaaagctaacagtgcaagatgccatcaataaaataagctccctcatcagtgaagaagggggaaccaggctcaaagtttgtcttctaccaggaatataagcatcgtgtcctggatagtatgaagcatttaaccatgaagtcttctgttgcaaatgacatgtgtatacatatgtgtgtgtgtgtgtgtgtgtatatatatgtttgtatgtgcttgtgtatatgtgtgtgtttgtgtgtatgtatatatgtatacatattttatatatatatgtatatatatatgttatatatataagttgctttcaccaaatccttgtaaataccctgtgctgaacggagaagtcagaaatgggtaatagactacattcaaactcattttcaatttccaaaaatatgcaaggcaccccatttttggtacgtggatgttttttagcatttaatggataacaattttgtatgtcccataagaattattcacagacatctcccaattccattttcagagacttactgtagacttgcttttatgcctgtagcttggatccaagaaatttatttctacctctgcagtccaaaaaacggaatgtctaacgattttttgcaaggcaagtcgaagtgctatggtggaattcttcttagcaagacaagcttcagtggaaggaagaatgtaaaacagaaaaagttctttaagaggtatataaatctacacatcggtagtagtcacactaataataaacattcatttggcatcatatatttttaaagtgctttaaaatgttgacattccttagaaaggagagaatagctctgggatgaggatttttattttacatttcagggatgggttacacagaaagaaagccacttgttcattattgactaagtgtggcaaccagtgtgaccattccctagtggtatttttggctcttggcttagaacagggtatgtatccaggaggcaagagaatgagtaagtgacctactgtactgaaaagaacagacagagatgtagtcacaaaccagtttagatgagggacctttgtttgtaagatgtaaacatcgtaaacaaggagatgctggtagtttttgacattttatgggcccccgtagcttcatcgcttatgtacattgaatggatgtatgttgtgatggaaaggcagtggctgcgtttgccctttcaattgatgggcagccatatcttgggatgaattagccttttgtgggatgaatatgatgcctccctctgccatgacatcaagaatatcctctttgagggttggagagaagttgtctcttttttcctgccttgcaatttatatattaagggttgaccaaaaattgttaaaaatgtttaaagctaagtaatatcctgtgctagcctgaactaaaaaataatgccttattctgacaattccagtttttacagttgaaggctattaatcaatgaagcagtgtggatccatataaatattgatcactgtctccttgccctcctgtgaatgttctctcttaatgacagccaatttcaatattcattagaaagggtgcattttctggcttgcaccattgctgattagtaactagagagatttaactagaccatggtcattttgtataaatagttcctcagatcaaaaagatcctggttattgtctatctggacttagcttacctcttcaacatttcagaaattagagtgttttcttgtttgtgtcatatcctgctcacctaaacattgctactgttaagcattaatcttctcatatttaatatataaaaatcaaagtaaatattcaagagttatatttagatctgtaaagggaagcccaagtgctttgtatgaggtgcgaactagggttaataggatgtatttaacaccatattgtttcagctcaagttagggagagaaggagatcatgtatgcaaaaagtagaacatttctccccttcctattttgtctagaggggcgtaccctcttttaaggtattgtcacatgcacaacatctggccttcagttctcctctccgctgtcatgcaatctggcagaatctctttctgctccatggttcctaaatgcatccatcccattgccattaggattctacttttggcattttccccatctgttttggtaattactgtcagatgaactgatatctctaagttgaaaatggccaccttttaaggtagcacattgtagtcaacttcccaaatcatgaagtctatgtggcttttagtagttgtttgcagaagtaatttagtaactttactttttcttttttttttaatttctaagccactgcaagcacgcaccagccttcagtggcctgaattattcagcagtcattaaaaatgcagtcagtgataaggcagacagtccttgtgcctgggtttgtcaacatatcttgtcctcagcaaagactaggttcactggaagcacgcaggatttagttcaccttctctagaatggctgttgttgggaggatttctagcaacattactataaatgatctgcctgcctctgtgttgtggtttataaactctgtgtaactaggataagctggctttggaagaggcaagccgttctttcactagaagggagaggttattgcatcacccatcagcaagagaggaattcaggagaggtagagagctgtgtggggtttgggtggcagccagctactttccaaaacttcccaggggctgcaatacagccgccaacccaaatgtcattgggataggccagcgtgccagatgccatcacagaaaataacttcccttgcctggcatctgggttcttgccttgtaatccagaagaccacatgctggatcagctggtcccagcggggaccatgagctcttccgtcctctctccctccctgtctgctgagcatttgaatgagtcatcagagtgcagaatggattttggccatgcccttaattgagtgttctgtacatacaataataattaataataatttgaactgatccttctatagttttgtctctggaccaggcactgctctaaaggctgcacagattgtaactcatttacatatgtaacacatatctacatatctcattagcctgaagcacaatagaatgagaaaagtgaaaagcaaagtgcttagactctagatttggaccaactggcttcctatgtcaactctgcctctttcagtataggtgactttagaaagtaaattctgctttctcaagccaagcgtccatgcacagacaagggaataaacaaaacgtggtgtatactggaatattattcagccttagaaatgaaggagattctggccgactgtgtggtggctctagcctgcaatcccaacactttgggagggtgaggcggacagatcacttgaggtcaggggtttgagaccagcatggccaacgtggtgaaaactcaactactcaaaatagaaaaattagctggacatggtggcacacacctgtgaagccagctactcaggaggctgaagcatgagaattgcttgaaccctggagatggaggttacagtgagcccacgtcgcgtccctgcacgcaagcctaggcaagaaagcaagaccctgtctcaaaaaaagaaaagagatgctgatacatgctacaacatagatgaaccttgaggacattattctaagtgaaatgagcttgtcacaaaagaacaaatattgcatgattccacttatatgaggtgcccatagttgtcaaattcacaaagacaaaaagtggcatggtcgttaccaagggctgggagaaaagaggaatggtgagttagtgtttaattggtacagagtttcagttttgcaagatgaaaagagttctggagatgaatgttgggaatggctgtgcaacactgtgaatgtacttaacactactcaactgcagacttaaaatggtaaaaaaaaaataaataaataaaataaaaattaaaagaagaagtaaattctgctttctgcacatctgccagctgcccttgtctaagttcccaaaacagattctgctttttgcttccacagagcctttgcatggttgtttccccttcctgcaatatttacttagtactttttcctaggttactctcctcatctttccaaccttgggctacacacgcacctttaggaaagcctacttctgtgttcttcccatcttgtgtacgttccaaattctgaatctccaataaaatgaatatgcatttctttctctctttttttgtaacttttattttatcttcaggggtacaagtgcaggcttgttacataggtaaacttgtgtgtcatgggggtttgttgtgcagattatttcatcacccaggtgttaaacctagtacccattacttgtttctcccgatcctgtccctcccctgacctccacctgccaagagaccccagtgtgtgttgttcccctctatgtgtccacgtgtttttatcatttagctcccacttatacgtgagaacatgcagtgtttggttttatgttcctttgttagtttgctgagaatgagagcctccagtttcatccatgttcctgcaaaggacatgatcttgttcttttttatggctgcatagcaccccacagtatacatgtaccacactttctttatccagtctatcattgatgggcatttaggttgattccacatccttgctattgtgaatagtgctgcattgaatatacacatgcatgtctttttattatcattttctcctttgcctttcctaaaccatgcagtttgatatatgatgaggctacttctaccattgatgtaggtactgtgggtgccaggatgcccaggaaaaggtggaatcagccagtaatcccagcaatttaggaggccaaggagggtagatcatttgaggtcaggagtttgagaccagcctggacaacatggtgaaatcccatgtctactaaaagtacaaaaattagccaggcgtggtggtgcatgcctgtaatcccagttacttgggagtctaaggcaccagaattgcttaaacctgggagctggaggtttcagtgagcctagatcgtgccactgcactccagcctgggcaacagagcaagactgtctaaaaaataaataaataaataaaaattggaatcggctgggatgatacctcaacaagtgaaattgtcctgtcaagaccatttgcatgtgtgaaagaataaaagaaaaacagaaaacactgagcttctctgaggctttattgccccctgataagaccgtgagaactcatttgtcttatattagatgattattttactcttctgggtctttgatctaggcagttagctggttagaatttgctgatgttgtattcatgtttctttgaatcagcagtaactcacttagggatgaaaatggggcatttggcttataagaagaaaacaaatatcatttatattcatttttctacttgaaactactacttgaaaactgggcccatagagttcgttgtgctaaaaggaacatttctcattggtagttagtatttcaattgtaatcaaattccaaaacttcctacctgttgaaactataagatgatggtgacgattatttgagactgagcctagctctgtcgcccaggctggagtgcaatgctgcaatgtctgctcactagaacatttgtctcctgagttcaagcgattctcctgcctcagactcttgagtagctgggattacgggcacccgccaccacgcctggctaatttttgtattttcagtagcgaaagggtttcaccatgttggccaagctggtcttgaactcctgacctcaggtgatcctcccgcctcggcctcccaaactgctgggattacaggtatgagccgatgcatcctgccgaatctataagatttaaggataataataatgaatgtttacggagcagtgttcatcaggtagtgttctaagtactttacatatattaatgatcttcactatgttatacttgtatatcaccatctgtgatcatctgaagcccttacagtttaagggaaaatctgcatttgatacatatagtgtgtgttaaagaaacatgttaaagatgaaggaggagtatgttattttattgtattgatttctgtttctaaatactggggttttcgtggtgttttttgtttgtttgtttgtttttgtttgtttgttttgagacagggtctcactttgtcacccaggctggagtacagtggtatgatcacagctcactgcagccttgaccttctgggctcaagtgatcctcccatctcagtctcctgagtagctaggactagaggcattcaccaccacacctggctaatttttgtagttttgtttgtttgtttgtttgtggagatggggttttgccatgttgcccaggctggtctcaaactcctggactgaagcgatccacctgcctcagccttccaaagttctaggattacaggcgtgagccgctgcacctggcaaaatattgttttttgaaactcttcttgaagtactaatgttgctttagatcttaaacagcagcacaaaaagtttctaactttgttggaacattctacttttcccccacaccttcccaaacaattctcttaatatacaacaatatctgttctggctatcgtgaaaattaagccactggatttgggttggaaaagaaggtttatttagcgcagtttttagtatttatatcagattgccatttctggcttgagacccgaggcagaagtatcccctgcatttggaaaatgaaaaatccactggaggattgattattcataaccctgaaatgtattgccccacctctaccataaatcacacggagtttttattctcattagctgaattctggcatctcagtctcggcactactatttattctaattctctcagcttgagtaatgggtgtggcccaagcaggaagcaggtcacctcctggcccgttggactatcttggaaagagcatgtgattccctgtaggattaggggatttgcagttcaatgggcaaattatgcattccaacgtctaagtgtggttgtttaattaaaccctttggttcattcaagatgactaaaatgtttcttgaaacaggacatcttgaaagttattaaaatttcacagcaaacacttttatggcaggaacttttatgaattttgtttgggttggggcattgcaagagggttacttaaaatgttttatctggaatttataataaagaaaaaacatttcttctttatgttggtcatattttcagtaagagtgcattacaaaaaatctacatctggatgacaaatgtgatacaaatggacaaatatatatgcatatacacaaacacacacacatgcccattttctcatccccccttctttttctctttcaatctgtctataaatgtagatactcacatatacatatatgtttatacatatattaaatatgtaaatatgtatataagtatatatgcatataaatatacttatatgtgatttgtgtatacataattacatgagtgcatatatacctaaatatgtatatctgcatatgcgtgtgtatatatttaagggttttcaactttggccctcttgatactttggattggtaatccctttttttgtgcagtgtccctgaccactagatgctattaccataggcacctcagtgataacaataattgaaaagtcaccaggaatttccaaattttccttctgttgagaacccctgcttattgcttggcacacatgcgcacagagaaacccatatatgtgtaggtcatgcacttactgtaagagacatggaaactactgtctcctagtttatccccaaaggactgacaagagtgttcactgaaaattcagagacagggttgcatgtaaatgtctgaataaaacacatggaaaaataaataataggcatgacatatcatcattggaaaggaaggtaccttctgatgcagacaggttgtgccacatgacagctgtgtgagcttgggcaagaaactagatctctctgagctttagttcttttatgtttgaaatgggcaacatcatgattatttttcaccacttgttgaatttatagatacagtgtacctccccctgcatcctcattacacattgactaaggaaatggaatggtctggaacacgtggcaacttggacatggggaggtctcttcgccattggctgagagtaagctgaacaaactttccatggtgacagctgcaggatgctcagcatgcagtcaattcagtccaacatccgtgcttcgtgatttgcatccatgtgacttgaagcagccagttggaccaggtttctgattgagtggccacgtgcatgatgggttgggttggactaactagttgtctgcaagaactggctaaacggctcagccaaattttctgtttgttgattcagacccgactgactttgccaggtttggactgtgctggtgagagagatatggagtctgcggacagtttgcaagcagtgcctctcgacattttcatcctgcatatggggctgtgtcggccttacctgtctaccttctttatcttcttccttcatttgttctcttcctcctcctcctcttgtttttgttacttggattttcaggatgtcaagccctggcatttttaatataaattggtaatataataatatattccctttattctttgtcattagctgaacgttttaggaatatcaatatagaatacatttgaatgttttcattaaaattgtaacacacccagtattaaatcagaaagtgaatgttcagcaaacacatattgatctcttgctacgtgccaacaactactccaagcacttggcatgaatgtaccacatttattctccaaaccagcctataggcgtggtcagggtgtgccacgtgacagctgtgtgaccttaggccagcaactagacttctctgacctttagttcttttatgtatgagatgaagagacatcatggtcactttgtaaaatttattccaaaacaaaaagatgtggaagaaaggcatattacctttggttgacattatctttgtttgtaggtgaagaaactgaggcttaaaaaattcacatatgttgtggctaagcagaagggctccccaggaagttgaccccttactctttattagtagtagtattaatacattttgagagaggctgtcactctgtcacccaggctgtaatgcagtggcatgataatagctcactatagcctcaaattctggggctcaagtgatcctcccagctcagcctcccaagtagctgggttacaggcgtgcatcatcacatccagctaattttattattctttttggtggagacagggtttcgctgtgcttcccagactggtcttgaacttttaggctcaagtgatcctccttgcctagcctcccaaagtgctggtattagaggtatgagccactgcatcctaccccttattctttgttcttaatgattatgttataatctgggatttcacataatcaaaactcttaatttctaatggatttaagagattcattaaacctctgaagtcacatacaaaactcgataactaacatacatttcttttttcctggagagaatgttcatagcttttaaatcaatatctcaaaatgatctttgttttcacagcaagattaaagataatcattatgtaataaaacttttattttctgtttcttaggtcagtctacagctcaatcttaaacagcagtattgtcatcaaagggtaactccagagaaaaaaaatcagagtaaataaacatttataataatatatctttcatcccttcttcagagtctgttctaggaaaatgccaaagtattccaaaaaaaaaaaaaaaaaaaaaaaacacccttgggcttttcattaactacacttcagtccttgagattatcttgatcttgaaagttgctggcctttgagcaacttcttcaaaccctcaagatgcatccccatggaccatgctggtcctttttcctgagccagccatttcagcacacatctttgtcatttcttgtcatattgagatcaagtttggccatcctctttgcaaaatcatattcagttttcttaagtaagattgtatttttggcatgcttccattagagtcagagccagcggtggctctcagttgcaatgctcctagagaaagggaactttaattaggacacaatggggttggcctagggctcgagttagattcagtattcaaccaatgttgctgcttaagcctgtaaatgtatggtatgcaacttgtgggtactttccagttttcactgactttcttccaatattgtgtagtgtgtaaagatcggaggtattaaatccaggacctgggaggtcatcacactcgaaggaggcaggctgggtcatcagacatatggctgtcttggttttgtttccttgttcccacttctgctcatgatgggcctaaataagagatattcctctactgtaagaaaagctccgtatcccaagtgaagctaattggtaattggtgtttcatgtcagaggcacagtagggagcagtggggattgtggcaaagtgaggaactcatgcctgccttcacagtgcagctgctcctcagctgcataccattttcatgaattagaaatataccagactttctgattgtttacctaagagagtctgaaaagtcttatttctaggtgctgtatgtccatttaattgttgttacttagtctagattatttttattgataacatagaacagtggtcttacatgtctctctagatcctaactaaaataataaatatcttatatttcatttgaaaaatatttcatatagttatagaattctagattttgagtaattttctttgagagctttgaagatgttatttcattatcttttgtttcctgtactcttgagtttttttaaattttattttaggttccaagatacatgtacaggatgtgcaggttcattgcataggtaaacatgtgccatggttgtttgctgtacctatcaacccgtcacctagtattagttgaatgtttgaaactcaaggttaaaccatacctgggggtgttatctggtcttcaattcaccactgttgaccaacagaggctattatgatttgcaaaacgtattttcataatcaacaagacaaaaataaataaaattttaaatctgatttttataacttttctgagaggttaaacttttggagagctagagaaagagctatgctgataaacaagcttacttagccttatgtttttgtttgtttgtttgttgaaagatgtttgcctgctcacttaaggatacttagcattagagaaaagtagcttttttgaaaaaagaaaataacttcgggttgccctttttgtccatcagtcttgcatagtgctttagacagcacttcatacactcatgcaactcttcacaaattaccaattactttcccctttgcgtttatctaatttaatccctacagtcttgcaaatagatattcaattctcccagcccatagcagcttgaaacagttcaacaaacacaattagcccatccctgaaaaaaagtatagattgcagtgtaaatagaaatttgtttttccacttcaagtgtggcacaaattatcacccaccttagatgaatgattaattccacaactgttaagtatgtttttacttttatctaagcaaatattttgagagtttttttcataacttagtttgatacctaagctggtaaatgttttgttcaagtttgctgaagccaagactaatttagaattagggaagttaggactgctttcaaatttgagagaaaatttggaaggaatccttagcctctccacagccaccaccctaatccaatgcaatccaattgcctctcacctgggcagctccagcagcaccctccctggattccctgtctccgtccttgctccctggcatcccccacagcaaagcagccatggagattgttctgaagtgataacccgaatgttttcctcttgaatgtgtgatttttttagtggcctcctgttgaaagcagaattaaatcaaactcgttgttttgctttcaggctctgcattatctggcctctctccagtctctcccttataactgtaccaaaccatggtggcatccttccttttccacaaacgccaagcttattatgaacctagggctttttgttgttgcacatctatttattgtcagactgtatggtcacctcctttttttttttttttttttttttactgagtttgaatgcaattattccttccctttcctccttggtaaaacagaactcttggagttttgttgtgctgactgcggtggtatcagcaccaaggacagcgcctacgtagcacatccagaggcttattaaatatcaggttcaacgactggctgactgactgatcaaagagagctacagcataaaggcttcagagtcaaagttgaactccagttctgccatccacgagacaggaaagttatacaacctccctaaacctcaattttcccattttacgacagggatgagaacagtgtctcccacattaggataccctatgtattcttttcctattggtccccagcaatcacaaatctaattggcaggtaacagtgagcacttgtttagtgcatgtgtctgtagtacaatggggtccttgatttaggctgcactcagtcatgtgtctgcaggtcagctggccctcaagtgaggaggctcagctttggagggaactctggtccctgtgtctcaagtcctctgctggagaatagtagctagtcagaaatgttctcttggtgaaggagaagtgcaagagaaacttctattgtgcaaacgccttcaagcctttaaccgcatcacactcgctgccggttaacattccttaaccaaagcaagtctcacagacacacccgcagtggaggggacactcacagccaacgggtaggaaagtacactctgcccatggaggtggagaaggagcaaatactcctctatggtgatctaccacacactaagagttgtgcaagataatgagtgttaagttcctggtatgtgataggcactcagtaaatgttagctaaagttgagaattactaatttttctgtaagaccctgtgcctgccacaataatatgaaagtaatgaatagttttatgttaacaaaagctaaaagcccccaggtcatccttaaatgaatgtatatcctgattcaggaatgccgtgattttaagaatacattagtgactgcttgtcatttacacatctcttaatttagctgaaatggaatacgggaaacatagcctctttaaatccaggttaagtacatttccattgcagggagcaaggtcggtgctgttcatctaggtattttaaaatgtggttccaaacactgcatgttctcacttataagtgggggctaaatgatgaggactcatggacccatagaggggaacaacacacactggggcctatcagagggtggagggtgggagtagggagaggatcaggaaaaataactaatgagtactaggcttaatacctgggtgatgaaaaaatctgtaagacaaactcccatgacacaagtttacccaaataacaaacctgcacatgtacctctgaacctaaaataaaagttaaccttaaaaaaatagaatatggttctggaaggaagaataaccgctgattttaggaagaactgtgaatgaaggcaaagacttcagagggagatggctctcagttttgagccttggtttctttatcagttagggatattaccagctctctgatagggtccctgtgatgtttagaaaagggtctacaaaccattaacacagtgagtggcacatgaacggctttgcaaattcttgctgcctttcctacctactgctcactcccttccttgttcataaaggaccgtgctgttggccattttgtcgtcagctcttctagtaggatgccctatgtgggtatcagaatacatttgtgcagaatcttctagctgagtcccttcatatctttccagtcatttgggggaaaaggtaggatctgaatgaacagagactttcacgcttacacttgctggcttagctgaattaggggtagcattacttaatttcacccatcacagatggttttacctgtcatctcagccatgagccaccttccttccagaactaggcatttcttctttatggtgagtgaacttagtttttgaccttcctttttataaaacactaatagttgcttataggaaattcaagtactgcagataagcaccaagaaaattagagttgcatgttattcatcatccagagataatgtgaattagcattatcattaattgatttttctgtatgtctaggcagagatatatcagggaaaatgctatttataacagttgcctttttgagtaatcatttagctgtcatctatttgtaatctgtatgtatatcctacctatatacataacaaggcaaatgttgctatgtatagccaacagccatcgcccaagaaaggcgggtagcaccatcttgttctaggagaggtccctttgtctgtggaatcccagataggtttgattttgcaagactgagagtgggagccagggaatacagcactgctctgcataatagagggagggaaaagtagtgttccaggaataggactgataggagagggaggggaagagagaaatgggagagggaaaggaaggaatcaatgctgaaaggaacagaaagctgggggttaggtggtatcaccaccaaccttcagctaagttgactacatttttaaatgtttttgcaagggtgggtttgtttccattcccctcttttttcccttctcttcattgtctttttctttccttcttttctttctattggatgaaccctgaaagtggtgcaatagagaataaataagataggaggagcctggaggacaataagaacaaaatctacctgagaatttgcaggaacctggggacatcactagacttccaagggccatagaaattggagctttataccaattttacttacatcaccaaggagaaagcatttttccagctatctgaattctctgtctttctctctgacttcccacattgtatatcaactgtttatatgttttgtagttttttaatatagctatatattatgaaaatttccttcttcataggcttctttctttaaaaaaaaaaagagcctgtaagaataatgaaagggctgaagaataaaatcattgaatgggtaccagatttatttttatgtattttttatttttggcacagtcccaattgctgagctttttcttgtgctatctctgattttccaccataacaaaccgacagtgatgagcaacattgtgtctatatcttaagcacacccaggactttctggagtcagttcctacaagtggaaatacttgaataaaggttatacaaatgtttaagccttttgatacacattgttaaatgatctcttcagaaaggttaaaccaatttacactctcaacagtagtgtttaagagactctttctctaaatctcctttaataatgaagagaagcattataaaatcctttccaattgccatttttataaaaaatagaacctatttgttttgcacgtatttggtaactctaagaatccctccccctttttttcccatagggttttgaaccagttgtgtttcctctgggaaaatctgcttcttcatgtctttcaagccttttattgattttcgagagaagtatctttatgttttgtttttaaaattcaaatgtggtgtttctaaatggtatgtgaagcatgatttcacttagtagacatttgtggattagccattaggtgaaaaataacactgaagagtaaaacaaatgctttttttgctgttcctgggagcgtgggatgcttatattaattgtttactggtgaccatggatgctgacacaatgattaaatgctttaaagccagcttaatgatataaagccatttcttcatttgtgtcttctaagtgaaatccttcctaagtgaaccacaagagtttcctgcttcatcgcctcagctgcagcctcagctgctgtgattacacttaccttgtctctgctttagttagtttttatcccctccctccaagaaagtaaactacctgaaggcaaagactaagagtatataccccagggacggggatcataactatgtacacagcagacactgagcaagcatttagaggagtgcattttaccattagactcttgaaggacgtcatactgaattttcagaattttttatgtacccagggcattttatgtgaacgtatttaccagggagggtcatgctgtgtatgacctttatgtcattctaccaaagaatcaggcaccaagacagctgcagtttctctggctactctgtttccttcttttagggaacttaggacactgggtgattctttaaaaaaataataacgaattaactttttgaattgacaaagatggtatacatttatcatgtacaacatgacgttttgaaatatgtatatattgtggaatggcgaagtcaggctaattaatacgtgtattatctgatatacatttttgtagtgaaaacacttaaaatctactcttccagtgattttcaagaacatgatacatgtcattaactatagtcaccatgttaaacaaaagatttcttgaaactattcctcctatctaactgaaattttgtatccattcaccaacatctccccaaccctcaccaaccccaatcccaccccagcccctggtaagcaaacttctattccctacttctatgagttcaactatttcagattctacatgtaagtgaaatcacgcagtatttgttcttctgtgtgtggcttatttcactcaacatgacatcctccaggttcatccacagtgttgcagttgacaagaatttatctctttttagggctgaatgacattccattgtagatacagagcatacttctgtccgttttttttttttttttctgtgggggatggagttttgttcttgttgcccaggctggagtgcagtggcgcggtcttggctcactgcaacctctgcctcgtgggttcaagtgattttcctgcctcagactcccaagtagctgggattacacgtgtctcccctcgccgccatcaagcccagctaatttttgtatttttagtggagacgaagtttcaccatgttggcttgcctggtcttgaactcctgacctcaagtgatctgctcacctcagcctcgcaaagtcgtgggattacaggcatgagccacagtgcctggtcatgtccattcatctgtcagtgcacgcttaggttgattccatatcttagctatagtgaataatgctgcagtgaacctgggagtgcagatatcccttcaaaatactgatttcgtttcctttggatatatacacagtagtgggattgctggagcatatggtagttctatttttaattttttaaggaacctccataccatttttttcataatggctgtactaatttgcattcccaccaacagtggggcactgggtgattcttaaagagagtcttcaaggaaaatgcaaaagctctacagtatttgggtggtgagacagaaagtggagaaggatattgtgttctagcacactgcaaacatggttactgaatttgaaattcagaaggaagagaagggatttattttccagctcagaattgcaggtagagcctagctatgagaactcctatttcttacatcatcaaaaaggaggaaggagctggttctcctttgagagatttttgtttgtttcccccatatctccattcatttattcgttcattcaaaactttaaattttaagcttttcctccattgacttgaagtaagtggaaatataacttataaggaaagtggaaaacaaattacattcaccactctgtgcttgctcattacaagtaaaggttacacatctggctggggcagaggtcttcaactgacagttcctaggccttttgtactttgctgtctttttgctgtttcatgttggaattcatcgtcagcactgaagtatctggaaattttgcacagatctttatatttctggcttttcattaaaagttggaagatctgacaaagcttgtccatcatccaatataacagcaatctgttgagctttggtagttgttaaatgttttgggtgtagcctgagtgtttcagttaacctgctttactcattggtgtcagctacttgtcctagacgtaacctttttcatttacatcctttttttttttttttaaatttgagtcacccaacgctaaaggtatttaggttggctattattatttccacttttgatggcattaggtatctctgggctaatgttacatagtaacgtcagatctgggatgtgaacgtggtacctaaattcagaccaagtgatctttccctaactcatatgacctacccatatttggcagagccgttatcttagagcctccaaaaatgcatgtgtgtaatcacacacattttgtaaattttgtaaataagcatgcacatatgttaaaggaagttcagcatcttgagcctctgataataagcccttctgggtaaatgagtgttctgcatcttttccatctttttcatttacgctcttataattacctttaaacacagcatcactggacacagcaaacatatctaggtcaatctgtttgcattttgatggctccgctggataaaatctcttctccactttcttgtttctttggaagaagcagagaccaagacaaaagaacctgtggttcatagtggcttcaccattcacaggtattctcctgggggtcaaatcaacaaatcattctgtcagttctgtggagctattcagaaattcgtgttgatgtcagtggcaacaaggaagagcggagacatgtcaggctttggtttctggttcattttcactctaactgctttgcatggtgttctccggcttgacaacccctcaacctcttccttgtccttagggtaaagtctgagttcccaacgagacttcaggatcaatcctctgcctatctatacatcattgaccttgtcatcacttcctttctaaccatctgcaaaacattaaatgcactctcacctctgagtcatttctggatgtctcctctgtctgaatgctctcatttccagcctcttttcctttttctgttcagctcatttctacatgaccatcttgcctatgctttgacatcacttctccttaccctacttctcaggtggcctagaaacccctactccatcaccacatagtattctgtgtcgatctatggagcctctcgttacttaccttgctgcctccttgtgactgggagttcatgatgggaaggaatcttttccttgtgtctccaacactgagtccaaggtctgcacatgagagctcttgagaaatgcatattggaggatttaatattttgttcgttcattacctgaatctgaagagtctttatataggagctctcttgtatctagaaaggggactattacagtgtgagacagcaaaggaagaattgccttgaaaatacgttatggtgttagcagggatggaaagtgtaaatcctcctaacatgtttttgagagtttacttcactttgggcattgtgttgttgtgctaagaatgccctttacttccacctgttattttaattctcacatcaaccctgtgacccccttgtttgtcaatgagaagaccaatgagaaaagaaatgaaatagtttgcctgaaatcacacagttcattgttggagaaacaaggatcccagaaggagctgtttggcagcaaggactcatagtattaaccactccataaagaaattcttgactcatttgcctttagcccttttcttggattactaattcagcaggaagaccaaccctgggctccttaggttaatcgggtttattggattatctagcacatttcttagattatccaagctggaatctccattgccaagatatcactggcctgattaaacaagctgcggtctctaaagactccaaatgtcatgttcctgtctctctctctctctttttttttatcaatatatgcccattttaggtgttattttattatttctctaactgtaccaactcatcattgtgttccaaaggacctcccaggtatataatcctctctgttgctacttaaaagaggaaaaatttttcttttcaatcctgtcttctgattggaggtgaaagccattcaaatctaagttagaaagacattcacaagccatttttgcaattgttattatcctaaaactaaattataggcattacgtctctgaagcattattgctcatacctagaagggtgctttatgttgtatttcatacaatgatgaacaagaagaaaaagactggaagtttagaatgagtgattttggtctgaaataggtatgaatttttcaagaatgtggtcactgcattttgtaccatcatttctctagacatttcaaatttcaattcactcattaatggctcaaccgttaataagaaggtgttttccacagttttcttgagttttatttgctgttgtgtcctgagtgtgcataattttggaactttataacagtagtgtttttaatattttattcataatattaacgttagctgttatttagggagtatccccaatgtgccaaaaataaccccatctccgatctttgcaacactgttgaaaaatagaaagatagtttctattttagacaatgaggctgagggtagagatatgacttgcttagtgataaacagctggttaaagcctgagacttaataggaaccaaaaattgcctgaccttaaactctgtgctatttccattctatcacactgctgtggaaactttgagtacaaaaagatttcgttaaaaggatgttaattgcagagttgtaataatagtgactacttggtaacaatataagtatccactgataggggattggtttaataacattttgttatatccacataatgcaacattatttaatgtttaaacatgcactttaaaaataagtgaatatgtattgccatggcaagatgtccagcttatatttagtgtaaaagagattgaaaaagaatttgcaccacattatctatttttaaagcatgtttatatttgtgcatgcatgggcgtatccctaagcaaggtctggaccagcactgttcagtagaaatataatgcaagtcacatatgcaaagtaatttttttagtggttgaattaaaaaaataaatgcatgaaatgtttgttttaataaattttacttaatatatccaacatatttcaatatataatcaatatagaaatattaacaatatattttacatttttttgtgctaaatcttcaatgtacatttttatactgacagcacgtctcatttcagatcagtcacatttcatgtgttcaatagccacatatggctttccgttaccttattggatagcactagtctagaggaaatataataagatcataaagtgttcactttgggatggggtgattatgtgtgttggtgttagtttattgtctccttttgtcttatttgcatttcccaaatttccataatgaatacatactgcctttgtaatttggaattaaaatacactgttaaagtcatcattcatttttaatagggagtggtgagcttctaaaatgcactgttaaaaataaatacatagaatgtaaatccgtgacctattttcagtcgaggcgagaagctggagatggtatgaggttggctctcctctttactcccttgccttccagctctgtaacccctgctcccaaaagccaggcctctggggttctgatgaggggagaggttaagcctcacctccacagtcagcgagcagatctctgatgaagccaccattcctaccagaagttctgaggtttggcctcagattcattttcaatctctttgaaagacaaaggcggctgtcatgggagaagcctacactagtttgtctcaatcttttatggcattattgctgacctttcaccaaggagcctttttagaccttttttcccttcctaatcaccattccccttccctcattaaattttaataccacacatacactgtatgtctgtttataccatgtaaactgtgtgtgcgttgatgtatggtggccttctggatggccacaaaccaaagtcatatctaaaatttcttaccctcttgtaactaagaatccatttccacccctttagggtaaataatcgctccctgtctcattgagaaggacgcccagggccatgttcactggtgccaaatgtcagtaatacggttgtcctgtgagttgcatttaacttcgaatcttggaccagtcaccagctctctcaccgttctacgcacacatctttgcctttgtggatacctgtcacttccctatccccactagggcatctgaaagtccatcacacccgggaaacctacccaagtctctctccctgaccacatgggaaacagcctttctgtttctcctgtggcatgtgtcatggctggcattctctgttactcgttctgatcctgtctcctctccccctctgatccgaccctcctggagaatgggatgctgtataatttcatttcccgtgtgtgtctagagccgggctttgcatgccatcgtccttcagtgaacagttgtgaaactgaacgaaattgccttcggaaaaccctttccggtccaactgtttctctatcagaaaatctcattaagacttaatcgctaacatcttcccatccccggggtcatgctgtaatccccagctgagagtgcgatccctgactgggaggaagtgagagtatcatttctttcccagaacccacacgcttcctgtgtatttcccaccacccaaaggtcaccacctggggtaaaattacatgcaacctcatgagacttgctgcccctctatcttccctcttttatttctgaagtcactgtagggaaaatgtactgattgcaaactgaaatagcagccactgggagctggactggtatggctgtcagccataccccccgggtttcacctgcttaatgagccggtagcccatgctttatccagtagagacctcactgtctcccattccagcccaccgttgcccacccttgcttatccacacctaccaagagccccttcccgagaactgctcttccaaagtgagattgtactcccaaccctcctctgtagccatccttgggtccagtgtttatttctttgtggccaggaaatctctcccttgctctgttctgcatagatgttgcctgtgttagaatttcagtagaactctgcagatttgaatggaagatttgagggctgcaagagctatcatcgttgatagcaagcatttagctaaggaaattaaattggaagtccttgcattctggctggattctgttactctttgggcagggaatgatttggtttcaaggagattccatcttcgtatctcctgctttcaagggaggaaagggggaaagaaagctgaacagagcctaatgaaggaattctgtatcgacacaactctgacatttgagatgttcaatgtaatcagcacaactggtagctttaggcattgatcactgtgctgaaatataaaattcagttggccatattctgttcatgaaaatgccttttcataattcactgcttccagaggtaccagcgataatttcttgactattttattctggagagctttaggtatggttaacaatgtgccatgtacagagaggcatgtatgcacaccataaagatcttaaatgcattttcagttcagtgtccttcttattaattattctagtcactttaatttattcagcctccgtattttatacattaaaatgagtgaaaatgataagaaatattaatggttgtaattattgactgtatatttgagattcatgtctaaatacacttaacttgggaagatttgacattctgtttcactgtgtgcattatttgcctgtttcatcttctatattctcctaaaccctctctctctctctgtcaaggggggaggcgaattactgcaagtagattatgaaatattgttgtacatgcacgtaaaaatatatcagtactggcacatctgtaatttactcataagtatgagattcatattagagatctatatatcatataagcaaaataatatccatcctgtactatattattttactaacatgatggctgaatttcaaatgaactgcaaaggtcatggttgctgttctattagagccatttaatctcatttgtctccccattactaacctcaactttattagttgctgcaactactgctgattttgaaccgagaaagggttcctctaactgatgtcatttcatgctttgaatttacaagtaagagaccctgatttaaaattattagggctcctgggaaaggagaacattaaaagtttgcagtggtcctctggtttcccataaggtgaagtttttagatggaagaaagatgggtcctgtttcacctatgacatattgcatacctttccaagcccttgtattccctcacctcttgcccctcttcaaactagtgatcacgtctacctttgagaaaactagtagctaaaatgaaacaaagctactttatgaaaagtccatgagaagcaatttaacctggttgaccatctccatcaatctgtcacctggagagaagctgttgacaccacatgacctctcctccaccatcacgctatgaagttatcacttgagtaagggctttctctttgatgctatacaattaaactgaaggaaggaaggctttcgctagtaggaaagcaactgcaaagagaggcttaaaccctatggaaacaccttcccctctcaggcacacacatgcaaattatctttaaccaaaagcgaatgggttccagtcgttcagcacacatcacatataagatattcctagggcaggaactttttttttaatgagtgagacccctgtagagttcatgccattgcataaaatattgcagccatttgcatttaatggtgatacaaatactgctttgaacactgggaacatcatttactgagagaaacaggagatagtcagtataaatctccaatgtaaaaaaaaaaaggattaagataaaaagtagtttaaactccaacactttctctgtattttttattatttctaataaacaagcctatagcttttgaaattttatcactaacttgagaggtgactgttttctgatgtttatacatcactcacttagtcatgaacttgtagtaacaatgccacatgctttatcaatagctggtgagttaattgggagggagggaaatgttttcttaaaaaactaccttttctccagaaaggataattttatgtgtgtgtaataagaatctagtatacctggtgtattaggtgcttaatatattgtaggcccttggtaaataattctgggataaatgaatgcctgccaatttatactgtcattatccctcccctccctgatttagtaatttcaggctcaagtagttgatcccaatgcttttgtgcaatgtgtggcttgtcttttgtcattgtttataagctccataagaacagagactgtctattcactgttttgtttctgtaaatatataaccatatattgtgtatatggatccttaagcatgaaggcttagaggagataatgaataacacttttatacagaaatcaaaccaagactttcatatcattatggaatcacatgcttttagcgtaattaaagttgttgcatatagaacaaataagactgcattttctttagctgttaacttggacttgccagatatccagacatgcttcacttttggtttgaattaacaggtgaaataatacagtgtgtgttttgttaaaattttattaaacgccgctcttaaaaattaagcaagaaaatgaaagaaagaaacaaaaacaattaaccaaagatcacccacaaagctcccaaactgttttgttctgggtgctaaggcactgtttgattttttttttcgtgcatattgatgtactctttccccgttaactgcttctagtctccctggacctccaaggctgcatcttcagggaataactcatcgcatctccattatgtgtcatgtagagacgctatgtaggtaagataacagagtctggctaaagggcacgtttggtgttatattccattagtttattgatttttttttaagtttctctaatgttctaatgagaatattttccactcaatcctgaaggagtccaaagctttttacgaacttcaggatagaacacacagggactgattccctaggctgccgaacagcagggtccttggaaagaccaaatggaaaattgcttttctatgaaccccaggtgcaagagttagggaacccctatctaattaagagctgggggagttctgatgcagtcactggggttggacccatcattacggtgaatgctaggctctggccaaacacctacagccccttcaagggtcaagaaagttcatggcaaaagatttgagtcacttcaggggatggtggaagtttctcccaagcctaccttggcgtctatgactccacctgaaaaatggcccaaaatggacaataaaggaatttggagggacaatggcatcaagtcaggacttcctctgtaggacacatatccaaagagccaacccactagagctccagccgcagttcttgcttgttttggctgtgtgaatttgggtaagtcacttagcttctctgagccttagctttcaactttgtagaatagttctgagcattaaaggagacagtatatgatgtataaagtggaattgatgaatggcaggttctcaataaaagttggcttgtggttatatcattatcatcactactactgtcatgatgtccagacatcaaggcagcagaatgtgtcctccatgtgttaacctggggcccagcctctatttggtgcctaatagttaaaagttggatgcttgttgagtaagtgagtgtatgagtcccttgtcgtctccctgccaaagggaacacttgatcagcataggagataactaacggcagtaactttgctctgagctcttgcttcttcatcaaaccgtgctttaaagacttccctgtgcagaggcagtatagaatgaggctcaggaactcaggctctgtaggctctctccactcacctctttatgtgtctgacaggatgccagtccaagcatccttttccttattgataaaaataggcatcatgataataatagtatctacctgataggatggtgaggacaacaaagtgagatcacgagagcctgacactaagaatcccctggagagctttgaaagcattactgatatccagaccctctccccaaagtcttggattcatttgttcaggaggcaaggttcctttgggcatcaatagtgtgaaaagccctccaagtgattctaatttagagcctttgcaagtcactagttaaggggtggtagggtggctgttgttaaatcatcctaactttttgtcttttcctgattatccctttctctgttggttcctttttcacatttatgggaaaagcaattatgtacctttttggaggtttcactatgttttccttttgctgggggtaccatttctgggaaatatgacacagagaaactttgtagtaagtgaaaggtaaatatagttatatatctatagatatggatctgtatattgaaatttaggaaatgagttatttctactgcagtaagccacattttcatgcatgcatagcctgccattttatggttgctgttgttaaatcattctaatattctgtcttttcctgattgcccatttctctattttttttttcatattaatgggaaaaccaatcatgtacttttttgaaagtttcactttgttttccttttgctgggtgtaccatttctggaaaatacggcactgaaaaattgcaataagtgaaaggtaaataactggatatatgtctatagatgtggatctatgtattaaaatttaggagatcagagttattcctactgcaatgagccacatttgcaggcatgcatagcaccccactttgtggggcacccattgctcctcattctgggtccagctttgattccctgtggctgctgcagtctctggctcatctctgcagctttgatagctgtctcaaatacaatctgcaatctatcaaggagggcgtggaggtgtcctgaataatcagcaggtgtcttggttatcaccaaggagagggcatcatgcccggcatgcatggatggcagaagagttactgcaaaggcagttgtaagctcaggaatccaattctttttctaagttagtgctgaaatgtggctgactcagatgtggggtgtcaggatcatagataggacaagagagaaaacttgtgttcttatttgaaagccacagcctgtgtggagaggcctgcagttcattgccactggacaagagagtaaaatttctgggacctccacttactctaggaagtgttagagggtgataggaaaggagtttgtgcagacttctgcagcctctgcaggtggaatgactgttctctcctctagtctcttagagtctgtccacaacctctgaatagcccttattccttggtgagtcactcagcaaatgagaaattaaatgctattgtgcatgctttatattatgtgtatttcttctctgttacattctaagccacttgatggcagagccgtgagttactttgctcaggatattcagcaccaggaaggtactaggcacacatccttagtacccaggaagcacaggggagttgaagatgctttgaaagacctgtttggcccttcaggtagacatgcatgggccctgagaagccccagaatttcgatgttctcaggaatcatcaggagactagaagacattgattctcaaccctggctgggtagcagggctccttggagagttttaactagtcttgatgcctggatcccagaagagaccaatttaaaccagtgtctctggatttggagccagagtacctacagtattgtagttccttaggtgctttgggttcaggcagggctgaggaccacagctccataataaaaggatggctgagctaaaaggggtgataagaggtagaaagaggctgggaacggtggctcacacctgtaatcccagcacagagaggccgaggcaggtggattacatgaggtcaggagttcgagaccagcctggctaacatggtgaaaccccatctctactaaaaatacaaaaattagctgggtgtggtggcacgtgcctgtaatcccagctgctcaagaggtaggctgaggcgggagaatcgcttgaacccagaaggcggaggttgtggtgagctgagattgcaccattgcactccagcctgggcaacaagagcaaaactcagtctcaaaatatatatatataaattaaaaaaaaaaaaaaaacaagtagaaggaaggagtgatacaactgaaaggagaaacaaaacacagaaagatcttggcggttttgttacatcttcagccccatcaaaccaacacccttcaagctagacactttgcttttagcattttgtcattgttaccctgtttcttactcacagtgatcttaaacaaaatgactaccctctttgtagcaaaggaaaggaagcttataaactgatgtgctaggctcctggactccagacctcaagcacttagccagtaaactgtgttccttcaaaaagacaaggtaaatatgaaggaaaaagggagtgaactggacagaagaaaaaacaaaattggtaaactcaaggaaagctgataggcactaaagcaaaaacaaatgagcagaattcatagttgttgagggcctccaagatcttatgagaaactcagaaggtgcaaagcagacccagtcatctccagcttacaacagatctgggatggctcacagtagtccagtgtcttgctcaaactcacaaagctaagtctctgagctagtttttctgtaagggccaaaagctaagtatgttagtctttgctgaccacgtagtctctgccacaagtattgaaatctggtattgtggcagaaagtggccacagatagataacatgcaaagaaataaatgtagttgtattacaataaaatttgatttatggacactggaatttgcatttcatgtaattttcaggtgtcatgcaatcttatttttctttggatttttctcaacttttttttttaaaaaaatgtaatcaaccattcttagctcttggctatatcaaaatagatagtggggcacatttggcccttaggctgtcatttgccagccctggtccaaactttaaagtacccagagggtaaaaagttgatgagaaagcatagaaaaaaattgatacatgactatttgagacatttacccccagtccaccttcccacagaaagatccatcaggccaagagtccaacactttccatcttccatgactcaatgccaccaagcagttatttgtagaatccatttgcggttttcaaaccataggctctggacttcaaagcaggccagtcccattctttttgtcttgaaatgagtataataagctcccagaccctttgttctagcaatatttattgaattactaataaagactagactctgttctgcgcactaagggtgcagtggttatcttagtctatccagttgccatagcaaagtgccatagacagggtggcttagacaacagaaatcttttctcttgcagatctggatactggaagtgagatcagggtagtaggatggtctagttatcatgtggtctcggtggcttatggatggtggccttctccctgtatcttcccttggcagagagaaagagagagagggagaggaaagaagtgggtgtggagggaagatgtcttttctttctttttctttatgttttcttttcttttctttcctttattcatttatttatttgtttatttatttgtttattttagatgtagtcttgctctgtcacccaggctggagtgcagtggcacgatctcagctcactgtaacctccgcctcccgtgttgaagcgattctcctgcctcagcctcccgagtagctaggattacaggcacccaccaccacgcctggctaatttttgtatttttagtagagacgagtcttcgccatattggccaggccggtctgaaactcctgacctcaggtgatccgcctgccttagcctcccagtgtgctgggattataggcgtgagccaccatgcctggccaggtgtcttttctgataaggacactaatcccatcaggagggattacctttgatatagtttggatatttgtccccactcaaatctcatgttgaaatataactcccaatgctggaggtggggcctggtaagagctgtttagatcatgggaatgggttcttccttgcttggtgctgtcttcacgacagtgagtgagttatgagatctggtgggtttttgttttttttttttttttttttttttttctgagagggagtcttgctgtgttgcccaggctggagtgcagtggcgctatcttggctcactgcaagctccgcctcccaggttcacgccattctcctgcctcagcctcccaagtagctgggactacaggcgctcgccaatacacctggctaattttttatattttttagtacagacggggtttcactgtgttacccaagatagtgtggatctcctgacctcgtgacccggccgcctcggcctcccaaagtgctgggattacaggtgtgagccaccgtgcccggccggtagagatgtggtgattttaaagtgtgtggcaccttcccccacgctctcgccctcttgctcctgctttggtcacgtgatgcttctgctctttcctcactttccgccatgacgaaagtcccctgaggcttcgctggaagcccagcagatgcctgcgccatgtttgctataaagccagtggaactgtgagtcaattaaacctcttttgtttataaattactcagtctctggtatttctttacagcaatgcaagaacaacctattacacctcatgccctcatctaaatctaatcacctcaccaaagctctatctctgaataccatcgcgttggaggttagggcttccgcatatgaatttggagggcacacttcactccgtaacaatggtatacaaaataatgaggtttctgtgttcatgagcttacattctttatatttgacaataaaaaagtaagcaaaaagtaagaatttttagctaatgttaaatgctacaaagggaaaaaaaataagaaaacatgtaccgattacagagatgaactgggacaggaattacaagtttggaaactgttttcagggaaggcctgtttgagcaggtgacttaggactgggggtgagtggtgtggaagcactcctggaggttgctggggggagactggaagactgagcaatagggagagagaagatcatgttcaaaagggccactgagaccaaaaagctccccaaaacaaaaacaaggttcaaaagggtgagccagcggggtagacaggaggccagcatacctgaggagagtcgaagtgggggacagtagctcccactgtggagagtttgagtgttacctattaaatgcaatggggagctgggcacagtgtggcttatgcactttgggaggccgaggtaggcaggttgcttgaggtcaggtgtttgagaccagcctggccaacatggcaaaaccctgtctctactaaaaatacaaaaatttagctgggcacggtggctcatgcctgtaatgcgagcactttcggaggccaaagggggcggatcacttgaggtcggcagttggagaccagcctgggcaacatggcaaaaccccgtctctactaaaaatataaaaaattagtcagatgtggtggtgtgcacctgcaatcccagttacttgagaggctgaggcaagagaatcacttgaacctagtaggtggaggttgcagcgagccaaggttgcactactgcattccagcctgggcaacagagtgagactctatctcgacaaaaaatttaaaaaaataataaaataaaatgggaagccgagcacgatggctcatgtctgtaatcgtagtactttgggaggctgaggtgggcggatcacttgaggtcaggagttcgagaccagcctggccaacatggcaaaaccccatctttactaaaaatacaaaaaattaactggttgtgatagtgcgtgcctgtagtcccagctacttgggaggctgaggtgggagaatttctggaacctgggaggcggaggctgcagtgacctgagattgtgccactgcactccagccggggcaacagagtgagaccctgtctcaaaaattaattaattaaaccttcaatgaggaggttttgttgagtcagaagcacttcagtacagtcatgcagcacttaatggcaggggtaccgctctgagaaacaaatcgttaggcaatcttgtcattgtgcaaacatcagagtgtactcacacaaacccagatgctgtagcctacgacacatctaggctaggtgatctagcttattgcatctaggctacaaagctagcaggttagtgtgctgaatatggtaggcatgtgtaacatcatggccagtgtccctgcacctcaatatagctaaccatagaaaaggtactgtaaaaatactgcattaacgtcttatgggactgctgtcctgtaggcagcctgtagttactgaactgaaatgtggttaagctgtgtaggactgtgtttgcattttcaaaatattttgggtgctattcagggaacggacagtagggggcaaaagtggaagtggagaaaccaaggaacaggctgctgaagaagtccaggcagccttggaggactcgctctcactcttactggttttcgatgcctgagttacttgctctctgggagaaggaagcaggtcgttcctctgcccaaattgctgctactcaggagtgcctgacactcctttccaaagatgctctgcggtaatatgttctaatgaggagtttgaattgccaattgacttgctctttgcagctaataaagaacagattatgcgctggatggtttgcagttggtggccaagttgtcttgtgattattgtaagttcttttagttgagcttgtgtaactgtgagtcaatcctgcccatgttttatttggaaattagtactagagcctccttgggactagcctttttctcacccaaaggcaaaagaatccatctcggctgggcacagtggctcacgcctgtaatcacagcactttgggaggccgaggtgggtggggcggatcacgaggtcaggagttcgataccagtttcaccaacatggtgaaaccccatctctactaaaaatacaaaaattagccaagcgtggtggcaaatgcctgcaatcccagctactcaggagcctgaggcaggagaaccgcttgaaccctgaaggcagagtttgcagtgagccgagatcacgccagtgcactccagcttgggcgacagagtgagactccatcttccatctcaaaaaaaaaaaaaaaaaaaaaaaaaaagaatcagcctctggatcacattaaccctcacagcccatagtccttcgtcttcctctgaaaaaatatgaaatattaaagattcttaaaccaatgagcagtttccggttattccagaatatacagcacgttggtgacttgttccacattttctttttctcttctcagtgcttcctgctagacatagacacatacacacacctacaccccttttaacccattttaaataattctgtttagaaaagcaacatatgatcatttaaaaatattgagaaacacatacaaaagcaaaaatcatccattagctgctcatcacccccaaataatcactttttaaaaacattttgatatttctctttttggggtctctgtgtgtgtgtatgtgtgtttgtgggacagagagagagagaggcagacagaggaaaaaagcttacagtatttgactgatagtgaatttttagaatttatcgtataattttttacttggtattaaaatgtgaacattttaccatgccatgaatcattttgggaaattacatgtaatgattccataatgttctgttgtaccaaaagttattacctctgttgttattgaagaaattttttatctttctcccttactattattaagaataatgtcacagagaattttcttatactcaagtctttgtttacatttttgaatatttccttggactaaatgctaaaaagtattgtgtcagggtcggaagatatgagcatctttatactttgtgaatagattttatgttgctttttgaactggttgtgcccctgcacatcccataaccatagcgtattagcataccgtttaatctagtcattaccaacattatttggtattattacatactttattaatttgataggtaaaaattggtattgccctgtttaaaccttccccttttcatcttgtctgtttcgtaatgccaagagtaaacacatatcatgctcttaacacaatgtgaaatactgtggaaagtagatactactgtcctcattttacaaattgagaagctaatacttctcgttgagaggtggagctaagatgggaacccagtgtaggcaatgggaaccttgagtctgagccttagccagggctctgttccgcccccaggcaggagcaggaacctgagaggaccttctcagttaggtgtgaaataggaaagcagcctcattgaagtaattcacactaacatgtgaatgacctggaagcatctgtctggtttttatgaaaaaccaaacagaattacttgttatttcagataagcttctcctttgtggatggaaatgtaagaagtttaacgcaagtaaaaaaaacatctaacaatgataaaggaagataccatcgggcagattcagaccttatggaaatgtaagaagtttaacgcatgtaagaacacctaacaatgataagggaaggtaccattgggcagtttcagaccttcttgcaatgcagtggtggctcactgctggcccacagactagaatcatatttattcctatgagataaaagaaaataggtcttaaaattcagtgtttaaaatactaaatcagttgctattagacaaacctctactattctaccttctctttaaaaatggaagctctggaaacattcactactgtttctttcagtaattgactgcatctgattaatcccactgatgcttcaccttgcatctgttagctggctagctctcttcttccttccctatcaactttccccgctttctccctttctgagccaactctctaaaacttttctttttgataagaatattatattttaatgaaaatcctttctgtcatggagaatcccctttccatcatggttaggaatggagacttaggggttacggtggggctgggtgctgagtcatttggaagacacacatgtgcaagttggggcctgtgtctttattagccctgcttaaattgctgggtaatttaagcctctcttattttgctgcattgcctcacagttctaaaggagacctgaaatagagtgtatcacattgtgcacatttttgaaggatcatgagagcagcctaaatataaaattcacgtccatattcttagtgtccttttcccctaaatggagacgggatgcacttgagcattctgtcccatgcttgcctttgtctacacgtgtttcctaatgtttgatctctgtcctttttgtatgtgagaacattcacaggcatcttcctagctgcaaaaagacgggcctgggttgcaacaactggatctttgttatttcttggggggagctcgtatcaaactctccccaatccatgtagtgatttttttctacatctaaaaatgatcctttaaagtttcaatgatgccttggtgacccaggaccactgttgtaatttttgccagtttctttgtatcacttggttgatcttgtattaaatgtctaattgatttgtttttttaaagatacgtgcatgttagtataataactagaagctcgatgttatgagttgaagcataattatgcaagcaacttaatactaaacttagaagatacgtgactactaaccaagaccatctgatgtaccattgatggctcaaatgccagatgtcgggaaacagtgatttaaaaggaaatatttcatgggggtcagcataaagtcggtcctgcttctagaaagccacagtagttctctgtatccatagctaagggtctcttaggctcttattgtaaatgtctgggtttcactcaggaaaaaaaaaaaatctcaaagctatggccaaggcagaggcttcctcacagcccatcccctgtgcatatcgattagttgacatccatgagtgccccagtcctgctggaaatatcccctcaggcttgcttttctgtggtatcaccacctattcccctcttgttactcggacctctttgaagtcatcatagtgtttttgggaatagagaataccactttgcagagagagtgatagcggcttgtgatcatatcctcttcatatccccattgtcggcgtttgtaagaccccaaatgctcctgaaaacttgatttctaatggttatgcaatatttaaatgttaatagattactctttgcttgaccatttccctattttattttttttgagaaagagtctcgctctgtcatccagagctggagtgcattggtatcacctcggctcactgcaacctccacctccctggttcaagtgattgtcctgcctcggcctcccaagtagctgggattacaggcgcccaccactacacccagctagtttttgtatttttagtagagactgtgttccgccatgttggccaggttgggcttgaattcctgacctcagtgatccacctgcctcagtatcccaaaaggctggaattacaggcatcagccaccatgcctggcacccgtttccctagtttagacatatatgttgcttcttattctgcatcattcattcattcatcaaatatttataggcaactatcacttgccaggttgtagagaggacaggaaagcagtgctgagcagccaggcctctggatccttcttctccatcaatctgtgaatttttacttatatctgagaagggggagggatggaaggagggaaacaagggagaggagagaggaagggaggaaacagacgcagctgagagctcctgaagctcctgaaacctctgaggagcattctcttgctttgtattcttttcacagaaccagtgactcttgttttcttttaaaatcctctcctccctcccctccctcccttcccttcttcccttccgttcttcccttccttccctcctttcttccttccctcctttcttcctccctcccctccctccttcctccctcacttccttccctgctttcttccttttccttccttctttccttccgtccctccctctctcccttccttcctcccttcctttctgccttccttccttttctttccttcccctcccttccctccctccttccctccctccttccatccttccgctctccctccctccctttcctccttccctctctccctccctttcctccttccctgcttccttctttctccttccttctttcctctctccctcccttccttcctcccttccttcctccctcccttccttccttccttccttccttccttccttccttccttccttccttccttccttcctccctttctctttttctcatctatgagccagaatgttacgctaagttttggaaacagcactctctgctgtgtctttaggatgcttgtttcctgcatgctgaccagacctcctgttggactgatattctggataatggcttggtgcctttctagcttctaatctaaacaagaattatttcattttagattctctctgctgcatcaagggtccctggaatttgatgatgacttaagtggaaatcccagctttagcatatataagctcagtaccatagaccaagtgggttaacctctttgtgccttcattttttcaatggaaaagttgcaaacaagatacttacctcccaggattttcctgacaatgaatgagaaaatgtaagagaaactgcctttcgaattgggaagctctattctgatgaaagatggaccttatttttaaatacaggacgtttagtaattttatctaaattccccattcatcagaatacagtggagaagatatttgccatacccatttcattgtgttgttcataaacttgtttatttttccagggctggattggtttgcctttctctctttctgtctgctactgcataatttcattatctgccatacgtaaatgtattatgtaattctctcagttgtcattgattgcttctgtttttctgtagtattactggtctataatactttttattaaatccccaaggatagttcctgaactgtggttgaaggaccctcctttccactaagtaaaatacaacacttagatatttgaaatgacacaaagtactagagaaaacataagtgtggaattttcccactggctttatgaaatccaggaaaccaattgagatatttgtttatgatgcctttgtctatcctggaggtttctctctgcgttctttcaatggcagtcacagcatcaacaaattatataaaattagctaatgtttattgagtgcttactatgttccgagtaatgttaggaactgcttgcattgtcatttaatcgtcacaacagcctcataaaggaggtacgctttgttatccccattttattcttgagagaactgaaattcagaaagtttaactgctttgctcagagatacacaataaagaagagatgaaactgtaaagcacacccctctcacacacacaccacacacacatacacaactttatgcaagcttagcaaagtcagtttccttcttagcttggagaatacatacatatgttgaatgcctgagagtttgggacttctctgctctgtacttgcttctgacactaaccttaaactaatcacttctctctggaactaggtctacttatgggccacgtttgaagggttggatgaggtcattagtttttatttatttatttatttatttatttgagatagagcattaggttttttttactttttattttatttttttgaggcaaggtctcatcctgtcacccaagctgcagtgcagtaagacaatcttagctcacatcaatctctgccttccaggttccagtgattctcatggctcagcctcctgagtatctggaattacaggtgtgtgccaccacacctggctgatttttatatttttagtagagagtggattttgccatgttagccaggctgtctcgagctcttggcctgaagtgacctgcctgcctcggcctcccaaagtgctggaattagaggtgtgagtcactgcacctgcccaaaagcattagcttctaattgacctcatgatgttcaagaatctgagcaggtggtcgaagggtggtggagaggataggaaggcagtgctgagcgggcagggttctggatccttcttgtccatctgtctctgagcttttgcttatatctgagagggatagagggagggaaagagagaaagaagggatagagggagagaggaagggagaaaacagacaatcgacatcacatgctacactactaactcattcaaaaatagcattgtgccattgctatttcccatgtatgtcattagatattccatgaaaacttgatttctaatcgttatataatattcaaatgtgttaataggttaccctctgcttaaccatttccctgttttagacatgtgtgttgcttctgatacttcatcattcattcatttatcaaatatttatcagcaatgatgattctccagacattaacataagtaagtagggtgtggattttcttatatataaatttttgacatgcctgcatatatgtgcttccataactatatagaatttggtatttttgctcttgctgctaattgctggacttctttagtgaaagattacctgttctggaaagcctgctaatttagatggtaggttggattgaaatctgtgcaaatgatgagcttatctgtttcggggaacataattggagttctggacacactctctcccaggattataggtatgagattaataggcattgttttgatggcatatgccacaagcatcaaaatatccactttgtgaccttcaggcttaaagggatcatcttgaaggtatagctttacatgttgcctagtttagaggtagatgaggctgtagataatgtccactccaacctgtgcagaaggatctgagaggcagccccaggggttgctgtaagacttggtgttgctgactccccttagaagtaatctccaaacaccaccaccaccaccacgaagtgtgtcatcatataaactgaagatagctgagattacacactgcctaaatttcactcagaaaaacatgatagagatcatttctgattgaaaaggcaataaagaaactcctaaacatacctctttgtccataaatggaaaccagacaaatcaggcttgtagatttaaagagaccctgcaaggtggcgattctgaaataccccttggaaggaccatgccaagtctgaagtgaagctgcagagtgaagcagtatccagagactgagctatttctggctgcagactttgtgtcatgaaatggtgataatttccccacgccccataatgttcctctccttcctgatggctctataagtttgagtgatgtcagtctgtttggaggcagctaggtttgcttgtgtcttaggacagatgtccagaaaaaacaaggctagaccctgaagagcctggacatccattagaatgacaaaagactctgtggatacaaaataccattagtttttcttccttcctctatattctctctttttatctccttccctgatagcaagcaaagggtagggaaatctaagtaggaggcttctatccttgactgatttttttttaaatttttctgcctcctaggggatcacttaattcattttatgcctctggaagagaccagaatttcctcactcctccaaattcctgggcaggttacctctcccaacctcagttcatcattattctgcactgagttatgtaatgatttgatcgtgttgaggagtaattcacctttgttcccacctacgttaagactgattacaaatcctcataaaatactgattatgctaccaaaaatgttcttaaggatagtctgttaggaaggaggtaatgctgctgctcagaagtgtgggcttctgtctaattatgtgtaaattatctgagtggaatctcaaatgtttagtgataaacagtttgatgcgtcccagcaaagtatctagtttgtgaggcaatataatcaaaagcagcttatgtgcagcaaatcgtagatggtataactttgcgtctttttcaagttatttttacagaaagaaatgagaatttgtctgcagccctttaagaatagcaaacgttgtattttgcattttttaaagaaagataattgatcctttgactatactgctgttctgttctcagaagaaacattaaaaagttggatttcttaagaaatgcaattaaccgacttttatttaatgattttttttcacgttattcatcctggaggaatggtttctgttggttattatcaaagatgaggatggattttcagaagcaaaatatcatgatattctactgcaatgcatctgtggttactcagggaagatccaatgtggtttgtatgtagatatctccttctttagaaaacctttcctgaattgcctacctccatctcccacccatctccagctggaatgttgtacattctctgtgccaccagaagaaagctattctaataatcaaagcgaataggacaccatttaattgggatgaagccacaattgttagtgtagctagtggtaattgaacctagatgttcataatctaggatcctaaactagatgttctgataatctagatcttcataaaatacaggtatttaagtctgaaagctcattatttcttagtctcagtggtagggttccttaaaggcccaagaagcttgagagaagtctaccagggcggatacccatcgaaaaatcaaagccaaggacttctataggcacagaatggtcaagatatttattcagcatagcatgaggaagtttagtccagtatagaaaacaggaatatcagttaaaatgaaattagcatattagttaacataagaattcccacgtcagtgtttgagaacactttgcagctcttctagagacattcttattacagaagaagatgactaactcagaagaaaaagggtatgaaagtctagtaggagaaaatgattagcaaaaaaaaaaaaaaggtactaagacattaatattttattgaaaagaggcaagaattctgtcagttccttattggtggtcaatgcagaataatgctagcattgcctatcattcagttgattccgtaggcggctaaattggttgcttaatgaatccatagtggtatttggctccgcttggtttccaaaattgtaaggtaaattctgtgcacgtggttttaagttggaaatggttgatatggttatacttggtgtatgcattcaacaaattaaccagttgcaaatgtgtgcctattcacaaaccccttgattgaattgcaagtataccagctaattagacatgtgttccgtaatgcttaaagagagatcaaacctccttcagtgtctctagatggtgaagtcttaaatttacccaagatcaaaatatctacataaagattcctatgtatatctgacatgtgcaagccagagggtgttggacattttgaaggccaaccatttagatgattgactaaatatatttactttcatcatacagatctgtccaatattaccagcataccttttaagaaagtgtattcatccttttagagttcattaaaatttatcatgactgtctgtgggatgcatttatttcatattgacttctgtttgtatcctttcctatcctacattctctataaccagtctttttgcaagtctgcaattcatatcaaaaagtctgaaggaattttatttttatttccttttcagtgaaaacatattacaaattgccaactcatgatgtattcagtttgaacttaaaatatcatttgtttaaaaaatgcaataaaacctgatatgtacactgatattcattctgaagattaaagctgccaatgaattatggagctgggccaaggctgtcttgttctcagcctaaatttatcttgtcgaaagggaattattctgaccggggctagagagtgaagatagttaaaatttgattgttcgattgctttcttctggcttttttttccttcttaaaaaatatttgattatatttctcttaagagctggattttaaaatctaaaaactgatgacggatggataaaaagtcctattttatctaattctaaaagtgacgtaggtttctggagactcttttttttttttaatgtacattttctctttccttttctttctttcttttttttttaaacatggatctttggccatgggggaccccatgctgagtgcctaccctctctgacttacacagaggaagcttcagtgtaatagaaataaatgctgcattttctctgtttataacatgtcacttgggcaaagtggtacagtgtctctttggtaaagctgaaatgcggatttctcagaaatgtcttgttttcagttaatgatattttctgcttttcaccaggtggtctctttggggctttgctcttgaattcatttctctgtgcgtaagccaggctttctgttactcgtttattcagccggcatttactgagtcctcaccacactcaggcctgagcgcagcgtccaggttgcagtggccacggaaaccagccctgtcctattggtgcttgctggctttggggtaaagtgacaggctgatactatattatagccagggccacgttagacatcaaaataaaatgttctgggaatagagaggagggatggcctggcatggaggtgagctgggggaatcaggctatctatggtcacatcattctatgaactagcagaccaggcataatgggcgacgtaagctcgccctggtgttgcctgacctgaatgagtgcttctctggaaagagctcatagttcctctttctcttatgtgaaatcccacaaggaaaggcaacttccagaaatggccaagctttctatccctaaagagccagccctcaaggactcatgaaggctgaaagggaaattgatcattggctcattatggtcctgatcaggtatgacctttgagaaaccagtgggcctggtaacaatagggcagccaagttggccatatcagcagatgttgcatttgctgactccatggccagcgccacatcacctgctctgaaggtgtttggttcccgctgcgattggatctgtattcaaaacagattgtgcctgctatggaaagagagccagcttctgaatcctggctgagtttgacttcgttgaccacagagtcttggttctttgcaaacgcaaaggaaaacacgatgtacaccttgactaaattcagctgttttcctcatccattcagccttgccttcattgcaaaatgagcaagcttgtgtttcagagggcttaggtcacttccccagcttcacttagatctgggtgttctgccttccagaatagagtccttcttctccctccatagaccctaagactattaacagtaggtcatccccaacctgttggttaagaaagacatgcacagtatctgcacaatgtccaagggatccccaggatcacctcacctttgtccaaagagaataataaggtgttggtagataagagggaggcccatgtgcctctgccattaggtcctgtgacagggagtccacatggagatcatcatgtgataaagaccactagggctgtagtccagggacaagcttgagtgacatctcagtggggccgctaccttcggagagctccgcacataaggacagagtggctggggcagtcaactggcatcctagaacatatttctcaagaggggccctgctgacgttttggaccagattgatagttcattgatatgagttttatccattgtaggatgtttggcaaaatccctggcctttccccatgagacactagtaacaccctttcctctgggagtcaaaacattgtccagtatcccctggggtgcaaaatcacccactgcttgagaaccgctatcctatggccatatttgtactcactaaagaaagggtacataatggcagctactctgggcctcttgaatcaattgcatgtgattccctacctacctccctccctccctccctccctccctccctccctccttccttccttccttccttccttccttccgagacagagtgagtctccttcacccaggctgaagtgcagtggcacagtcttggctcactgcaacctctgcctcctgggttcaagcaactctcctgcctcagcctcctgaatagctgggattacaggtgtgtgccaccacacctggctaatttttatatttttagtagagatggggcttcactgtgttggccaagctggtctcagactcctgaacttaagtgatctgcctgtcccagcctcccacagtgttgggactacaggcgtgagccaccgtgcccagtgcaattgcatgtgtatttaatgagcttctgcttggggggtagtttagcatacatttggaggcagatgggctgcttcccttattgtatgagagccaggtgactttgtgcaaaacacttgcctgctttgtactttagtcctctcttctataaaacacagatagttctaacactgtatatctctcccaagtttgtagtgaaaaaggattgcacacatacacacacaaagagaccattatgtaagtgttaactactattcttattagcattgtctgggcacaatatctggtgttggaagtcagagaaaatacacagcatgttcttttcttcatggggttctagtctagatgagaagacagtgtccagccactgagagcaatatgcaaatcagtcatcataaactgagtgactgttaggagagagtctattgagggaaacgtgggttatttatagtttgcttgagtttgaatccaggagacaatcttgacttcctctctgcagaccaaaataatctttctttctctcttttcctccctgccttcctttcttttcttttccttttatttttgttttcttttcctagaaaaggtcttactctgtcacccaggatggacaggaggtcagtggcacaattatagctcactgcaacctctacctcctgggctccagcaatcctcccacctcagcgtccggagtagctgggaccacaggcgcgtgccatcacgcctggcaatttttttttgtattttttgtagagacagggtttctatttgttgcccaagctcaactcctgagctcaggtgatccacccacttcagcctcccagagtgctgggattacaggtgtgagccactgtacctggccgactaaagcgatgtctgaaaagggaggacagaatccaccactcaccgccccaaacccattttctttgcagcgtttgctcagactaacagtcagaggaacaagtaaatggcatttgcaaaggggatttcatttattcctggatgccacagttacttgttcacccccaactcattgcaaggcacagggtcttaggaattctttaattgtaaggaacagaaactcaccctgtatgaagatatctcattataagaatcaaaagatatttcacaaaactcagttgcatgaaatatggggaaatacatggatattagaagttatcaggtggattttctgctgccttttgctcttgcaccctctccctggagccttctgctctctgttctctggttgattaagcttttttttttcctgttatcgttcttttaaaaaatttttccataggttattgggggaacaggtggtgtttgatttcataagttcttcagtggtgatttgtgagatttgggtgcacccatcacctgagcagtatacactgcacccagtttgtaggcttttacccctcacctccttcccaccctttctccctgagtccccaaagtccactgtgtcattcttatgcctttgcattctcatagcttagctcccacttatgagtgagaacatatgatgtttggttttccattcctgagttacttcacttagaataatagtctccaatcgcatccaggttgctgcaactgcgattaattcattacttttttatggttgagtagtccatcatgtgtgtgtgtttgtgtatctgtgtgtgtgtatctcacagtttcttcaatgcactcattggtttatggatgggttggttccacatttttgcaattgtgaattgtgctgctataaatatgcatgtgcaggtatcttttttgtataacgactttttttcctctgggtagatacccagtagtgggattgttggatcaaatggtagttctacatttaggtctttaaggaatctccacatgattttccatagtggtgggttaagcattttgactttgtgtgcctctctctgcttgtctctctctgttcgttcatcccctagtgcttggtccagctttcagttttccatggccttcctccctggtcccccaatctgcctctgcagtctctatactccaatccagcattcctgacagggagaagatctcattgaaccagcatggatcagtgtccaccatgagttcccacagttggaaagatttaggggagctcactaggtagatgatggtgcctcttccgtggtggaaaggagtatgaatttgctaagaaaatcgtatgggtggaggaaattggttgacacttccataacacctcccctctgtgttggccagggaaacacccttgacattctgtatctccatcccctagatcgcctctccctaaacaccactcagcctcaccgtcctcagaagctgtatccttactcagttttctttaattggcatcttctaaaataagactctcatattgttgcttcttagggtcacccagagcttgccagaagtgagaaaggatctcttctggacttgatctagatcatgtcatcagatcattgcatcaaagtcaggtttactgaggcataatttacacacggtaaaatgtactcattttagcacacagttcttcaagtttcaataagtgcatacagtgatgtaataaccaccagcgtccgcatgatttggagcatattcgtcattccaaaaacttgcctagggcctagttatagttagtccccagctctagatcctgggaattggcagtctcttttctgtctctacagtgttggtgtctccagaatgtcctacaaatggaatcagaagtacgtagcctttaggcctgactatctctgtgtaatggatttgagattcatccaggtagttgcatctatcaacagttccttcttcccttttattgctgagtagcattctgtggtacagatgcactatagtttattcactagttgaagggcggttgtgttgtttccagtttttgctgattatgaaacagttgctgtaagcatttatgtacaggtaattctgtataacaattcttagttctcctgggtaaattcctaggagtggtgttgctggattgagaagtatgtttatgtttaactttattcattcatttaagatatagactcctgctctgtatcccaggctgtagtacggtggcactatcacagctcactgcagccttgaaatcttgggcacaagcagtcctcccacctcagcctcctgagtagctgggaccacaggcactcaccaccacgcctggttaattttttaacttcttgtagagatgaggtcctgctatattgtccagattgatctcgatctcctggcctcaagcagtcctcccaccttagcctcccacagtgctaggatgacaggcataagccaccactcctggccctttttaacttcataaagatgttttttaagagaggcagaggacagagtggtagtttcggtgtttaatcctggatctgatacttcctagctctgcgacctcacggtttatctgtgccttactggattgcagcagaattaatggcaaaataataactctgcacaagttcagggcagtcactggctgagtgttagagctttaagatggcccctcatcttttggccactgccttcttgtactggatgttccttctttattgcctgagcatgcacactctttcttacatccttgccacacactgtttccttttctggaacattttcccacccacctttctcctcgccaacgcctcatccctccgttgcccaatggaatgccgcctcttcagaaaagccttccctcaccctcagtctcaatccagccctttgctatctatagattccttacttttttttttttttttttttttttttttttagcaacctgttcttatcctttatagcatttaccacaatgggcctcagaaaattaactgtataatttgatttttaattggaatttttattgagataattgcagattcacatgcagctgtaaggaataatacagagagttccaatgtaccctttacacagttttccccaatggtaacatttggcaaaattaaagtacagtgatcacatctaggatattgatgttggtacaacccagtgattttattcaaatttccccaatgttacttgcattaattgtgtgtgtgtgtgtgtgtgtgtgtgtttgcagtggtggtagttttatctggttttgtagaattttaccgcacatgtaggtctgtgcatccaacaccacagtcaggataacaaacatttccatcaccactggatcccttctgtttttctttttacaaccacccccgcccccactcccaattcctaatttctggcaaacactaattttctctctatttataagcttggacatttcaagaaatggacccatatagtacctgacttttaggcattgacattttttgatcaacgtaattccctggagactcattgaaactgctgtgtgtataaataacttattccttttcattgctgtgtagtattccatggtatggatgtaccacagtttgtttaaccattcatctattgatggacatctggactaactcctggatttagctcttataaataaaactgttacaaatcttcaagtgcagggttttgtgtgaacacaagattccatttctctgagataagggctcaagaaagaacatgctgggacatgatttttaagagaaactgattgatttttaaactgagtctctgctgatagacttttagttccatccgggtaagtagactgagttttgtttgtttgtctgcttgtttgtatctttaatcagcatactgggaacactgtacaattcttagaacataatttaccactctataaatatttatagatgatttaaataaggaacgaatgagtgaatgcatgaataccactgctggcatagggattaaatgaaataatttatgtaaatcatgttcagaatgtctagcatggagtaagctctaataggtaaacacttgtagcacaatcgccattgtaagatatgattttggttgaaggtgacatgaggaaatttcatatccttccaccttcagcatcatacaaacatcatgtggctttgcaggatcccaagggtctaggttcttgccactttatttctttaaataaaagcctatcttgtgaaaatgctcaaaagtgtcagagtgggaatttgggtttcatactttgatactttcttatttttttttttttttttttgagatggagtcttgctctgtcacctaggctggagtacagtgatgccatctcagctcactgcagcctcccctgccaggttcaagcaactttccctgcctcagcctcctgaatagctggaatttcaggagcacaccaccaggactggctaatttttttttttttttttttttttttgagacagagtcttactctgtcacccaggatggagtgcagtggcgagatctcgggtcactgcaagctccgcctcctgggtacccaccattctcccgcctcagcctcccgagtagctgggactacaggtccctgccaccatgcctggctaattttgtttttgtatttttagtagagacagggtttagccatgttggccaggctggtctcaaactcctgacctcagatgatccacccgcctcagcctcccagagtgctgggattacaggcatgagtcaccatgcctggccctgggcttcaaactttaaagaagatactgcttaaataggtcagggtgaagctacataaccacttgcctcattgaacatgaacgcaggcaatgcgtgatagaagctgtaggagtgtgaggatgtgtggcacaaaagaggttaactttgttccaagatcattatggtcccagagtgtgacataaatattggtgaagccaatggagttagcacagtacttaatagagagagaagattagtgattctcatttgcctgaggaaagtgcaggtcttgataatgtcttgatctatgtacaaagagctagtaaagacaagcagtcctcataataaaaatagaaatgaggttttcccgacaaagatgccaccagaatgatgagctgtcacacaggacctggagagacaagaaagaaacttctttggtgactataattaggattccatggagagcagcagtgtgcaggaactatgccagggtgctctctttctctttctagaatcaccatcaaacttgctctaaaggaccaggacagcgagtaggtgcaagctgatccttggtggaccaagcctgtattccccacaggccatggtgaggctctgacctggggtataataggcaagaagtgttttcagtctgtgacttgggctacttaaatggaagaagataaaaccttttatttttccttataatgaaagtacttcacgctcattattaaaaacttggattgattgacaattttgaaaaatgataaaagtcgcctctcaacaccacatttgggtgtttcctcaaagctttgaaaatatctatgtagatctatatgtttagatttagaaagagataaatttagaagtggagaacacaaattagtttatgatagattttacatatatggggtattacccaataattatggatttgcatattaccttcccccacccatttcgtgtgcatttttctgcttcttaagctgtttttccctcggtgtattttcaaaatacacatagtttgtgaggatctagcccaaatgaaatgagtgatgtgtgactggctgttgaacgaaaaatccaaaccaatctcgtgtgtatttgctggctgagatctgttttcctcatgttctgtagaagggaaggagtaacatggtctcctttagatgctggatcaaggtctgagatttttctaccttcaccctggtttccatataacagggaaatcctagagtggtttaagatacccacaagcaccctggggaagcggcacctacctcaaccatagtttgtgatcctgtaattcaatttaatttctggagaaagaatccactctcagagaactctcacatcaattgttcaactttcagacattctacttggaaatccatttaaggaatgcatcatacaataaagtagaagattcaaggtgagaaaatcacactcatctgagttagggcctcagggtgtacatttaaataagttatttatcttccctcattctcagcttccttacctgtgaaatgggaggagtcacatcaccttgcttatcagatttctgggaagatgaaataagataatgaatgtaaaacccttggcatagtgtctacacacagtaaatgctaagtaattcttaactgtgctattactggccggagagcagtggctcacacctataaccccagtactttgggaggctgagctgggcagatcacttgaggtcaggagttcgagaccagcctggccaacatggtgaaatgccatctctactaaaaatactaaaattagccaggcatgatggcacatgccaataatcccggctacattggaggctgaggcaggagaatcacttgaacccaggggatggaggttacagtgagctgagagggcaccactgcactccagcctgcgcgataaagcaaggctccatctcaaaaactttgttgttactttttacagtatttcttggacttgtgtgtgcttcttgataggacattggctatgcaggggaacaacattggaatcgtttgtctggtgagaggcaggggttggagaaaagaaagtgacagcctgctgagaatctgagtgatattagaggaagtatgggcaccctggaggttagtgttttcactaaaaagatcataaattattaacatccaacagagttacccagaagaacactcatgccagatcctgcctgctgtatcagagagcctccttagagatgtctgtggctgagttacaaagaagaaaaagcagtcagggtgatgatgggtattacatttgcttccttagtcaaacactagagttgagagagaaagcaagattggaagtagcaatgggctctccttagaaagattaaagagatggctccctttgtttctagcctaagagaacagggctggctgtctttcccacaaaggtcaatgtacattgccttacttttgtgtttacaatcaacagtagccagattatcattaccgataccaacattaccaccaccattatcatcatcaccatcaccatcatcattaccatcatcatcagcaagagcatcactgtcaccaccattatgattatcatcatcgttattacagtcaccttcatcgtcatcatcaccattatcaccatcagcatcaatatgataatgatgatcatcatgattatcagtgccatcattactaccatcactttcatcatagtcatcaccatcatcatcaccatgatcatgatcatcatcagcatcaccacccccaccatcatcattatcacaattatccttgaagctgatatgtgttgtgcacttcctaggtgctaaggggttgcaccaagaaatttagtgtattagtccatgctatcaaatttagtcttgtgagataaaaatattagtgcttgtctcacttataaataaggatccaagactcaggaagttttaaataacttgccaaaagccactcagctagtatgctgtagttcaaagattcagaaccaggaggtctgcctccctagtccttatcatccatttcgttatcaagaaggcaggacaaggttaggataaactctgtggccccagaataagctcttttaattcttattatttttcttcataggagagtaaacctataatctgtgcttcccagggttacatggcacaccactgtttctcagatacctacgtacatttacaccggtagaaaccattttagaaataaatgttacagaaaattccatctataagagagataaaaggagcaggataaaagatgcattttatgacttcaaatgtgaagcatgtatcgtaaaggcaattagtgagaaaatgaggctattttgatgaacaccaatatttgaaattgggagtatggatagataatattgttttcaattaggcttataatccaattcatttcagtcttttaatttgttgcctgctattgagaagatgctggttcacacactgatactgagatgcagaaggtaattttttaaccaggtgaccttaaaatatctcattaatctggaatgtaagctccatgtcctttcgtagttgagcactgtatctccaaggccagcaccatgcttcgcacagacactattttcaaaaggtagctgacgattgaataaatgaattaaccaactagtaaattaaatgaatctcagaaacatgaaaatggaagaggactaatattttcattttcaaatttgctcattcactcaactaatatttaacaagcatccactacagtaagccaagtgctgttctaaggtggtgagcatgcaacattaagaggggaaaaataccgttctcatgggacatgtgcgtgtccgtgtgtacaggatgggggcgtggaagatagacagaaaatagacaaggaactcaccattaacactcgctgtaatgtttagaagcagacagcttatctaagccttctgagtctcagcatgcttgtgggtaatgtagtattatcggtatgtacccagcaatacccctgtgaagaataaacagaaacacacagaggtgctatcatccttgcctccatctcaatattgcaaaacatacaagaatgcacatttcattctgtgattatttatttaactaggcactgggcattctgggatttgtacattcatatcattaaagcagtttcagccaaagagcatatatttggagatgttttaacatgcactgggcataagtgattatagccctaggttcaaggtgaccagtatctggacagagggagatatgtagaagaagtaccagttacgttgcaaggtaagatgtgcagaaccagcttaaagcattcaatactgtgccctaaccagctgaaggggtcattgatgccctttgaacagaagacagacatccttagttttgggtatttaaaattcctctgtggcaccaatgtgaggtatgagttgggaagagctgagactgagagcaaaggaacttacctaagtatagctttttcccccttttctaaaaatctaggctaaataaaataatgtgatgtgctagtatagccacaatggaaaattaagacagccttaatagttgggagatggaagagttaaaaatgatacaatttgggaaccaattgactattcagagcagcaaaggaagatgtgaagggcaaatgttcagctttcaagattaagtaaatggaagggaggtgcttccattaacaaacaggtaagtcaatagaggaagagcagcatgtgcagatgcgtttgtttgggggaatgttaaaatagcagcaaggatgggaccttggcactgagacatgcaggaggctgtctgaagttcatgatgattcctgagatgcagcctgtgaggagaggtcatggctagggatgcgataaggatttgtctgtattctgcaaagagtctgatgcaatggctttcaatcattactgcaaatccttcacaagtgtgtaaagagtatcatagccattactatattactatatataaaatatataatgtactatataatgtattatatataatatataatgtattttatatattatatattatgtatataatatataatatattttatatataatatagaatatatgatgtattatatgtattatatattgtatatattatattatacaattatagtatatattacatattgtatatattatatatagaatatatgatgtataatatataatatatcatgtattatgtataatatataatatataatgtattacgtatgatatataatatagaacgtattatatatcatatatcatatatgatatagaacgtattatatatcatatatatgatatatgatatagaacgtattatatatcatatatatgatatatgatatagaacgtattatatatcatatatcatatatgatatatgatatatgacgtattatatatcatatatcatacatgatatatataatatataatgtattatgttatatatcatatatgatatacatgatatataatatgtaatgtattatattatatatataaggtattatatataatatataatatgtaatgtattatatataatatataatgtattatataatatgtattatgtattatatataaaatatatataatactatatgtatacacacacacacacacacacacaaatatataacagaagtgggttgtgcacggtgatgacgattagggtataggaggtaagagacctaacaaagcacgaagtgatgccaagcgagagttttttgtctatgaggcatgtaagaacgctacaatacatgtgcattaaaaagtccagccagggacatatatagtctttttcttacatgtcactctactgaaatagtcttgaattattttatctgatacgaggtgaaggaaatgctatgttttcatcagtaagcacaataggtcttgtaatggagcgtacaggtttggtttggaaagatggcttgatacaaagctggataagagatgatcccctcaaagacacagaaacaactgttgccgagcttttaaggagcaggaaacagaggatgaaggggtgaggatacgaatttgttctctggctctcaaaaagaaaagagggaagaggaaaaggaagtaaggcagagaaagtctggaaccaagacagtttaatcaaagtcgagggcactagaatagccaaatgtcattttcaaggatgtgatagataccgttgaccctccacgtccttgggttctgcatccatagattcagtcaactgcagatcaaaaatattcagaaagaaattgtgtctgtgctaaacatgtgcagacacttttttccttgtcattattccctaaacaatgcattgaaacaactatttacatggaatttgcattgtattagtaaacctagaagatgatttaaagtatacaggaggatatgtgtaggttataagcaaatactacacatctgtagattttggtgtccttggaaggtcctagaaccaatcacccatggatagtgaacgatgactctaccgatccttgtctgtgtttttaaaatgagaatcacatcttccattctctctgccaccatcttcatgtctgctcatacatgcatcatttagtgggtgtattgcagaatgggctaattaattttatgtgtgggtctttgtaatggaacccagagacagggaatataagaacctggactcgcaggccagatgaggttgtgagaacatgagctgcctgtaaccgtgaattgcaatttggggactaaaacttggaatcctagagattgtctgtttgccgaggtgagatttttgagagccaggaaggttttctacccaatacccgatacatccccagtgtcaccttgtaagttttgcagataaacctagtttcgtatgattccttacatcgttcctagctcacctccaacaatcatcagactttgaaggtatgcaatgatgccagggactaagaattcctggggtgtctttgacctgtgttccaggatgagaccctgggaaggtccaggtcaaggtggattaattcagagctggagatgttagaggtgaagtcacttctagtcagaaatgcttaatgacaactcatcttgtactttaaagataaaatttctgagcatttctggggtcaaagaaccttgcagccaagctcatgaaagaggaaaaagagaatcttctgcaggctttgtttgccttcaggtttgcttgagtttaatccagaagtcgaaacacagagagtgggtggggtggagggttcccaaagtagaccttcccacccacttgttcattaggagaaatcaccacttagctgtttttgtctctgccgcctacccttccttgtcccacgcacttacattcagtcctgtgcactggaaacagactcccaccctctcaactgccaaacgctgcaccttgtctttgcttcacctcctggagtccattgtttcaggaaggctgctataggaactgaagttacttgcttgctctgggtaccttttaatttggggttctacctggtgtgtctcgggtctcttttgacatatgtcagttggctgctctgatagaacattgtctccataaattgtcacttttgccagaaatgatgataggaaagtgttggcaagaaaaaaaaaaaaaaagactgaagcagaatattttcttttgaaaagcttagggcaagctgtggatagggtgggacttactcctgctctaattgagtaaggacaagaaagctaggaaaatttcatatgataaaattaggtggctggggtcagcgatatattcctggaaaaagaaagcttgaagataaaatggcatagagtagttcttcacaaaagtgcttacgaggtttagatattgtaaaaaatgatgaatatgatgatgatgatgatgatgatgatgacagtggtgattttgtaagcagcatctctactgctgtttgtattgcatggttaaaaaggatactttctcattttgttcaacagaccagaaaaccctgttttccatctcttattagaaggataagatagatacttcttgtgccctcagtttcttcttatgtaaattggaactataaaaataatctaccttgcaggattttgtgaagatcagaaaaaaattaattaccatctggccagaagtaattttctaacatgtattacgcttgtcagtcttcacaaaatagtgaaggacttgacctgatgttgtgtgagatacagttggtgaagattttagttgacaagggttaatgtgtaagctggcattcatttgattcattagcaaggttaaataaattgtgtactcagaagaccagggcagaaaggtgatgtgtatgatgtctatacatttttgtatagtgccatgtcatttaaaaaaactttacaaaaagaaaattgtatctgaagttagtccttccataaatgtattgactttgttggtctcgtttgtgtaatttttttgcaaagaaggaggaatgatggtttcatcaactggtcaggggctgaaaatagaaatacctcataataatagttgctatatattgagtggttgctagataatgggcaccatttttatgacttatatatattacatgattttatctttcaacaacttaggaaggaaaagtatcattattctccttagaatgaaactgaggttttaagaacttgtatgtcagtagacatataatagcagctgcaaaggtatgatccagagatagatcttcagaccaagcagcaagactccaaaaggtgtactgctcactacaggtgtactcaggggagtacaccttttgcagtctcgctgtttgtgtttgaggcatacccacatatgaaccagaaagagttcccaaataccccatcgcaactccatatttcaggtggccttgaacgagcagggctgagtcattgaggaacaagaataaactctggtgatccaacaaattcaattcatttgacctttattaagcctctcctaagtgaaaggcatgctgctctgtggttcaggaaactcagaaatgagaagggtgtttggtttggtttgctgcagtgaacctgtgggggtaaagagaatagttattcaagcctaaagagtgtaactattaattgttttttagtctcctcgtgatagctaacaagtattgttgatacttgttgtgccagtgcctatgctgagaagcactttacattcattatctcggtggttcccaaatgccgatccacagactcattggattctgtaatgacattttcgacagactgcagctaaatgagaaaattaagggcaatttagtgaaaattttaatagacttaaatttaatcaatttgaaggactgtcctttattttcagattatgtcctcctttttttttttttttttgcattttcgtgtaaaatgctgtttcttttattaaatgcttatgacagtagacagtgtatgtgagtttatgtgtgtatgtatgaatgtactaccttggcaagaaatttaaaagctgttaattttcatgcagtctctttaccatttttaaacttttcttggaactgtccatgtcattgagggctaggggataagaagtctgagaatcattatagttctgtaagggtgctaccattggccccattttacagatgaaaaaaactaaggctcggaatggttagctcacatgctcatgttcacgatagcttgcaagtagcagagcttgaatttaaaccagtttgtgtgtttctgtagatgcagaacacctgcatgatgggcatatggctgcttttgctgcaatgaataggctccctagcctgtccctggccatggatgtgggccatgcaaccgttttcagagtcccaggactctgggcctttctttcgggtgcagactgaaatccacaatagctttagacattcatggtgtttcctaggagctagtttgcagcagttctattcctctacttggaggaatacaggagttaagagcctagctttgtgtcccttccctctgcccctgagtcctgtgtttctgtttaccctcaaaaatgtgagcagtataggtatgtgtaaaggtaaatgcagacatcctgcttagtggcttacagcagaacctcatgtcaggggaagagctgggttgaaagatcccgttttccaagcttgcactccatgggagccatagtcagtagccagtgagacgacaggaggagagacaaggctcaagggtcaagggagaagacactgtctgtacctcctgagctttctcttcattgtgcctgcagggaggagggaaggcagtttgggccatggcttgtaggaacaaaaaaggacaaacttattttccacatcttcctgctttatatgtgaggcttgatgtaaagacaaactaccccaccctgtgagatgggtaattgagaatgagacataactgggtttggaaatcagttgcatcccttctcttctccagaaacatatgcaggtttccaacctggcagtctgtttctcagcagccttggcacctgaggaaggggtaagatgaggatctgggtatttttattttgatttctgacattgtccctaagaagttatgctgtaaacggataagagattctgggttactgaaatcctgtatggatgctaaggtgctatgtagcttagtccattcccttttttgttgtggatgttaattatctagaatattgcaactcagtagtggctttaagcaggttttcatgtactagccagggaaagttaccaccattaaaaaaaattattctttaggaacgtgtagcctggggtctttataataacaacagttgtagtagtagttgtagtagcaatgatgataatataactgtttcattttattgtaaaagtaatacacagacacattcttattgtgaaaatctaagcgacataaatctgtacagagtaaaaattgaaatcccccccaatagcccctcctctattaccctagatctaaaagcatttattggattgatttatttgtttccgggcccttttgtatgcacttcacatgactgcatgtatgcctattttacgcacatgcatatgcacatacttctgtggatgtctatatgcatccacacacatgtttttaaagaatcgtagagttttgctgtttgttttggtttgatttttcacatgtgaaattttgttatctatatcctgaaacttcttagagaattttcttagagatttttccaaggaaagacactcagatgccccgcattctttttaactggtgcattgcatgcatgtcctgtaccttgttttatttatcccctgtttcccctattgctgtttattatagttgacccttcagcaacatgggggttagaagcatcaacccaccacaatgtagaaaatttgtgtataggtttttttttgtttttttttttttttttttttgagatatactcactcttttgcccaggctctggagtgcagtagcatgatctcagcctaccgcagcctccgcctcctgggttcaagtgattctcatgcgtctgcctcccaagtagctgggactacagatgcgtgcgactatgcctgagggctaatttttgtatatttggttgagagagggtttcaccatcttggccagtctcatcttgaactcctgtccttaagtgatccactcgccttggcctcccaaagtgccgggattacaggcatgagccaacatgcccagcccaaaatttgtgtataagttttgattcccccaaaactatgattagcccactatcgactcaaagccaacagtggattaaaacgtattttgtatgttacatgcattatatatgtattcctacaataaactaagctagggtaaagaaaatattaagaaaatcataacgaagagaaaacatatttactattgatcaagtagaagtgaatcatcataaatgttttcatctttgtcattttacatgaggtaggctgaggaggaggaggaggacgaggaagacaaggggttggtcttgctatctctgggtctctcaggtggcagagaatttctgcatatgtggtcctgtatagttcaaatctgtgttgttcacgagtcaactgtatttgcttttacaagcaatggtggagtgaatatcctggtttatgtatcatgtatctacctcaaatatttcagcaggacagatatctagaattagaatagttactttgaaagatgtgcgtattttagattttgatagtgagcaccaaaatattaatatcatctccaggactgtaccagttttgactcccaccatctgtgtttcaggttacccatttctccacagtgatgtcaaatctatatattattgataggcattttattcgttatttgattttatttgttaactgatgtcagtcttttaggcaaaagatggccgtaaactgttctaaaccaccaatgtaactttgaaaagctcatttgtagtgggagcgagttgtgaactgggtattgcctgcgcttgtatttctgctcttggaagcgtggtttatttttagtcctggactcactgacaacccacacccaaactagaaagctagaggagtttgagggtcctttacacagaatcaggctctaatctcgatcctgtcattacatgcaaagcaattgctgctgaatggttggaattggttctgcctgggacgaagccctttactctgaaaaaggagcgctgtgctcatttgagcactgccaaaatcctggaccctctgactcagtgtggagtgatcgtgcttttgcctagagaaactgtgtctgagaaatggagcttctgcaaaatacagctcagagggaccatcaggggttgagacattctagaggccaacaggccagcttaatgtatacattagaagtgccaaacttctcacccctatccctagtagattgacccaagagaactacagaattcatgtagacatgctcctcagtttacaatggggttatgtcctaataaacccattgtaagttgaaaatatcataagtagaaattatgttttcgacataggatattttcaccttaccatggatttatccagatgtgaccccatcgcaagtcagggaccatctgtattaaacaaatgtgaggcttatgcaataagattggaaggagcgggatgcaagaggggctttcttgaagctgaaactgcattttttcagagcaagtgtagtttttaggtagatttcactgccgtctcccttaccctggtttccctaattccctgatcttgatcttgcctgctatgcttcccacagcactcaccaccatctattgtactgtacttatttcttctctgtattacttactttctgctgcccctcccccacccactagaatgtaaactgtctaatgtcagggacctttgtttgtccggccccactgatgccgacctgggggctagaacagtgcctggaatgagatcagcactaactaaatatgattcaggtgtttgaacaagccagtgactcaaagtgcttttgatacagataaataataaagttttctaaagatactttcatgctcactttaatgaagatggagactatattgtcgtccacattaaatttggaagtgaaagtaaaatatttctaagtcacatcttgacgttgccactgagctaaccccagtatagatgattacattgaagttcaagtccttctttctgtctaactggagtcttgcttgctctgaggtatggcaactcttatagaaagtattttttttagtggaatgtctgctatttcaacagccttgggaagttataataaatagttatgaaaatgagaaaagaaaaaaatggtttccattcttcttttaaattgctggcaaagttggaagaaaaaaagttacaatattattttatgagtcaaattaaaacttgggtagttgccttctgcctaaggaagtttcatttgaagatgacattattgattgccaattttcctgcactttttcagcttcctgtggggtatgtataaccattccattaagggtccttgtagctgaaatgcaggcagggtggcccttgaatgcatatgaacccatgtgatgttgaatgtctagaatttttttttgtggagagataagagtattttctttccccacttctcccatttattgatgttggagaatcatgccagagctagtggccttgatatggctctttctcagtctcttttgagatggaattcaaatttgctatccccagatgcggtttaaaaggctggcaaagtgttgtcatcaagtgagcgatgattgtggatatgatgctaccatttgatttggggtcattggatgccctattcctgattaaggagcactgatgttatcaatggaaaagtgttcctctgggctccttaatatagttgcagtgtttatgggaaggggacttgtccctgtgtgtgattgtgtttgcatgcactggtggagagatgttcaggtttagttatccagagagcagagcccgactccaaataattttgatgtggatttaggtctggttctcatgttgtactttgcagatcttcagtgtgtctgactgtgaaaacttaagtttaagggaatgtcagagccgttattgcaagatggatctgtggggatctaatcactactgaggggttccaactttggggagaaaacggactggaaaatctgtattgccttagtgcagccaagagcatttattgggtctttacataatgtatttgtttttcattaaaccgttcagataaagtcttattaaagtgccatgtattatgtatcatgtttcttatgaaaatgagctgaaggaaaaaattctctcctcttcttgggttatttacaggcttttctaatgccagcaagagaaaaaaaaataaaggaaagcagtgcgaacccgtccgtacagcagattgcttgacgcaacagtaaagaatgggaaagggagagtgaggattggaaaggtagaatggttggccttttattccattcgtgttctgtggagtgactttctctttagttttgtgaatgcaaaaataaataaataaaggcaggtaggaagtaagagaagaaaagagggaattcttatattatttgttaatcaaagcttgtcccatgaatgtgacctctgatgcaacgtacagcaaacgtttttcaaactaaccactgccagcaccccccaataaaagcagtacagaatagcagcctctactttcccactcccctggatgaacttctgcctagggctaaagggttaaacatgctactgtgtccctgataaattgatgggatgtgtgagccccagagaggttggaggcactggttttgcaagatgaaaagtggaaagaaacagcgggttggggcctagtgttaggcagagtgaagacttcatagttatttcaaacagaacgacaacaaaaaatagagccgtgggataattagttttcttttcttcagaaagcattttgattagcctgcaaagtgagttgtgccttgcgagctgatggctgggttcagagccttcatttggctgaggatgtcggggtgagccctgaggaggaggggatatttgggatgtccctggtggccagttccagggttctgccccaaatattcttttgtgagagagcccccatcccctctcaggtacggttccgtcctgcaggtcagtgagaagctgtcagcaaggtttctttcaggaagcccaacaatcaaaaaagctgctgtttagacagctgatctcttggtctgaaaacaaaaaaaaaaaaaaagaaaatccaatcactgggtcaaaatctatattaaaaaaatatggctactcttcctgatcacgattttattgctgccaagaatgcaagaatgtgcttttttttttttttcctgtcaggaccaaggacgagttagagtcttaatattttctttcgatttgcagatcacatcctattttattgcataaagactaatgaaatctactaatgaataattattacttcataaaataaaggggaggggagacccgtttgcaagagcagaatgttaatttggccaaggagggctggacaggcaagaataaaaaaaataaataaataaaccattgtaatttgctccctgcagccgacggagtaatctcttatcagacacggacttccctaccctgtgcatttataatttgagaggagcgggtgttctgggctgggagaagcccccttccagtcgccccgagctggcacgttagtccaacaggcttgatttccacgccagcctgggcggttgctctcattgaacagctcaggggctggttcgctggctcggggctgcctgcccaaccaaggcgaggcacagagcgaaagctgcgccccaaacgcccgggggtgcatcggcgcttcggtgctctgctggggggcgcagaaacctcctcccctccctcagcccaagctccctcctgcccccagcccctaacgtctcagcactccacctcctgaggaggggaaatcccttttctgtgtttatttggcaaggaatccggcaaacgcaccgccaccaacatctaccactgtgggtcccagctgggccatcgcgctaattgtccagctcgcctgatgccgggcgcgcggggcgctcgctcgcctgctcaccggcagagggttttagcagaccgaatttaaattttggtgagtgtttttttgaaacaaacaaaaaaaataaataatttttaaaaaaagcgaaggggagggaaggaaaaaaaggaaaaaaaatctttcccctggacccatttgacaaatgaggagacagacagcatcagaaccaacggagtgagcttcagtgtgagtcaaaacctctcttcctctctttcaatctctctctctctttaccctccctctcgctctctctctctctctctctctgtctctcccctccctctctcttcctctctccctctctacctccgtcccaccccttcctcctctccctccctccctccctctcgctatccttgcccccctcccattcagcctcttcgggagggcagcgcatcccctgccccttccagagaagttccctctgccggttctcgtgtcaccttcacaggggtatggggtggggggccccttccactttccgggggatcaaaaagcaggcccaacaacccagaaaagccagacgaccgcgcgaagggaaccaactagtttccaggtccccgcaagtgttttagttggaggcagaggaacgccgggatctagcacatccccaggcggggagagccagggaggagggaccggcggggtgcggtggggggagggaggaggaaagagggggagagagacagagagagagacagagagagagagagagagagagagagagagagacagcgcgagccaccggtcattgacttagataaccagcaaaattaaaaaagaaaaaaaaaaattgtagcgcccaggcagagagcaacgtgattgcattcaagcgtccccactcgggctcggcgggcgccagagagacatgatgcagcatcctctgacgggggccacctgcgtggcgctccccaacgtgggcatgtgtccccagctttcgtgtgccttgacttttatgtacttacagcaggtaaggcgcgcgtctgccctcggtggctgctttcctggggctgggccagatgggtccccgcgcgtactgggctgcgcttcggtgccttatgtaggttctgaggagggggctcccgcgttgcgatggaaagggtggatggaagcctcctgctctctgtggagcccgggcacctcgcgctgagatgtttctgcacctgtccgaatactttaaaaccgcctgatgcccagcctgggcaccggaagtttgaaatggaaaactgccttttccttgctaccatcttccttgtgtcagtgcctttcgtggtgatctgagtctaagacccctttgatgctaagagtttgaatctttgtggaggcattccggtgcctgtagtgttaattcagctgatttaatagagagtggaaaggagaagtgtgtggtgtgtggtgtggtgtgtgtgtgtgtgtgtgtgtgtgtgtgtgtgtgtgtgtgtgttttcctaagtttgtgtggtgctatattcggtccgcatgggatcgcagcatttgaatttctggagtgtgtcagccccagtctgccttcaaactcactggcaatgctgtgaagaaggtgagctgtttaggatgttgtctttgttggcatgtgttagggtgtttgtgtgtgtgtgcgtgtgtgggtttttttttccctttcacttctccttagtggtcttgctgagggagtctgtgtttgctttattttccattcattgtgcacatttcagtcttttgacaccttactctctgtctttctcagggtgtttccttgggaccctctctgctctgtcattctttctttattggaagggttgcttcctgagttggttcctgggcttgggaaatagctcagcactgcccttgtagggtgacaggccagctctctgtcattgggcaggggcagtggatgtgaactgaagggctagaaggggttttgtcatgcagatgaaaatcctttctccctcccaggatctccatcctattctatgaaggtttacagtgattatactcattttatctgtttttccacggactcacttcaagagtaccatttgttaacatgagtgtgtgaacagaacttcctatgcaagagttgagagtggccctcttccccaagaccctcaatttcaacctgtgttaaaggaatgtatatttttataaaatgtcaggattctgttttgaacatttgggtgattttctatcaagttggttgactccagaaaatatttcttaggtgtattttctgttgcatgtctttttgagaacagtcttaaaaaaatcttgggaaccaatttgttcttttaaatattattttattacgttcattattgagtaaatcgtgccagaagacatttcccaagagagtattgataacatattatatgcttcatcttccacaatttctgtgcctttgctgtgggtgtgtgtgtaaatgtgtatgtgcatgtgcgttttataccagttatttccaccggaagaaaattctaatgagcatttctatagatgctaagcctcagttggatttatcaaattattactgagttgatcttttgccttttacatttacttctttcatgttatttattaatcaatttgaatatcatttacctagcaagtagaatgctataggtactcaatgttctccgttcctttgtgtggtggtgtttgtgtttttttcaaaaatacatccatgtttctgccttctagatttttaaattggcttactcatttgggcacaacttaggagagaagatagtgactttgagtgagaggttattcttgccatgagaagaacaaacatataagataaacacaaaggttctcagcatcttccaggcagtctctcccacgaggaaaaacacccctgctctggaaaggggaggcttgaagaaaacattggcagccacaacaaatatttagaagtgactaaatcagcatcatggttccatatgaagatagatggagggtggattttgaaatgtgctttggaatgcatctccccctcccctgaaaggacttgcactgctatctgtgaaagtgtttataatgtgatactatgacataatgtgggaatggtgtgcgtgtgtgtgtgtgtgtgtgtgtgtattttctctgagcttcactgaatacctgaagtataataaaggcagtcatttatttttgcctgtttcattcagaattaggttttctagcccttcctggaagctcaccgctagggtgtaagtgatatacctggagtcatctgtcctggccattactgtcgtgatagttcgtttaaaagtctcaagtcacttattttatttagcattccagacaatcggctgattaagagtgtgaaatagtttaatctccacatacataaatcatatcgataagtaatatcttgtacccagacaccactactatattttttatctgcctttaatctgtagctattattggatctctagctaattttggtgaacagaagggtaatctttgatctcaaagtaaattgatcaagtggacgaatcaggcaacatttatgataagtaacaccttcactgaaaacaattttattttataattgtttagaaataaacataattcagaagtctttgtcattgagatcaccaattacataagaaagtaatcaacccacattgatcttattttggagcatttatcattttgttttataaatccacaaactctgaccaccggccatcgagtcttccctgaagtatatttttctggaatgcagtttcatatggttatttcttatccaataactaaggaaaatgacttcattaaatgctttctttgtctcagcatgaacatccaacctttcctcctaaattctcacagatttatccataagacaactcataaaaacaaaaatcaattggggtgcctcagcatcggagtctactctgaatggccaagtgtaagtggcaacatatcacttttgccacgaataatttatttacttaggccaatgaagaagcaactttgatgtttacattatttgacttatcctgtttcacttatttgtatgtcccaataacttttatctagataagtgtttacttacagctacgatttcttttcttttctccttctcctcttttttcctccacatccaagatgttactacagtttagagctgcaaggtgggataatgctaaatagtttttttggcgtctagatatcagacccagtgatgtactcacataggaacacacaaatttgtatacatacacacagacacatatacacacacacctagtatagagcatatattttgtggttgtcaaccactttcagatggaacggacaagtagtccttggagcaactggcttcaatcttgctgtccagggaaagtccctgcctcaatctcctttcctgagtggcttcatgctgtgtcttctttgatggtgaatcttcttgaagctgaacttagaactcacatatccccaatacttaatcttccacgttccaaagtaagtactcatggaaccattcttgctttgaggaataattctgaatacaattccacattagggggtttgcagcaagctaggtcaaaagagaacctattttgttttcctgatagagaagaaatagaaaacagccacacacacatgcatggacacacaggacacagaaatctagagatggtttatttctattgtaagtaatagagggcaaaccttatagcacccatctcatggtaaggtatggtgaggcaacagacaggatggatgatgagattcgttttctgatgcaaactgcgtgtcagattccacccagagctgtttttttttttttccactgagtttaatgtcctgaaagaggatcagtagcatattaacttaattttctctgttcttacaccaccagcgtctctcagtactattctaagaaagcttcttatctgtcaagccctatccactgagaacctttttatcagcctaaatttaaaaatacgtcaaatgcttaaaatccacattagagggggcagaaaagagcctctaaagtgggccatgccactgtcaatattcgaagattggtaatttttcccacttaatgatgatccatgtggtttgttttaagtagtgaagtggtttgtacaaagggtaattcccagtaaatgaagccattgctcactgtggacatcttcagatcgaaagcaattgaactgaaacctgcatatcaaccctttctgtctttaattagaaagcgattctcagttcagggaatcacctggggaagatgggctctcgcgcgaaggctgcaggcgttggggagggtggccccatgcaccagccacggttataaattttggaaacattaggtaggtcataacaattatgactgtgtagaaaagttcaattctcattgcagttacttaccttgtgttactccatctgatgatttatagggggccaaatggaatttatcacattctttctttttggcttaatcccgtgttgatttattagatagtgctatggattgggggtggtcgatagtgtcagtaacgcagaaaagaattaggatagattagcttcatgtctgaattgtttaaaggaatttaagtggctggaatgagcacatttccaggcccaggtggctgcctgatagaagaaaggtccctcagtctctttctagagggatgtcttacgtcgtaaattggttaaccaatctttcttgtttctctgatcttttccgattaagagaaggcatgaaatgttaggctgttatcagccaggtaaggcccacatttcaggtgagctgggggtcatctgtgcttcccccctttggggaacctatggagggccgcgtgttgtggacatggactgcagggccacctgggctgcctctgctttaaaattacttaatccaacaatcacttctgaaaattgtaagcatctgttcatccacagaccaaagccttgtgccattcgcctgctctgcctgccattttgaggcagtttctgtgttataacatgcaactggccgctcctgcctttgcccggctggagaaagtctgtgttattagtgctcacccgccatctgttttccttacagctgacccttgagtaattctccagtagctgatggactgagggtagacagtcttttttagggttttctgattcatttaaccaggttctctgccccaagaggaaacataatgcttgtttattcatattggccgggtgaaaacagtgtagtttgtcaggcaaataatagtcctgtggaagggaacgaaattgcagcattgtaaacaaaatcaggttgctgactctgtgcctaagggggttgggtgatgagcagcacatgtcatcccgtgaaggaagcagagctgacaggtgtgggtgtaattgtcccatctgcagacccctttttaatggacggggagaagtgtcccaatgttctgtttaattcagttaagaaaagcaaagaaagttccattcatcaataaagtttcctattgccgggtgctgcccaagagaactctgccgggctgagcgttggcccgtggctgttggcatgatgcagcttgcctcacccagccctattgagggcggctgtgtcagatagggtcagctctcaggcacaatggcccagaagagccctggccctggccctttaaccatgctgaatacaggtgagctagccaaatgagcaatggacccgcaggccgcctctgctgggagacagagctggccagggttctctctgaaggatcctgaaatgcagttcctgagcctggcatacgatgaggaaagagcttgtgtggttggaatgtcctggctcctgagagggtttggggaaagaggcttttcatggttgtttctgatcttcctgtcatgctatagccctgatggattgatcccggctaaaaaagtgacagaatttggaaccagggttggtggggaggaggtagagagaaggagaagatgttgatcaaaactgtaaaaactgacgttaactgtggagcacccagagtcctgttggtatgttttatcaaaacttcatcaaggggcatacttattaacatggaaataattgtcatggtccagtatttctcaaacttcagacattcaggcaccacttcctaagtcctgccaatctacccattaccagagttgatatctacttaatattttttaaaattaacttacatattaaacatagacttgcccaaaccaaataaaacacagtcactgaatcacacctgtgatcacactttcccagcatacgtggaactaaatgtgtattcattcacctgtccatccacccattccatgttgatggaactcctgataggtttatggaactccagctgcccttctagactctcccagggagcaaagcaaaggcccctgtcctcacagatagtctgttacgttgttcatctctttgccatcttgtgaaccatgcatgcagtacaacgctttggaaaacttccgcttggcctgctggattgcctgggaatcctctgccgtgtccggtctggaattactccttccgctaccttgacccaatttgcaaggggcaaggctagagttaagttctttgtgatgcttttttttccatctgccagatcagcagccactagtgcacaataaaggaaaatagccatacattcaacgtctacatcccaaggagggctttgagatgatggagctgggactgggaaactgctgtggtccttagcactcagccaagctctagctgaagagcagtcctaccctgttttgatccttttctttatgtgtcttgaaacagaatcaaaattaggaaggggaactggagtggaaagcattcagaaggttagtgtgtgttcccagggatgcaatgactattttttttctccccttttgtggccatagaacaaagtagaagcaactgtaggatttaagtgactccaatttcccaggcctgatgagtaaatgcataaaaggtttagtcttgatgagccttttcttttttttttttttttttggcattcgatgtttgctcaggattcgcctcaatgactagattccccttatcaaaaacagtaacaaacatccccggtttttcccttccatagatcagcttcctcttgctctgcctgaagccaggcacggggcaagccctgctcttatggaaaggttgagagcaatattggtacctaaacccagaaggaacagcgaggtttacacactgcagtagccagctgtccatctcaagtgtctcacaaaattcagatgaaaaacccagatctatttagagccagttggtatcatggtatcagccttcccaaaagtacaggtttttttgaaaaacgatagtgtttctgaagttatatgtaggacagaagtcatgagctgaaggcttaatcccaactctgttattcaattagctgatccagctgaattgagcaagatagtttttttttgtttatttggggacttaattgctccttcagaaaaacagggattagaacaaccatttcatactgttctttgtgatattaagtaagatgcaaatgggaacacttagctcagtgcctggggtgcagtgagcagcctatagatgtttgataaagaaatgaaggaagggccgggcgcagtggcccacgcctgtaatcccagcactttaggaggcagaggcaggtggatcacttgaggtcaggagtttgagaccagcctggcctacatggtgaaaccctgtctctactaaaaatacaaaaattatctgagcgtggtggagcacacttgtaatcccagctacttaggaggctgaggcaggagaatcacttgaacccaggagacagaggtagcagtgagccgagatcgcggcgttgcactccagcctgggcaacaagagtgaaactctttctcaacagcagcaacaacaacaatgaaacaaaggaaggcaatatgttaaagaaacgtaggatttgtttattgaagctggacataaacttctcgtttccatttctctcaaattaacatgattaatacacccatggcctgccaaggacacagacacaagggacttgggtgtcactccgggtcttcttggttccactaccctgtttgggagctcttctctttcttcctccagtgagctgtcattcctgcttgtgtcactggattgtaatatggctacacagctcaattaatgctcagtgtcaggaggagggaaaataaaaattgtcttgctcttgtcagtagcgaagttatttactttcaaaagctgacagaatcacactgcagggccttcatttatttccattcagaacgtcattattctgtgatgccagagacttgggcacacgttgaagtttattcccataagctttaatatggcggggccctgctaaagtgtagatcgtcacccaggagagtctgggagagtctggcggagctctctgggggccccagggtgcctgggtgcttggcactgatgtctgggagggtaccctagtttcaggatggaccggggaagctgacacgtgcattttcatgccctggatctgttgtaggagaggcagcgtgttccccactgctgctcttccttctgaagcaaaagaaaggggtgtgggactcgtacttccacatcactcttcatccgggccactcctggaatttctggaaacacaaaagcgcctcctgaaagtggctttgctttggatctatctattgtctctgcttaaactcgttgacaggttccctcaaccaaataatctgtataaaactatgcaattttttgtttgtttgtttgctctctttctttcttccttttccccctaagggtttgcaatgagcagttaacacaggaaggggttgagtggagaaattctcttttcttcatggtgcagtggcagaaccttccactgggggtctccatttagagtacgtgactcaggattcctgaagactttcttttttcctttctttcttcttttttatctttttttttcttttcttgtctttttttttttaaggctctttggttccgttcaaaaaatgaggctctttcggacagcagtaggagaggcagcttgtaagaccatttaggtaacgagataagccagccttcttccacaatgatgatcataataataaaataattaaaataatgaaataatcaataacttttatggagtgctttgtgacaagcacacgaataagcacttttacatggattatcacatttaatcccccacaaaaaaagcctccagggagttgaaattaatggcttcatttttagatgcagaatccaaggcttaggtgggagagctgatatttaaaaccagacacttttgccccagaaccgacacttagaaccacgattctgcaccatccctatgtcctcctcctcactgtgccggccagtggctggttctgtatgatttacggagagacctctgccaggttcctgcgttggaagaatagctccaattgatggagtgggcctcttttcctttaaaggcaggacttgccaaaagaggaaagagttcaggcgacctgtcaactttgatgctcttcccgattttgttttttttaagtcattacgattttgtttaatgaattgcaacaaaccatgaggcttttggacttggggaggaggaagggagaggggaaagaacgaggctgtgagaatcatcagcactgagaatgatggagtgtatttctccgcaaccaattccaatccccaaatctctgttgtactggggagctctccaactaacagaggaaacgcagtcactgcccggcaccgtattaatgatttatacaccccgcaccactgcttttgttcacttgcggggcctggtcgtgttcataacggaatttcagggagtggggtcctgccttgccatgctgttttgctcagtgcagtgaagactgcttcataaatcaaaagaatttagtgctttacaaccttcctgagctctgagatggtgtgcgcctgtgtgcggttgtgtatgtgtgtgtgtttaatcagattcacttagacacattttcattgcctttctgtaaagaatgaatgaagaacgggatgcgatctgtcttaggtgtttcagggctgattggtttgtttcacagtggcatcacggtcctatttgtttcccatttggtgtttatgctttatggtgttgtctgtgaaaatgggctgacactcttttattagcataaagagattcagatcacattagaatcctccgtccttctatatcatcaaaaacaacaggcaggggagagggcgagttgactgtaagccgaatcaccatttgttcacgataagtcaacaggagcttgatgtgatctttaaacaaaggggtttttgagccttttaaaaatgattctttttcaatttttcactgaaaaagaatgcagcttcgttttgaatgttatcgaggacatttattttccggattgggaattctggatgtaggaaagtttcttctcttgagtaagccacagaaagctctaattttaacctccgcttttatttttttcctaattggaagaaaacaaatcataacctcatatattttatttggagccctcaatcaatctttcaagataccagcagagaaaagctctttttttttttttaatgaattgcacttgtacttgtgttttcttaattatgtcatgcatttcattttgtgtgtggtgatatttctttccctatagaactgagaactgaaaaccaacagaagacagagtaggagtttgagggggtaaaacagaatatttagaaaattagaatgatactttaaatattccagtcaacagtaatatttttgtctatgataaaatcttgattttaggaaatgctcttgagttaaaaaagaaagatacgtaaggcttttaggaaataaacatgtcattttagtagaattctgaagtgaatacatgaaggaataaatgcaaagacaaatgattaaagccctactctaccctacccccccccccatactgggggcttgaatttcttttacaaatgtgaaagttttagctatctggttcttattaacatttatgcttataaatttttttaactgtccagtatgcttgtcagtaatgatgaaattgaagcaaatattcattgtggaagatagtcttttatagccttcctgaaaagtggagaacagaatatatatatatatatatatggaacattacacacacttttcatcatgggacatatgatacagcattttggactcggaaagcaggtgtccagcaaatgcactttacatttatattgtactgatttttgtatttttgtttgttctctattatttgaattcgtgagtgtctcattgtttttaattatgtctacatggcacaagacagcagtcaacatctgctctattgtttacttggtttacatatatctttgatgggttactaaacaatctatttttcaaaccccaaacagaagaaacaagctgaacccatattacagcattttgtaaagacccattatgcaattagcacttgggatttgtgcaaatctggtgattcacccaaacaaacatccctttattctgatagttcttcctggctttgtgagaaatatcagtttccaaaaaaataaaatcacatttcctctttaatcatgcagcgtgccaagaagattatgtgtttatatgagggatggatcctccactttgtgtatcagagaaagatcaacttttcaaaataatgatgtctttaattcaaggcagcagttactatattacataagacaactatctgcttacacatagcagacttttgagagttacatggtactattggagaagagaaatgctatgtttttacctgtttgtataatcttcctaacattgcatgatctgtttacagaaggcatagctggtcatctcttgcaaggcatgtgaggcccagaatgattaagtcacctcaaatctgattatttctctgaagtcaatggttaataattaatttactcactcattcatgcagcacatccttatttagcctctgtctcagagattgggttggtcattgaagggatacagacaaggaaagcaggtctgcttttcttcatggaggttacaagtctgtgggagagagacagcccatgagcaagtgatcatcacataactgtgccttgccaggtgtgataaatgctctgaaggaaaagagtgggagttggattcaggggtgagggaagcttttttgaagaagtgacatcaaagctgagatggagtgggaggtaggcaaggaggtggggtcagggtggaagagaggattcacactaaggcatagagtgtgtgtagtgcctgttgcttgcctaggtgtctttaagatgctggaaaaacaaagggaccagggagccagtgagagaggggtaaagagacacataagggccagagacgactggagtttggaaatcttgacctagagttggattttttgccaagacgaatgaagaagacagaacacacacacacacacacacacaaacacacacacacacaataagagggtttaggcaggagttaaatgaccatatttagcctttttacaaaggccagtttggcttttctgcagagaatagagggagacaagatagaaagctgaggacgggggtgtcaagtaggaagtcactgcgatactactggtgcaagctgatggtcgcttggactaggagtggacagaaaagaaacggccaggagtaaaacgttttgaaaatcaagcctgagattcatccccgaagctgatgttcagccagaagagaagaaatgcaactccctgaagtcagacttcggcaggctttggtgaagtcaggtggcactgacctgggtggtatgcagcttcatggaagtgagtgacaggccagtctcagcatatcttaggccaaagctcccagagctcagaatttttcatctgaactctaccatcaccaccactatcaccactgtcaccaatccagtgctattatcaccaccactatcaccatcgccattaggaccatcaccatcacgaagcaactggtctcatgtatgagttggtagcagtcaccaaagacaaaggcactcaccagcttggtaaggtgctctgtagcatcccacttctaatatggtgggtgagaagtggggagtcatttttatgaaatgtccactgagcagtacctccacccgctgcctccagccacaggagtacaggagtgaagtgcattcacgggaatgtgaaacagaactgactttgagtctgaaacaaattacaaatcttatgggcctccaactagctctatgggcatgtttctcgacttctctgcagtttcatttctacatttacgaagtagaggtaacagcaagaccacaaagacatagcattgttaggagtatggcacgagctagtttgtatactaccccagtacagtacccagcaaacagaaggagctcaatacatacttctacttttgatgctggaggtgatggtggtgatggtggtggtgatagtggtggtgactgtggtggtgacggtagcgatgatggtgatgatgtgaaaatggtggtggtggtgattgtgaatggtgacggtggtagtagtggtgatgaaggtgatggtggtagtgctggtggtagtgacggtgctgatggtgatgtagtggtgataatggtggtaatggtagtgacggtggtaatgatggtgatggtgatagtgatggtgttgatagtggtgttggtggtgatggccatggtaatggagttgggatagtggtgatggcagtgatggtggatggtagtgttggtgatagtaatggtggtagtgctggtggtgctggtggctctggtggtggtagtgacagtgctgatggtggtagttgcagtggtggtggtggtggtgatgatgtttggtgatgagagtgattctggttagatgcagcgtggtagaatagtttcacacataagtacctggcttcagatttggttcaagtctaccacttaccacctttgcaccgttgggcaaattatttaacctttctttgttttaattgtctcatctgtgagatggggatggtgatattcattgtcattatgaagactaaattatttaatgtttgttaaaatcagaatagcgttcctataaacaaactcttagacatagagaacgtttgttaaataaagtgtcagtgcagaatacagcttttaacaaaaaggtacctagtggcttctggacttctgctatattcttgattttgctttttatagcaggctgaaaaggctgtctttgccttctctcaaccgccagacccaccccccatctctccatgtgttctgcgtagaacaggtgtgtggtgagccgaagttctggcagagcgcaacatgaaaaagactcccagtaattataaaaataacaacgaaggctgcttagcgaggtaggcagatgagcacaccactagccagaatgataaatagcgcctgcaaatgttaggtcccagtgggagtatgggaacatatgggatgaaccacactaaaagttgggcatcattggtaagttttagatggttaaggcaggctaactccagtgccaatttttttcttctttctttgtttttttatcctaattttaaatccttcagttcccttttgtccctttgttctattttggtcctaaaagaagcattcatctttgaggccagccagggaatctccaaggaagtgaggtctgtgccgtaatcctaaaaacaaatggccaccctggagtctgtgaatttccacgttgagctctattcaatattgttgggggagatgtaaatgaatgtggtaaatatttaatggaatgctgacatgttgagtccagacctatgataggtgggcgtgtagaaaaattagtgcctaaccagctcaataagtttacaagcatttgtagaagaggcaaacaattcttgtctgccaaacattatttaaaaagaagacgtggagggtggtaggttgatttcaggtcagtgtttgtatgtctgggtctgaatatagtttggagactgtacaatctgtttggcatggctctgcagcagtgggatttctctggaaggatattttggaattcttgttcaccacccaccatgcttttcctgggcctcagaagagatttcagcatcgaggcgagatttagaatgtgggcacctgagtgttggtgccagctccttagtagatttccagggttccttacttagcaattacatcaacatccttggtcatgtgaagcaggcagaggaaaggaagtaggatttgggatcgggcaggtgtggctttgactgccggccctccctgctcaagttgccatgaatgatgtaaggcctctgagttctaatatcctcatttgtagaatggggctattatgagtaccaataccatggacttgttaaaagactggatgagtcaaagtgttggagtgcttagaattgtgtttggcacatagtgagacctaggaaagggtttgttaaaaaattaagcagaacatatcttctaggactgccttttatgcaagtgtacgtgtatgtatgcattaatctgtttttttgaaagttaccttttcttaaaaaaattaattttattgtaagttgcaggatacatgtgcaggatgtgcaggtttatcacataggtaaacgtgtgccatggtggttgtctgcacccatcaacccatcagctaggtattaagccccatgttcatcagctatttatcctgatgctctcccttcccccaccaccccctacaggccccagtgtgtgttgtttccctccctgtatccatgtgttctcattgttcagctcccacttgtgagtgagaacatggagtgtctggttttctgttcttgtgttagtttactcaggttaatggcttccagctccatccatgtccctgcaaaagacatgatctcatccttttttatggctgcatagtattccatggtgggtatgtaccacattttctttatccagtctatctttgatgggcatttgtgttgattccatgtctttgctattgtgattagtgctgtatgcactaatcttacaaccacttttgtactagtccagaatctattagttttaatggacagctacccaaatcaaacttgcttaagcaaaaatggggatttgttgattcatgaaactgggataattgaaggtcagtcggtagtaagtgaatcatcatttaaacgctcagcactctaattgagatataaacagatgtgattgtaagaaacaccatgaataaagctcaaacacttacaaatgggtgcaagcccaaagaatattttaagtatgtggttatattacttagagcaaccgcacaacaaccctgtaaggggagtgttattgccccaaatttataagggaattaattgaggttcagaaagtttaagtaacttgcccagggaaaaacagccagggattttcagagcccaaatttggacccaaacttcttatggcttcaatagctgagttcctgatcaatatgatacattgctattacgataaaaataagtactttttattagtaaactggagaccagagaaattatctatctatctgtctatctatacgtatacatatacatatacatatacatatacatatacatatacatatacatatacttatacttatattgtttgttttttgagacggcgagatggtgttttgctctgctgcccaggctggagtgcagtggtgcgatctcatctcactgcaacctctggctcctgggttaaagcgattgtcctgcatcagcctcctaagtagctgggattacaggtgtgtgccaccatacccggctaattttttgtgttttttatagagacaggctttcaccatgttggtcaggctgttcttgaactcctgacctcaagtgatacaccctcctcggcctcccaaagtgctgggattacaggtgtgagccaccatacctgtcccagagaaatatgttttcaaaaaacaaacaaacatgaaatacgtggaaaggcagcataacatgggattatgtatggggccagatttacccttcacaagctgtgtgattttgggcaagttacttgaccactctgtgtcttgttttcctcacagtaatatgaagatagtcataggatttaccttataggatagttgtgaagattaagtgagttaatatacaaaggagttagaagatgtttggcaaataataaatggcatatatagtttattttaaaatattttaaaatagattgtcatgtaagagccagaaaggaaatgaggtcactcagagtggttcctcttttgatgtccccagggtgtcccacaaggacactgctaatctggggagttgaaaatcccacctgtcagaggctctctgttgccaccagctgcctggccatgacatcgcagagagaccatcttgcagcagtcagccccttggctaatcctctccaatgagaggttcagctgcacagcttggcacagcttggttctgggtccctcacatctctgtcttgtctgcaaaactaggctgtatagtctctgaaaacacagttttatctgctacctccttttctcctccagtgctgtatttggtgggttcccagtgatggctaatacccattcattggtctgataacatattttttcccctggtctgaagctggagaaaaaagcttcagcagagagaagccatctcctgttctgagatgactgctagttatcggacaagggaatgaaagatgtgttttgcacttcttaagcacagacttgcttttacaatatggggtgccttagcacctgccccatgttgtttgaccttcttgccaccttgaaaacctgccccctgccaagctgtggtgaatgctgactggcaggttcatagcgtcaaagtcacagtgctagtaaacacgtcaacgtgatttcacgtgaaaacagccatccaagctgttaatatgagcccgccttaagggattttgactttgcgcatgcctgcccttagtagaaagtacagcacatcttgctacctacttggaaatctgatggacagtcagaagctcctctggagtcctttggtgaatttcacaagagccatcaactctctacaatgatggggaatatttggggagttacatgcgcagttttctgggatgagggcacaattcagagtggtccaatttcagagtggttcatgcctcaaaaataagattgaggaaccgcagtttcacccttagaagaggctcaatggtatgggaaaaagccaaggagaaatcagcccttgaggtggagatgatgcctcagcttcacaaaaaaagggcaacctaataatctctttatctgtcctcctcctgcgttccttccccttctgttttctcctccagtggttattctttcctggtgttccctggtgattagcccatttccatgtacctctgactttctcttgcttgggaggcatttccccacttcctgaagactcagtggtgggtggtgtaggtcagctcttctccagccatcaaagtcttctcctcctctctctgctctttggatttgtattcctttacctctaaggactgttgggatggttgagattgactaaggggtggagagtaaaggagatgaagaaaccactcagattgagttaaaatgtccaagctaagactgggcacatggctcatgcctgtaatgccaggactttgggaggctgagttgggaggatcacttgatcccaggagtaccagacccgcctggcaacacagcgagacccccatctctgaaaaaaagtttaaaaattgccagacgtgctggtatgcacctgtagtcccaggttttcaggagtctgaggcaggaggattgtttgagcccaggagtcggaggctgcagtgagctatgatcatgccactgccttccagcctgggtgacagagtgagaccctgtctcaataaataaataaaataattttctaaaaacccaggccaccatttctcagagtatattaatccatatcgcattcaaaaaaaagaaagccttcttatagtattgagcacaagggagttttgtagttttgtagcctctcagttcatggggatagctctgtgtttgactaactctacggccttggccaattcacttcccctctcatggtctcagtgttcttgttactaatgtactagatggaacagactctacttcataggaatgaagaggggataaactgagataacagatacaatgaaatgagtactgtgtctggcacatagtaagcattgaataagtggtagtgactctgttagtgatgatgaagaagatgaagatgtaggaggaaggaatgaagaagagaagaagccaaaagcctagcacaggtctgatacataattctcaaaaagcagataatccaatagatagcaaaatgaatgatgagtggatgggtgggtagacggatgggtggatgatgagtgggtggatggatggatggtgtgttggtcatcaaatcagttttggaaagtctggatcaaacaagatccagcagttttttgttttgttttgttttgttttgttttcttctttacaggacttctcaggtgcttttatatgctaatagtcatcatgaattcccaagaggaagacagggcaagctgaatttctccaactcatttgtccgtggtgtcctttttacaatgagccatctgatgagccttctatccatgcaaagtatgccttgcaagatgccagtccagcacacttagcttctaaagagaaaataataggcagaaagctcaggtggttcagccagttcagcaactgaatggaattagtacaaaaatcctcatttaccagtcctggagacctgtgctgttaggagtggcctctgtgtccagctcctgtagggtcctggagcacagaaggcagaagatgtagagagtgcacaaagaaaagtccagcggagtagctgcatcctccccccttctgagaggcctcagggggtatttgtttgcctcaagcaaggtcaacaaattctcaaacccagttgtcattcatccccagacaggtcagaggtcggttcctgaggcattgttgatctcagcagagatgatgtgcagggttgatattcttagatttgctcattcagccagtcagtctggctttcagaggagaatcaggtcaggaagcgcttaatgaaccaagaggagcatggtgctgcctgaaccactggggatttgagtttgtaatgactatcagcaggctcctcacttacaaaacctactggaattttctttgtgcatctccataaccatttttagagatgtggttagtactgctggttagagtaacccagggtcctggattctttaagttacttctgatttaaaggtaccatcttcatcatccctaaaaaccataaattgaacttgatatcctttttactgttttggtttcaaaaattgcattttccatttacagaagccatatacctatcctttgttaattcctgggtcttagttttttgtttgggacatagaagaaggaggtaagctcttcaacaagaaggcacttcacaagttgcatttgttagcacgctttcatttgagcaattagcggttgaagggaggaagagttttgatatccctggcttgatcctccaaccagctgctaattctgttgtcactatgacaactatcaacagccatttactgagtgtttgctatgagcctctgagctaaacactgcagtatactgtacttatttaaatctctggaccactccatgtgttatggctactcgtgatattcttatttcgcagataataaatctgaggcacagagaggttaagtgatgtgcacgggaacacacagctgataactggtaggaactgggcttttaatgtggtctatgtggtttaatgtgagctcttaactactatactatggtgcttgcaacaagggagccaggcatggtaagaagttgccaggaggtgagagaatgtaatgccacaagaataacatatgcttagtacatacttgtcattctcataagaacttcccatggaacggctcatttgcatacactaactgaaagcagtctctaagtggggagatgtgacttctcttctccgggtgtctttttttgctagattagtcctccactgagatttccaatgggggtggttgtaatctggagagaggttggttgatggtctggtgtatcctgtccacagtctatggaagcttttcctatattcccatcttgataatttgatgcggttgtgacttgggtgtcacattgacaacccttttgtagccatcctctccttcactgggaattcatttgttagtccttggtattctaaatattatgtagcatctcagggaatttttcttgcggtccatgctaggtaatgcttttccatgttctcttctcacctacgctggatggagtttgagtgcatgtctggcagtgagtgtcatttctcagttctggttcaagctgataccctagtgtcatcattcttgatgactcagcaggtattacaggcatgtagggaaacctgactcttggtaactgaccaggcacacattctgttgtttaaccttggacaagtcacttggactccctgcgcctctgtctcatcccacaggtaacagatcattctcaaatacttattgagcaactactctgtgcccagtcctgggtgaatggcaggcaaacacagggattgaggaggtggtggaggggatagaatggaagcacacctgtgtgataatgccagctaggcctttaccatcccagggcaaatcactgctgatgtttcagaatctcagccccatagatcacgagtgctgggattggagcaggaggtagtgctgggaagacctggcatatgactgcttgtggaaggatgggatgtatatataagcagttttactggggggataatagaatggaagctcgaacagcaacatctgtatggggtgttggtggggcactgaagacagacagagctgccatgatgagcagagagatgaaaaaacaattttgaatgggtgcattgaaaacattctgaagaatgaattaaaattaactagcactttctggatgccttccaagcaccaggaacacccaccttcagcatgtcatttcactgctgtaatgcatttatgagagggtacaggtgttttgtaccatcttagccctgatgggagtagggctcaaggatgagtatatcgtccttaatcagaaacataaaagggcgacagagcccagatcccccagatccaaacccagcctctccaactttgaaacgcaggcttttcctactgttgtgatgccctcaggtcacttgtgatgaccttggaaacataggtagctctcagtggtctgggggcccctggcagcccctccaccttcctcacactttttcagtcagtcatttctggaaggatttgggaaaacttcatttgctagtggacattttagtcattgggtgagcaagaagaaatggcatacttccttatttgagccaatctgccttctcaaaagtgtgatcactattaaaagagtcatgatatggtgtgggcagtctctgaaccaaacacaatgctgaaatgactttcggacaaaggtgatggtgcacttagttctgtcttgggtggcagggacaactttgcagaagctgtcatggaacatttgacttaggccaacaagattgatctaaaaggaagaaaggaagagaggaaggaagggtatttctgcatagcaggcaagtttaaatggaaaagtggattcacagaggtatttggcaaagataatttgccagtgtggtttgaagaaaagagtgatctgtagaaaaacggaaaatttgtatcggaggatgaatttggacagggtaaagtgaggaatattatgaagggcctcagatgctgtaggaaattttccattacccacttttgtctggaaacaaagtgagtgattgtgtgagtaattacataatctgcacaaatctgtattttgaaataaacattgtcaatatccaaaagataagaaatgtgatgataggatcagggaaacactctgttttatgcattttgttttgttctgttttgatagtcaacaaatggcaactgacagcttctttttagatagctttttagaaagcaaagaatggttgggttgatcctacagtgagctcctgacctgtgggagaggcagctttttcgcagatatgattattggtacaaagaaatgtggctcaacatgcctagatcttccagtgtttcaagagatagcataaatctagattttatatgagatgcccccattaaacaatattacctttttttttttacactgtgcagacaaatcattatcatgatcatcatcatccccttctgtggactggacttggtccccacggctgcaggttgcgatgttgaccgacagaatccatgaggcaggagttggtcttctctagataccccctgtctctcatcttccagacacagccaacacttctgtttcttccttctctttcattgacgtctaaactttgagaggctaccactcagaagggccagtcacttatgttggctctctttgttagtctggtgtcaaactcctgggctcaagtgatcctgctgcctcagcctccagagtggcggagactcaggtgtgcaccactgtgcccagcttatgttagctgttaagatctgggaaaggaggttctgggcgcggtggctcatgcctgtaatcccagcactttgggaggctgcggcaggtagatcatgaggtcaggagttcaagacaatcctggccaacgtggtgaaaccctgtctctactaaaaatacaaaaattaggcaggtgtggtggcggatccctgtaatcccagctactcggcaggctgaagcagaagactagcttgaattcgggtggcagaggttgcagtgagctgagatcatgccattgcactctagcctgggacagagcgagactctgtctcaaaaaaaaaaaaaaaaaaaaaaagaagacctgggaagggagatgcagtatctgacagccagagctaaaatgcctttatctagaacaggaaaagaggagttaatacctaagaaggaaatgtcatcatggaaggtggagatagatggaagaattttttttttttttttttaggtggagggatgagattgaactatcaaagcctggctaagaaaaagcaaaatccttgatggaaatctctggcacagggaaaatgagcagaactggcaccaaggaagcattaggagagagaagaagatagtggggaagcagaaaggaacagcaaaggagcgagtatttgccattgtcttgaagtctgacttcttggataaaatacataccctagattaagggttagcaaaccatgggctgtgagcccaacctggaccattgcctgtttttgtataatcttcgaggtaagaatggtgtttgcatttataactggctggaaactttttttaaaaaaagaataatattttgtgacctgtaaaaatgataggaatttagtaaatacagtattacaggaacatggccacaatccttctttggtgtattgtcaacggatgctttttcacgctacaacagcagaattttgagcagttgcagcagagattgtaagttctgcaacacctaaaatatttattatctgagtgtttacagaaaaacatttaccattccctgcccgtgatgggcagagcagatggcaatacacggctctttatttgacttccgtatgtttcagggatctgcctgtttcttagccactaccagaactgccccactctcctttcaccttgctgtttcttccactatttaaagttcctgcattacaccgtgagcgtaataccacataatagatgttgagtagcccgacatttgccatgaaccatgtgcactgccactggggaatggaaagacacacgacatagtgtcgaccttctagaggaggctccaagaaggaagaatcacagctcagcaatactaggtgcttcccatttgggagagcagaacctatgttaagaaaaagaggttttgtttagtagttgttatttatttacaggctttatgattagtggaaggttttgaacgaggacgaagtcaatacaacttcaaaaacataagtaccgcaatcatacaggacaataatatataaatacaaaatcagaatcagagaatgtatgagtaatggtgatcgcgactggaggtgggagggacagcccttattttcacacaagataaggaagatatttgtaactcaagaacagcaaaaggttattgtatcatggcgttcttaagaagaaaacagaaaatatccccggcacaaggtataactatatatctctatcctgtatgtaatatatctcttatttctatcctactaaaatcagcagattcttttatatataagcatatatacacacagtcacgtgtcccttaacatttggcactgggtatgttctgagaaactggtcaggcaatcttgtactgaatactgtaggtgattgtatctaaacatagaaaaggtacagtaaagtataacattataatataatctgatgtgaccagcatgatatatccaatttgtcatggcctgaaatgccattatatatacagtcatccctcaatatggtgggagattggttccaggacctcccctcagataccaaaatctgcagatgctcagtccctgatataaaatggcctaggatttgcatataacctatgcacatcttcccgtatacatattaaatcgtctttagattacttctgaagcctaatacaatgtaaatgctgtgtaaatcattgttatactctattgtttaggaaataatgacaagaacaaacagtctgtatatgttcagtgcaggtgcagaggttttttttttttttttttttctgttttagatgatctgaggttggttgaatctatggatgtggaaccccagaatatggagagctctgtgtgtgtgtgtgtgtgtgtgtgtgtgtgtgtgtgtttgtgtgtgtgtgtgtagagagagagagagagagagagaaagttacataaatacaatggatcactatcttctctgcagtttccagctacctcttcctcaagtttgcttattgaagcattcttgattaagagtaaggggatatagttacctctcttctatgctcaggaaactaagagtctaaagctgtaaatttgttgcctgaatgatggaattaagtctcctgccttctggtccagtggtctttctattttacaacactaaagagacaatttgatctgacacaggccttacctaagtaagtaagagctctcccctcctgttgattgctaaaggaaagcagacgggagagacacgtccgtctcacagtgatgcttctgtcctccccggtaacttctcagaaatgtggtgttgaaagtcatcgtcaaaagctaaagttagaaacagtatcgggctgttgagtaagaggggtcagtgcgcagctgttatgggagctttttgaattgtacaacgtggccactttgatgcatgagaatcaattacagagaaaccttgtcaagatggccaaaattcagccttaaataattgaattctctgccaaaccctgtccgccgtcgttatctagaaatgcaattatgcagctaaatcaagcaactaaaattagtgtagtgtaaaaacaccttggctatctgaaagtggaggaattgacatttggatttagaaaacgccaatagttggatatgtttggcggtgtttgaagctctctcccagtttcaacaaaatctatatcaagtgtcctgtttagagtgagcagtggaatgtggccagtgaatgtttcattttgaaggtgattttcagtgattcctgggacttgggcattatttgagtggattcacttcatcagaacttcatattattgctttcaaaattgtggaactacacacacccacatgtctttctaataagaagattagaagactgacaatttgattgttatctgagccttcagtctcaggtcaaagccttcaatctgaaaccaaagatgtgtctgtaccaatcatcaggaaaacagggaatacatgataaaagtggctaatagctgccggtactgcacacatcatgttatggttctaggacttcatttaatgataacacagccttttgaagtagggactattattatctcagttttccaaatgagtgaacagggttcagagaggctaagtaacttgttcaagatcacacagctagtgattatactgacacccaagtcagtataattccaattatattaattaatatattaattcaattggaattaattccaattcatgtcatcccctaggaatttatctgctcctatgtaacatatcccaaatgattgcttgggtattttcaaacaccagaaagatttcaaatctgtgcttgaatgtattttttatccatagttttggtgcttgttagctatgccttgaaactctgagaacaagaagacatctcttgttaatgtattgcatattaatatatcacagatgaaagctcaaaataaagaatgtcgttaaaaacacaaaataaaaggcatagaaaatgttattacagactgaaatacagcagtgaaaacagtgttgtggttaggaatcgggctctggaatgtgtttgtagcttcgcactgccttgtacgagctatgtgaccatgagcaaaccatttaactagtatcagccctgtttcccatttgttatatgggactgataatagtactgacttcagagacttgttgtgagaatgaaattacataacacgtgtaaataatttaactctgtctctctgcgtagcacacattgtgcaaatacaagctggctggtagttttatcttatttacaaattgccactttaaatttgaaatcagagagagagcgggaggaaaactagactgaatatcttcttattttttttctatcagtgccaaacgttgcccacattaacctgctggatttgaattttaactcggaggcgataatcacattaatttacatttctcagtttatttttccctaaaaatcccatgtagaccccatcccttgctcttttggccaaattcagtaggatgagcttatatctcatagcctggttccctctgtcacttggtctcttggtctctctctctgtctctctctctctctgagaactaaattaatgaagagtatttggttagtcatgttaggcaagctgttcccaaaatagcaccttccattttggtagcttcaactttgcagctgctgtgtctcttcgtcgtctgggaagaaaactttcacattaagagttgctgatgcggattttctttctttcctctcccggcgttgatgagtgcttggctcctgacagaagggatttggctcccagctttgtagttcggaagaagttgggtctatagatttccccctaactctccattgatgtgttgagcttcagagggaataataactctacgtaaagcatgctggcgtctcaaggagttctcctgcatccttatggcgtgcctatgattgtaccggcagctccttaccttcctggactgattcaggtaattcaaggcctctgccagccagcaacttaactccagagtgctcagagtaataattggaatttttatggttgagaaagcaaacacttttaatacaggaaaaagccctcgcgtagtcagtgagaagacagtaggaaatcaaaaagatggatcaccctaatctagctatcgacatctctcatggctgaataaatggtgtagttgagctatatttgcttgtattgatctgactgctatttaacattcatgtcttagcttcaggaggttgaccacggggcaaaggatttgctctccttctcagctttctgagggactcagtctcccagagcagatcatgagacaaagtaacttatcatgaggtgactcagttaagagctttaacccaggaaatgaaaggagcatgaaatatgcattaattcataggacgcctccacacggattgtctattttcagagaaggctctccccacctgaatttgagtggtggcactgaggcaagaaggaacactctattgatgggtaatttatgaagctcagagattattctaggaatcccttgccagatgtgtacatcttaatgatggcaagaaagtggagggttgatatgtgtgctggttttactttgaagtcttttaattctgtgcagagaggattaatctaccaataaacaattggggacctttttttttccccctcatcataaggttttctttgcaagcaggtattgccttccgcgtttatgtctgaagttctccgttgaaagctaacatctactagcgatagaacccacagatcatagaaatccaaggtggctttttgttgttataattagttttttgagtataatcatccctttgcaataaattctgtatctcctttctacagaaaaggaaaacaaaatatatttaggtacgtcctttcacctttactcctgtgcctccctctgtcccctccagcccctcatagttaaaaactatatgataccctagctcattaattacaatttctgggaaccattctggtcacttttccccctacctcttctgaactttgctgttaccttttgttaagtgtacgaacctgggtgattagagtcatctgggggtgattccaagtcacaacaaaacattctctctttctggatttatggccgttcctctgtttggaagcttttctctgtattacctgttataaacaaatgggtcatctggagaacggtcctttgcagcgtggaacttgttgcgtcttccctggtatacacaggccggtatgataaggttgccatttctgaagtagggctcagtggcaacttagaaagttaacaggcctgttgctgctactggaaacgtggggtgaaggtcggctgttggagctttgtcagaccctctgccgacccatctgataaataattacaggcaaatcgtggccttcactctatgctgattgatgctgaaattgcttttgaaagttctcataagttcctgttatagattaagtgccggtgtaggaaaaataacggcacccactgaaatgggtgaatgtaatcaggtttaatggactccagagcttgttgggaattaaataactatcgatttgttggaatgttgctgtcattacgaaatgccactctggacgtattaccccagtgatagatgagaagatgcaagggccagctgagaaattggggaggccctatttcttcctcctttgcagagcatttgagaaacatagccagttatttttggaaagaacaagtggtcttacttgtaaatcttagcctgatcatactgtgtttttccaagcgacacctctggtaactagttacccataagttaggagagcagtttagtgaggagcctctagaccagctgctgtgatatgtgttatctcctttctttctcactgctgtggaatgcactggaaagctaacacacagagagaaactggctttacttatggtttgctgagacagcccatgttatttaccctttggcatcaagtagctaaaatcaccccagtgcagtaatatttgcaaggggagaaagggcagtgcaaagggagaaaaaactgtatcactcacagatgctcagctctgagccgatgtttctgctgccagctgtcctgcattgctgcagactccacttgctcactagtttcttgaccttatgggtttcttcctcactcaggaggcaaagtatttcctctagggaattaaggttctatcaccacctaaatatgtcattggcaagatgttaaaatgagccaaaataaaccatgtgtactccatcactgggagtaatttctctgtgactggagatgttgaaacagagttcatagtgtccacttggaaggattgttgtattatagttggagattacttttcaaggtctttccaacctcaagagattttgtggcagagtgctcccttttcatattttcaagagtcattttgaaaattcagaccagcatcgccctgttttagttgcctcagataaagaaaaaaaaaaaaaaaaaaaaaaaaaccaagtgatttaccagtcatttggtgtgccagactttaagacggcatccacctaatcctgcaaaggcagtggatggaggtatttactgatagcttcaggaaagttactcatacaggatcttttattccaagcaataattgatagttatcatctgccctacccttcctcctttaggaaaatcagaatctttatcatattggatctcctgaacccattattttatgtctacacttgttgtgtgtagccaaatagagagtttttccctccagccaggtagagaatgacagaatgactatggagaattcagctgaacctgtctggactgtctcatgtgcagaaaaagcagagaggaaaggataagagtagtattcccaagtgcattgtacaaatattggctgctttcccccttgatagagatcccgatgttgatatctttggataagaagaaccaatgtactacttaacactacttatttctgaatttctagtgatgccttgaatgatcagtgaattgtctgacctggtaacacaggagcctcagtcacttgcccaagtcagcctcgagtccagaagctactcagaggtcttagccaagccatggaccatggccaaatgacataaccaaaacaacagctttgtaactggttaggctatttggttagtgtttgggtctaatgtgttggctctgggctgcaagtgtggaccctcacccctcaatctaggtatctacctcatagatatgcccttgggccatacatggccaagtcactttcactattggacaaatcgttcccatttcatccaggtctgacagatgatgagtcagcagattattttcctggatggttgatggtgtaaatagagccatattcacctcatcatgcatttgttccttcagttatccattcactgtatactcaacctataacaaaagtgacagtcatagccactgaactgtgggttcacaatctagtggaagaactagtaggtaaaccccaactataagactataatgaagtcagagggaggaaatgataggtaatgattgttgaacacaatattgtcatgtgccaggctctgtgctaaacacttagatttaggatctcaatttatttttataataaacgtaatgcaattgggcagtatttgtccaccttcctatatctgtaattgtaaattccaaaaagctctgaaaatcaatttcttttggaagttgggcaccaaagctcatttaggaacagaaacttgacctgaaatgatgtgtagctatttatagactttctttatcccagctaatgtaaatattcatgtattttgctgtaggaatatttatgtgtttgattttcagggtgttgtcctagaccctgctgagggctttacataatcagcatttccactgaaataactttctgaaaaagcccccaaaatctgattttcaaaatgctggtgactccaacgggtcttaggtaagaaattgcagtcatgcctttaattcccctttgcctatggagaacctaaaacctacacttagacaaagctaggtagcccaaggtcacaaagaatgcgagtggtatagctgggatttggactggatttgttgaaccagggtcttttatccaccaagctaccctctaggttgaggtattcaggcagggtggcttatgaaaacacaggaaaggaagtaacccagtgcctcttagagtcgggaagagggtggtttcaaaggaagggaactggtatttgagttgggc[450 bp omitted]agtaactgggattacaggcacgtgccaccacacccagctaatttttatatttttagtagagacagggtttcaccatgttggttaggctcatcttgaactcttgacctcatgatctgcccgccttggcctcccagagtactgggattacaggcatgagccaccatgcccagcctagggctggtgaatgtttaattttctgggtttgtgcatcatttaccattcctttctcttttaaagtattattttatttttgtaagttccagggtacatgtgcagggtgtgcaggtttgttacataggtaaaggagtgccatggttgtttgctgcacctattaacccatcaccgatgtatttagcccagggtgcattaactgttttccctaatgctctccccacccccacctaagcatggcaattatcatttaccgtttctatgccttcttttctctctgagatggtaagctctcagagggctgagatttttccagcctaaactttctatagctagacagtggcagaaaaatgccaatgtatgcctctctgacgtggatagcaatggtttaaagaaaccctatactccatgtttttatttttatttcttttagagaaagggtctcactctgtcactcagactggagtgcagtggtgcaatcatagctcactgtagcctcgaactcctggtctcaagtaatcctcagcctcctgagtagctggaactacagacatgtaccactatgctcagcttttttaaaaaaaattcttttgtagagatgaggtctcattatgttggccagcctggtctcaaactcctggtctcagacacacacactgtattttgaagcagaaaccagcgtatgtattttatgagacatctacatacctatatgtagtaacaatgcaaattatagaaacatcggccttaacaatggacagagagtaaccatccttatagaaagataaagaaatctataaagaacttacaagtaatttgggtaagtttctggttgaacttgaaaaacaacagcttgtttggctctgtggctggcatttcaggtcttgatattgctgccctgcgattttatctccatgtttggaatgtctgttgattgggaaagacatcagcatgcacacctgatataaatgctggtggcgtcatttactctgaggctgctccatcttagtcactaagcggacttttctgtactgccaaagaggccatgtcaacagcggactaaattaaagagtcagggaggtggcagagagaatttggagtcaaacaggtccaggttgatatataggctctggcatttactaagcctgtggcctgaggcttgtcaattaacctcaccaagcctcagttttctaggctgcaaaacaaaagcaggaaggcctagcttgcaaagtcactgtgagttttcagtgtgattcatcatgtgtttattcagcaattatctattgagcacctactgtgtgccaggctgtgaactaggactaggtgatgtggtagaatagaacacactctagatctcttccaacaggaagttgatattctaacacatgggaaaagctagcatataaagtatgtttattctgtattattctggagagagaaggagagaggaaagatatttatgtattattattattttgtgacggaatcttgctctgtagcccaggctgtagtgcagtggcatgatctcagctcactgcacctccacctgccaagttcaagtgattctcctgcttcagcctcctgagtatctgggaccgtgggcatgcaccaccacaaccagcttatttttgtatttttagtaaagacagggtttcaccatgttggctgggctggtcttgaactcctgacctcaggtgatccgcccacttcagcctcccaaaatgctgggattacaggtgcaagccactgtgcctggccagaaagatatttgttaagaattcttttgtctgcgatgaagaaaattctaagtcctattggttaaagggggaaaaaaagcatctagctccagcttcaggcactattgaattcaggaattttgacaagccaagggctgtcactctccacctctccacagtggttatctctacttgatcctcactcacaagcacaccatgtccaagtggtggaaaagatggttcttggcaactccaagcttacatctcatctccttttagaaattctcttcccaactattccagcaagaattccagattgcagtctcattggtagatcttatagtccatgcacatctccaaatcaatcatctaatctctggttgcccactttagagccagagggcagggtcagccccaagaaagctgcatagactatgaacggaggccagatcagggacctcttaccaaaatgtgttggtggataagcaaaatctaggttcttgttatcaacaacaattatagttaaagctgtcacagacattcaaacctgtgctttctcccccataactttgcacacaccatcccctggggagcaagtggtgggtttcagatcttaattatcctgatcacttgttgccattgatcatatttactaggtagttttattgccttccacttcacttggcttctccattcatgatcagatttgccaaaggcagggatggctgttttacctggtatcttctccgttgcactaattacagtcatgtcttccactcgtgtatttgggatattccaactctttttacagactagtaagtcacaacctagggaagtcaagacagtccaaccaggacatccaacaacacaataatcagtgcaagattgtgtttctcagattcatgatccatgcagccacaccacttctcttcacatcagtgatgcataaataaatatattaaaaagagcaaacagagccttccagttattaactttgtcatgacgtagacctcccatcattccaaagcactcgaagatgctagtgacttgtcctattctgttttatataaattcacttttttaaattaagagattaaagggacactgtcaatctcttctgattaatatcagtcctataaaaagggtgtcttgctgcagcagccatctgtcattttgatcattttaaaggcatgctatatcagcaactatgctttttataatacgttggcacagggcagggagggttggaagacctacggatttcacactctctgctgctgctttggtgttcggcaatgtgagcttttgatggtggagcagagtcccctccctgtcttttaaaggttgttttgggtaagtgcttttcctgggtgatttatgatggagatactcacccctatttatgtttttcccccgtctaaagatagacctctcacacacacatcccaccagcttgcaaggagccagcatgttcacttgattcactgctgagccctaagagatgcccagaaacattgaactcaatactctgaaggtcttttcctctgagcaaccgagaccattatcttcagcaatggtcactgtctagattgagcttttcaggcttgtaaaactaggaggcaaaggctccatgaaactcattcatttattaagataatgatttatcaatcatagatttcgtgactgttgtcttgcaagctctggaggtattgggatgatcaagtcccagtctccgtcctcagaggttgcgtaggggggccatgccattcgcagtagagtcagaggttaagcacaactgtttgaagatagaactcttgagtctccaccccactgaccgactcagtatgacgtcttcattgctgtcagtggtctgacactcaagacaggtttatgcacagtccaaagaagatggcttcctacagagagatactccaaatgacagagttcctgctacatttcagagaacaatggtcctaccttccttccttccttccttccttccctccctccctccctccttccctccctccctccctccttccctccttccctccctccctccttccttccttccttccttccttccttccttccttccttccttccttcctttttgaggtgggaagatgacagcaggagctcctgcccccggcccccttcccaccttgcatccaacttagactaaagtaatagagttcaacacacccactgctgtgggagaaggtgttgcttggccattccttctcttctgctctttaatctgtattggctcctggaggaggggagaattgcagtgaggagggggatcacttgttcattccacattgttctcaggaactgctctctgaagacctatttcttcttatttcctgaggcagcacagttaaatttgaaaagaacaggatttacaacaaggaaacctgagtctggccattactctctctgtgttactcttggtaagttgcttgacctctctgaacctccacttcctcatctgtaaaatgggagtaataccaagtgtactctactcacaaggcctttgcagtgtagtcatggtgtcattagggcagcaagacaggatgcctagggctgggcttccaactcagatcttcccactcagacgcatctgagttggcatcctggctcctgtgtgatgcggggcttcagctctctgagcacccatggtttcaacctgtctgcggggatggtcacatcgactgcagaagggagcaatccgatttgacaatcagctcattgtaccaacgccacaactgattgccagcagtgttgtcttggtttgttcatgatttctggagttattgaatgttcattttgataaatcgagatgctctaggttgggaaaggagaatgtttacacttctctgctcccattcttggtggagattcctggtgagcaaggacacatgtgtttggcctgcgtggacagtgcagagatacaactggggaggtggcgaaggagagggagagatgccaccatggagtttgacatcttggctcatggctctgggtggtgtgaaaccaccatcctctttccacatggctggtataaaagccaccatcctcttcccactccctaagccaatagcctgcatagttggaatgactaagtcccagcctctgtcctcagaggttgcatcagggggccatgtcattctcagtagagtcggaagttaattacaagaaacacgtgaaggagagttgatcagtttcaataatgttgaatccttgcccaaatctttgtccagaacatgctgggactggaactggagctgggttgcaggacggggagggtggactttgtagggggaagagaggcctgtcccctccgttccatgtggccatagccttctggggacagactctttaggaccacccacacccctgttccatgcagctctggcacaccgtgggcgcttaataaatgttaaataataagaatagctcccatctgtcagtgcccggtggcaaggaggatgtgtgagtgccagccgtcactgggcagcttatgggaagcctttcggggggaaattgtagctctgagtcgcttcgaagtcccgctgcatccagatgttcccccaaagctgctatggatcagtgtccaggcaagggaggagcatgggactccagaacatctgcatcagagtgacagggggcgggaccagagagatgagaatctgaccagcagtgggatttgggagctggtattgaccaacagtacaagggctttgttgaggtttaaaagggctagaggagctgccctctgagcacacagcagcataaattcatacttccgtcatattcttggaagcaaatgccaactgggacttttcagattttgttataataacaacagcagctgctgtttttaggcatttactatatatgaggctgtgtgtgaggggtttcacttgtcgtacctaattgaagtaatatatcttagggaggaaaaaacaggcaaacaggaggtggtatggagtagggtgtgagctctagagcagactgcctggttcatctgctgcaaccattgaggcctccacctctgggaccttggatgccatttgctacctgtgtgaccttggcacagtttttcccttctgggcagtagtcaccctctttgagtggttgttaaaggaaccaaatcatgtaaagtccacaatatagcacctggcacatagaaagtcctcaataaatgtatttacaagtttatttccaagcgtaaagcaataccaccacaaccaacaccaatgcaattaaataatagcctcaatcttgagtgttttctatatagggaagccaataccttctactggctaagagtatgagcccttgagccagactgcctgggttagaatctcagctttactttttttttttttttttttttttttaactcctaagctactctgaactgcagttttctcttcggtaaaatggcccatattaaaagtgcctaaattcaagcttcgctgtactcttctgtaggacagggataataccaaagtcatttctgaggatcaaatcaattaatactccctaagtacttaaaatagtaaatccaatatagtcagggctaaaaaaaactgatagaaataataattgttacatgattattttatattttatattatttgtattatgcattattcataagatataatgcaatatatatttcaataatatatgcaataatatgtattttatgtaacacatagttataaatatataaatatataactacataatgccatatagttataggataattatatataatgattagatgacacatatcattgtgtaatactgtataatagttacatagtaatgattatatgtaatataaatgataataataattattatttctactcttgctactatgacaagttactccattggggattttttcctaaataatttctaccactttgaagcattctggccagacttattttaaaaggaaactgaggctcagcaaagtggaacaatttgccctcattcttaggactggggaagggcagaccagccaggtgtctggctgcagagcccgtcctcccgcagaccacacaattctgcaaagctttggtgtctgtcgtctccccatcctccatggggaaatggccatgtctcttgcccgtacaaccgactctgagcagaaggctaatgcgatattgtgccgctgtcatttctgatcagtttttcccccactgtctcacagcgggctgtcaggaggccttgttccccatggaagcctggctcctcgtggagaagatcaaacctggaggttgtgtggtgacaaaggctgaggaagggcactgctgggactgggtcttgtggctctattttcaagacctttatttttggttatcagtgttgaaacctggaaatacactttctgttttccgtttaaacacaaatcaagcaacgttaccaacacacattctctgtcaaacatgtcagttactcccggggctgtggacagcttgcaagcgatgtcttctattgttactgtggtggtgtgttatttctccctctacagctctgcatttgttttggcgagcagtgtaaacactgaggggcctgctctcggggaggttttgacagaacatgtgaaattgacatggaccgtccgatgaccatcttaataaggctgttcgggcagccctgtatttgcctgtagcattttccatgaattttggtgggggcttaaggattctaatgagctgggttttgtttcacacctggtgttttggcagacagttcccactgtgacttagcagagggacttggcacggcttgccagagggcctaagatttgtgtgggcgcccagcagatgttggatgtgttcacccatcatacagaacgccagtcatcagccgccgagtcccctctctgtctacattgtaagggaccagagctcccacttgctgccggtgatggagccgtctggggatggataaaaagcctttcattactgaggataatgcagagcatatgggattcttatctgtccaaacagttgtgggatttgggttagagacgccgtctgcatgtgtattttctttttctttttttaattttaattttttgtttttatttttattatactttaagttctagggtacatgtgcacaacgtgcaggtttgttacatacatatacatgtgccatgttggtgtgctgcacccattaactcgtcatttacattaggtatatctcctaatgctatccctcccagctcctccaaccccacaacaggccccggtgtgtgatgttccccttcctgtgtccaagtgttctcattgttcaattcccacctgtgagtgagaacatgcggtgtttggttttttgtccttgcgatagtttgctgagaatgatggtttctagcttcatccgtgtccctacaaaggacatgaactcatccttttttatggatgcatagtattccatggtgtatatgtgcgacattttcttaatccagtctgtcattgatggacatttggtttggttccaagcaatgcccctgggccacatgggacacacacaccatgatgtgtcagcaacgagacgtctatagagtaaaccacgatggcagaggagcattctacccaagagggcagtgtattttctttagtatttggttctagcaagtaggagcttcattaaggagcattttgtacagttccttcctgggaatggacacgacacgcgtttgataatgtctctgctttctggcttcacaccttcctcccatgttagcattggttctaaactcccaagcacagatgttaccaagccactgccctcctgtgtagaatgctcctctgccatcctggtttactctatagaagtctcgttgctgacacatcatggtgtgtgtcccatgtggcccacgggcattgcttcgttcaagcctttgtgttcagatctgccctgttatcagagacaagttgatgtcaacttacctcttatctctgatcaataactgttgggcttcctgtgggttgactgaagacccataagattcatgagacccatacgatcatgtgggttgatgatctccaccattctgaatctcaagaaaccaaagatgattcttgaatgtgtgtttttgttaagatccctttggctgaaggaacagaactcaatcctgtctagcttcaaaaaaaacgagaggggcagcatttatatgtttactgtgttttgaggtgtagtgcatgaacaattgaatgcacagaaactcttggactcaaaagagaaagaaaaaagtcaagccaaggaaagcacaagaggtaagacaggcctagtgatctcagcaggcagaatttatggacatattttgcaggcaagtggttctcaatcaggggtgatttttggcttgtaaggacatttagcaatatctggacacattttttggttgtcgtaagtggatgggggttgctgctatcatcctacaatgcataggtgcattagtctgttttcatgctgctgataaagacataccggagactgggcaatttgcaaatgagagaggcttattgggcttacagttccaggtggctggggagccctcacaatcatgttggaaggtaaaagacatgtttcacatggatgacagcaggcaaagagagctcgtgcagggaaactcttgtttttaaaatcatcaggtttcatgagacttgttcattatcaggagaacagcacaggaaagacccgccccccaaattcagtcatttcccaccaggttcctgtcatgacacgtgggaatcgtgggagatacaattcaagatgagacttgggtgaggacacagccaaacgatatcaagtggacacctggaattatcgagcattatccagaattatcagtcacgccgagattgaaaaaccccactctaggctgtcacactactgtgactcagctacagagactatcagtctctgcaagtcttcattcaacttttgctttctcagctaggatctgatggacccaacctatcgtatgtctcaatctttatatcagtgaactatgcccgagacccccatgtatttgcagcccgttcaaagtattgctgagtagtcctgggaaagcaggagtaggatgtagctggttgtgagctgttagccattccgagacaggcgtcttgcagggtgtattgatagccttcagtgcaccctatcctgtggctgacactcattcatgctagtgccttccatgcagagctgtctgtttgtagaaagcaaggcccaccttggtgccagtcttaacgagcagtcaattgatttggttttcgatttaagctcgttgcctcctttgacttctgtttaacagaaaattcactttgcaaaactgttttaaaacattgttgcttacttttcttaccataaaattaatgtgggctaaacctaagttttcagaaacaaaaagcacaaacaaacatacagagatatatgcatataccacatagatacataaaccacaatccgctacccaaaaatgcctactacaaaccactctttatgtatcctggatttctttgtggtacatatattttcttccctaaataattcttatctactctcatcgtattcacaaagatttgtaaaacttgcaagcagctgggtttttaataggaacaccttttgaaataaaattaatgaattttttttttttacctcatgaatattttctgttaggtttttaagactaaggtgatgtcttaaacaaacacatattccgtgtcctttccacatgcccctttgctcttatccctctccttcagcccatggcaaggtcgtatatgatatcctaagtaaatagatcaccaaagaaatgacattactttagtcagttgggaaaagaagatagggacaaagaagagaaagtagcaaaacaatcctatagattacagaattacacaaaaggccggttgccgtggctcacgcctagaatcccagcactttgggaggctgaggatggcagatcacctgaggtcaggagttcaagaccaccctggccaacatgatgaaacttcatctctactaaaaatgccaaaattagccaggggtggtggcacgtgcttgtaatcccagccccttgggaggctcaggcaggagaatcccttgaacccaggaggcggaggtttcagtgagccaagattacgccactgcactccagcctgggtgacacagcgagactccacctcaaagaaaaaaagaatgaagagagaggcagagattgatcggctccagtcaaccgggtgagtaggaggcttctgctttcagattttcttgtaaatttcttgaaatggggacattgaaaaatgtgctagttttggagaaaataaaaatttcatgaccacgatggaggtgtggttgctcctatggttctcagaacacaaaaccatctcctagagacccactgaagttcatgctcattttaggactaaaacttgggttaaaaatcaggcggctcaagagatcaagatatcttcctggcagccttctatcacaagtggagactgggagaccaaccagacttgccttgtcagctctcatcactccttctctcaaaccaaacgcatgtctaaggcgcaagatcggttttcaatttaagtgacttcgctttctctcttaaaaactaaatcctcctcctaattcccctaagtcctcaaagtataacatttttcctttgtagattggagaaagaagtcatggatcgggcttgccaatggcattaggatgaggtctgccagccagtccttgtcagaatgtgcacagaaaatttaaaagacttttttttttccaatcagtagcttaccagttaatactcctccctttccgttttgatagctgaccctcagaatcaaaatgaggatggcgacataccacatccgcttgagaggctgaggagggttgggttcagaaagacggatggctgtggcttgctttccatatgtgttcaccgatttagtaaatatttattcaacattcagtgtgtgctagacaatacagttccaggtgtgagtaagaccacttatatcctattaacaggaaaaaataaagcagaaaataaccaggagaatatcagatgctgttagctgctaggaaggaaataaaataggttatgggccaggcacggtggctcatgcttgtaatcccaacactttgggaggccgaggtgggtggatcacttgaggtcaggagttcgagaccagcctgggcaacatggtgaaacctcatttctactgaaacatacaaaaattagctggcatgatggcgcatgcctgtagtttcagttccttgggtggctgaggtgggagaatcacttgaacttgggaggcagaggttgcagtgagccgagatcaggccactgtactccagcttgggcgacagagccaaattccatctaaaaaatttaaaaaaaaaatggttacatggtagtgactgaaagggttattttagatagttgaaacaggaattagagctcagatctgattgacaagtaggtgccagctgtgtacagtcgtggggtatgggaaagaggtctaaggggaggaaaaaagcaaaagtcctgagatggaatgaaatgggtatgtttgagaaatgaccggatggtcagtatggctgtgacacagtgggtaaagagggaggatgaaaaacacaaagtcaggtgtgcaatcagcagccaggtcccattccaccttgtagggcattgcaggcagtttagattttgatctaggggaaatggcaaacccctgcagaatttcaagtaggagaacactatgatctgattgtatcatgttaaaagattcctctggaaagtgggaggaggatggacaaataatctttagtgggacaagatgcaaaacagacaggacagctagtatgcatggtactggtgaagacgaccagtaccatgttatccacgattggctagtgaatatccatatttcatgctgccatttctttgatcttcattgaccggagaattctgccctaaaaagagggcccgtttcagggatgtggggtaacagaaaaatcacagtgttaatggaatgagaggtagaggaccagggagtatagaaatgtatctgtgtctgtgcctgaaggtctggtattttgtgtggcttcaggggactgtagtatgtgtgtttaattgttaatgacccaagaatgcatccaaaggggttacatgcaaacctgcctgagcatggaagatcagtcttgagtgctttattaagtctggctctatcaaagctgtaagcaacatatggtgtgccatgtgcccatggactaggttttccatcacaggacagttctgtcttcgggatggctggttttccttttattttagcagaagtagagaaggccccttgggactggatctctcacttttgcaagttatgaccacaggggacaacttgggagtttggattcagatggaccgaggttccagagccagcctcactcactgttagctgtgatcttgaacaggttcttttacctctctgagcctcagttcattcgtacctaaaatagagggaaacttttctatgtcaaagggtagtagaaaggttattacgcattgactggttagttcattcctttgataattctttagacatgtattaatcaccactacgtgcaaggcacgatggcaaacattaggaacgcaatgaagtcagctttgattctttttttagtggaatttatgttcttgtaggggaaggagacaaaacaaagaataactaccataatgtatatataaactgattaattttagattgaagtgagtgctatgaagaaaataatgtaagagggaagaaacagttaatgatggtgcggtggatcatgatactctgctcttgagctcacatcctttattgtcttgaaatttttcacccattagctcacttgttctctttttttcgcttcctgggtttgccttagagacacctggtactttactctcccatgccctaaatacccatgtccacagggagcagctgacttactgtggtacaaggaatgtgcttttccagattttaggagccacctgtttctgggagtgccatggaaacacacattctgcctctcaatcttcaggcccaggcaggaaattttcagctgtcagcagctgtctttctgatctgctgccaaggagtttccaaccccaaccccaggaaaagcccacagtgaccctcaccagggactttgatgccattttttggagctgaaaaggaaggaggggctcctgcagagtgattcgtgggctcagttcttgacttggggtggctgagagtttccccttaaataatatgtcacgctgtaggcatatggtcttgcaattgcggggtgtatcatttccacttgattgtcaaagcaccccacggcagaaacatactaaaggatctctgctccagatacagccatggctttgcagcatggcagatttgcagctttgaggtggaaaacatttttcagcctttcccaagaggtgaactggatacagctgtgcagtgtaacctaaatctttgcacgtgtctttaaacagggcagaaacaactggccctgtccttccactctgggcctgatgatgaccaagtcggagagaactgaagctatatatcctgttctcagaagttgaatttccccatcttggacagagtagtgtgctgttgtgggaatgcgtagctattgccttactcaggtgaatgtcatctgaagacgtggggtgggtaagaatctgtcaccactaaacgcttactccgggctgcccatcactgctgtttggtcagtccttttgttctagggccctttgcagccattctccaggaagagtcatcctggccttgccttcagaaacaagctcgctatatttcccatgtagttctagaaagaatcctggtgcagggattctgaaggatgcactcttgtcctggatctgcccctcaatgtctgtgtattaatgagcaaattattattattattattttgagacagggtctcactctgtcaccaaagctggagtgcagtggtgcgatcatggctcactgcagcttcgacctcttgggttcaggtgatcctcccacctcaacctcccaagtagctgggactacaggagcatgccaccatgaccagctaatttttgtattttttgtagagatgaaatttcaccatgttgcctacgctggtatcgaactgctaggcttcagtgatctgcttggcttggcctcccaaagtgctgagactgcaagtatgagccactgcacccagcccataccacttttccatatggcttcaggttacaggtttgtgcatgagttacatagtggaaccctaaagccatacctttgaccagttgtctaaagtttttagcaccactactactgtatagctaatattttctttgaatggattcaatttttgtagcctaaattgattcacaaaaaccatacttttcgtctctaatttaactggacattcaccatcactagccataaataaatggtacctattacaaatgcattgatgaccctagctagaatggctataataaaaaagatagacagcaagaagtgtcagcaaagatgcggagaaattggaatgcacatacattgctggcaggaatgtaaaattccgcagctacttagaaaaatagttgagtatttttcttaaaaaaattactcagttattatgacccagcaattctgctcctaggtatatattcaagataattaaaaacatatgtgtacacaaaaacgtgtgtaccagtgtttataatagcattattcatagtaaccaaagcatggaaacaggctaaatgttcatcaactaagaaatggataaacacgagatgatatagcatacaatgggatatgttcaggtataaaatgaaatgatgtcttacatgctgtagtgtggatgaaccttgagaatgttgtactaagtgagtgaagtcagatacaaaggactacatattgtatgattcgatttatatgaaatgttcagcataagcaaacctatagtagcttaaagtagattaatgattgctaagggctgaggggagagagtatgggaagcgatccttttatggatatggattttctttttgaggtgatgaaaatgttctggaattatctggaatgttctagaattgtacaactatcaccactttcatacacagttgtacagttttgtgaatatgttaaataacacagaattgtatattttattttattttatttttttggagacagactcttgctctgtcactcaggctggagtgcagtggcatgatctgggctcgctgcaacctctacctcccaggttcaagcgattctcctgcctcagcctcctgagtatctgggattacaggatctgccaccacgcccagctaatttttgtagttttagtagagaaagggtttcatcacattggtcagactggtctcaaactcctgacgtcaggtgatctgcccacctcggcctcccacactgctgcgattacaggtgtgagccaccatgcttggcccgaattgtatattttaaagtgtgaactttgtggaatatgaattattatttcaaaaaatatgttgaaaacaaagcaatgtcatcaaattctttctattacctgtgtttgttgaaggtgtttgctgtattcaaggcctgttttccctcaggaaataaaacagaggttggaaagtattaaagaggtgttgttaaacacggcctagcaccagctgagactgtccttcaagcagccagaaaaactgaatgagcttggaaaaaaaactacttcctaaaaccttctaaactcagcttttcaaaggccaccaatgtgaaatgcttaggatttcattcaatttaagcactattaccgtgcccaatttttgttagctgtgtttatgaggaaagaattaggatattttagctggggaagatagcactctctggaaacatactgtgcgatatgacggccactagtcacgtgtctctatttaaatttaattaaaattcagtagccctcaaaactgtgccattgacattttcagtgcctaggagctacatgtggtttgtgttggttgtactagacagtatgatataggacattcattttattgctaaaagttctgctggacagctctatgctaaaagattaaattaattgtattgctatcttgtggtctctttgctctgctttccctcatttaagcaaattcgaatgctgaaacatgacaaataatgattataataataaaaattaatagttaacgtttgtacttgccctgtaccagacagtgtgctaagcatttaacgcatgaggtcttagttaatcctcccaaaactctaacaggtagctaccgctatcacccaagctttgaatgtgagaaaactgagcatcagagatgtcaattgctgaagtcccagggcattgggaggcctggatttgaatccccatcagttggctttgtgctcctcgtccttctaacctctactttttccacaaatcccatcccaggcctcagccagcaactcagagtccctctgtcaaggtctctgagaaattttacttgtcacgttttatcatgaccgtattttctcaggacagtttcaagaaataagtcagaaagcagagtaaagtttgtggctctgcctactgccccctttctcctgtcctacctcccacccagagacaatacctgctaacgatttggagtgtgagtccgaaaccctcccatacttttcctatgtaattacatgcataggtatgtgtacaaggacaccatgcacgtgtgttaagcaagtgggatctcatcacccacatgattttgctcattgcttttatttatctaacagcatgttttggccatctccccatgtcagtctgtacaggtccactctatcattctatattgtgacggcacacaattctataaacagtaataccatgatttatttgcccttcagcaaatggctttgccaattcttacacacaaaaaagggtatgatggaccagtttcttgcatctgtgctcaaactggacatcatcaatcttttaagtttttgccaatctgttgggtgataatttcttttcctttcaaccttcagggtcatttgcagctccctccacctgctctgcccaggcttctagctgctgacagccaaaggcaatctgccggaggcaaaatgaggtcaaggccaaaaaccatattttctttcagtgagagagggcatttacttgggtaaatacggcccatgcactgtgctttattggtttgaaaaatgaagaagcaagctccaacgagttctctctaatggggctgcatgtctccaatacctggtgctccaatgcattgattgacgcattgtcatcacttataaggtcagtatgttcatccaatcctttattcatcacgtaactatcaggcattgattccatgctaggcagagttctaggcactgagaatacagcactgaatagtgagtcaagacccctgttttacgggacttagattctaatgggcaggatggaggcccacacaggcatcatcgttatagatctaagcaacaaaagactgaaatgagaggtatgccccaagacacagagggcccatcacagagaggacagtcaggtaaggcctctctgagcatgcacactaaagaaaagaactgaaagcaagaaggagcatcccactgagaagaaagtgactggagagtgttcaaaagaagccaggatggccagggccttgtgatggaggaggagcctggcaggaaatgatgtcgggtggtaggtggggggccgattgaggcagggccctgcacagcatgataatgagtttggatttttatagaggtgcagtaagaagccactggaaagttttaagcagggcagcagcagaatttggtttattcggtaagctttacgttaagggcatttgaagttctgaagtgcatgaatactttgctttttaaataagacaaatacgttaaagaagtgttaacagttttcttaaaacagggacactctcacatggcttctgcagtgccttttccagtgatggaaggaagggtttggagccaggtttagtggacttactattatgcgtagtctttcgtcttcagtatctgggtcacagcttataaccaaagcatggcaagaacctccagcaaggttgatgcaggggaaagaagattgagatcaagtcttgttgcctctagtttctgttctttgtgtgaatgctgagggcccctctgtgcttggccatttcacaccagcagaaagcttttgggctcaggaatccagggatctatctgccttggaacattctgcatcaaggtaaaccagtttggtccagtagtgtcatgaccagagatgggagaagaaactgtgtgctcgaggtgctggggctagcatgtaggaacacaaggattttgaattctgcaagcatacacgcagttttgaaatcatcctgataagagtcggcaggagaaatggaaaaaaaaaaaaaaatctcttggatggaggatatcagtcctgtgggtaagaaggttcttggttatcatcattatactcccatttttcactacaaaaacatttttagagaaactgatgatgaaaacaaaagattccaatgaatcagaagcattgattaagcttaacagagagcagagtggtggtgaggtgcatgaattgcagtggaaccatccaggttttttccactttctttggcctcacctttttgccctacaactgtcctgcttactgctgtttgaagaaatgaaatccaaccacctccacctcttttcatacttacccatcttgttttgctgcatacattttgagccctatatgtgcatttcacccatcttcctggactctgaactgagccttgtttctgagccattttcagtctcttgcgcaggacttttattcagtctcggttgcaatgtcagttttcttgccctgcccatgctcagaggagaccaggctagtggaggtgcttcctgtgaccaagtggtgctttaactctttattttaaataattttggagcattcagcattgctccttctccccttccttactttgttactctcctctaaggcttcttttccattcatggaagatatttcttcagtctagttttggttcctctttaatttttttcctctctgagggaaggagttgctgttttttactttttactgtctctgtcttaatagggagggttactttcatctgcctgagaatcacgttatcttccatgtgggctaatgactagtgcagcctgagacctgagctcgaaccagccttgtagaagcagaacagtgaataggctgatcttcgataggtaatttacaagacttccacttcttactgattaactttcataactcactccagaaaataaattgtgtatctgttatcatcctattggatatgcagaagctgtcctgagagggttgataaacctttgaaagaatacataaccaagtcagcctctgctgcaaataaaccgtgacagagaaagagggtggccgtgccaccgaaagggacaggtgacagtggcatcagagcaaataatttgcaaattgtttaataaataatgataaatctctaagcagctcctgcattttattcaaggaaaattaagacttaagtatttttgtgttttttgttttttgttttttgtttttttttgaggtggagttttgttctgtcgcccaggctggagtgcagcggcgcgatctcagctcactgcaacctccacctcccgggttcaagcaattctcttgcctcagcctccctagcagctggaattacaggagtctgccatcatgctagctaatttttgtattttttgtagagacagggtttcaccatgttggccaagctggtctcaaactcctggcctcaggtgatccacccacctcggcctcccaaagtgctgggattacaagcgtgaaccactgcgcccagtctcttaagtactttttatatgaataaagtagtcacaggtggtaggtggtacagcaatgtttgtatgacaaagcccagaaagtagcagagagaaggaaggttatatgtgctcacgatgacttatctacataatacgagagaagtaactttctaaggacaagacatgagacagtaagaccattctgcccttgactctctaagacttggaatttcggatccataaagtaaaacatttctccttttaatagacaattagattaatgatgtttttggaatgaaaaaatctaagattagttgagttctttgctgcctccaccttccttcaaccttgactcacttggtaattgtcagctacagcatagccatctaaggaggtacagaaaactgtgggtgagttaaacatgttggctttgggtccaattcctagccatccgtgcaaatgctgtgtgacctttggcatgtctcagaacctctcttatctgagccttggtttctaatccttacctctcagagggacgattatgagaaggaaatgaactatcataggatatgtaaaatagtatatagctgtatgtagcatgtagctacatagcatatgtaaaatgtttatcacatagtaagcacctgttatatgccatctaattgtgtgtatatctgtgtatatgtgtgcctctgtgtgtttgtgtgcacatgtgaatgtgtgatactagggaaaataatttaccttcattaaataactaaatgctttttactactccctgtggagcttgatatataaggttgctcaggaagggagcagtaatttggtgggaaatagtcacttgtgtgtgaatcatctgaagtacccatccttgtgtccggatttggggctcttgagttaaaccactgtttgcttcccctgtccacaatggcttgctgtctacagcacgtctctccatcagcaatgtcaaggatgttttgttgaatctcaaatttaaccactctggacctggcatggtggcttacccctgtaatcccagcactttgggaggctgaggtgggtggatcacaagttcaggagatcgagaccatcctggctaacatggtgaaaccccgtctctactgaaaatatgaaaaattagctgggcatggaggcatgcacctgtagtcccagctgctggggaggctgaggcaggggaatggtgtgaacccaggaggcggagcttgcagtgagccgagatcgcgccactgcactccagcctgggtgacagagcgagactctgtctcaaaaaaaaacaaaaaacaaacaaacaaaaaaaccactctggaaaatcactttttttaattacactatatagtctttctatagttgaaacaacttaaatattccctccccctatgatgaaaatgggattcaaccaaaagacagatggatggaactttatctcatgtatatactatttaatacgctacatgcattctgcatgtcacatgctatatatagcatggtattatgttgtaattacatttaataaacctagaaatgccccattttttcccaatagcctagaattcttagaatagactcaaaatgtgtcacatgttagccaaactgtggtcaactgaaaacagtgactctgagaagatcagaaatggtggctctgctgcttcatatgtggctgaaataaatgaagtggtctacagtgtgcctgtatgtatgatgtgggtgtgcacgtgtgtgaatattagcgagaatgggagaagcctttactaattcttgaaaaactcacataacccatcctagctacaaccttcctggtatcagaaaacccaggaaggtaacgggtggcctgaggaccaagcctgtgcctagggaagtgaggtgtttgaaaggacgtttcctgtaggccacaacaaaggcaaaggaattatccctccctatgatacaaagttcctctcccttgcttggaatgcctgtgtccctgggatctgttgtaaatcttctctggataatgctgtcaacacacagccaatgtcccacacactgggatctcttttttcctatctgtgttggccaagtcttcttttcactttgcctttcttcacacagtgccattaattaggcttgtacattccagccctgcctcccagagatttcccaggtcaccttgacatcttcgagtatctatttagagtccctgaatgtatccttatccttggagagtctcatccactgcgtatgagtttttcttctttcattccaaaggcaacctgagtcctcagcctctgtgtgccatgatgagaaagaatgaatgggaatcaacccaaccaggaagctggctttgtggcgtggtagatgtttgtaaactctgcctgctgggggtttcttggccattgttgaagaccacaagcccagggacagaaagtggacaccttcctccacctgccagccctctttccaagcttctgctcctaacctgggtatgaacctgctcagtgaagccagtttcgttttatgcaggttctgggctctgaaggcctgtttgtgtcattgcacactttgtagccattccgtctcgctgggcctgcctgtaatagcagtgcagcttctaggtggcacttagaggatgcctaaattgacttagaaagctttgcattaagcagatgtttgctcttggggaagattaaaaccattttgcatcaaagaacgaggctgcggcacttccctaaagcttgaaagaacggtttccttttacttggctgagggttacctggtcccctgcttgacaccctcctagtccgtgaaatggagtaaatccaggttagaccaggtgagtccgaaggtggcaggtggctaaggaggatatttcctttgtagctgttcccggccttgtttctacttatagggataactaaagcaaccaaacacacaccaaacaggtgggagacagcagggaaggatgcttggatatggctgagccacgttcctgcctggtagtatgagaattcgaagatgcttgaggcatgctggtgaaagtaggcaaaagcagagagactcgaggctgcatcaaggggcaaaccgtgtgtatgtttgtgtgtatgccagtgtgtgtatgtgtgttagtgtgtgtatgattatgtatatatgttttgtgtgtctgtgtgttagtgcgtgtgttttgtgtatatgttagtatgtgtatttttttgtgttagtttgcatatgtgtgttagtgtgtatgtgtgtgcatgttttgtgtgtatgtttgtgtgtatgccagtgtgtgtatgtgtgttagtgtgtgtatgattatgtatatatgttttgtgtgtacatgtgttagtgtgtgtgttttgtgtatatgttagtacgtgttttttggtgttagtttgcatatgtgtgttagtgtgtgtatgtgtgtggatgttttgtgtgtgtgttagtgtatgtgtgttagtgtatgttttgtatgcttgctagtgtgtgtgtgtgtttgtgtatgattgtgtttgttttttatgtgtttgtgtgttttgtgtgtgttagtatattttttgttagtatgtgtgttttgtgtgtatgttagtatgtgtatgtttttcgtgtgtttgcgtgtgtgtgtgtatgttttgtgtgtatgttagtgtatgtgtgtttgtgtgtatgctagtgtgtgtgtatgtgttaatgtgtgtgtgattgtgtgtatatgttttgtgtgtatgcgttagtgtgtgttctgcgtgtacgtagtatatatatgtttttgtgtgtgtttgtgtgttttgtgtatatgttagtatgtgcatgttttttgtgtgtttacatgtgtgtcagtgtgtagatgttagtgtgtggatgttttgtttgcatgttagtgtgtgtattagtgtgtggatgttcttgtgtatatgttttgcgtgtagtatgtgttttgtgcgtatcttagtatgtgtatgttttttatgttagtttgcatatgtgtgttagtgtgtgtatatttgtgtatgcatgctagtgtgtgcatgttcttgtatatatgttttgggtgtatgttagtgtatgtttctgtgcgtatatgtgtgtgtgtgcatttcaagtgttcactgccagagaagtggcttatcagtgggtcagaagacagcatgtacgttttataatgtaccagttaagagtccagatgtgagagtcagatattgctggagtcatttcctaactcagctctgcactagtgtgtgaccttggacaagtcacttagcctctctgagcttttgtttcctaatttttgaaaaataggatgagacccacatggaatgtctcctgaggcttaagcaggatggcctgtaaatcacccagtgtggggcctggatcattgagagcaatgggatgcgctgatggtggtggatactgctgctcttacgctgtgactgctggggctgttgttgctattttcattatgagaggctttgggagagacagaactgcacaacggattgccgtcagcctccatcctgagttcctggggtctgggttctttgtctgttgtgttactgggcggggggaaaacctccagataaacctgtcaagctgttgagaaatcctgtctcccatctaactacttgtgtgttacttacaacgtgtgagacttaatgacttcttctgtccaagggggtaaaacaaagccaattgcattaccttgccatgagcagccaatgaaatggctagcacagagccgttagaacagtgtctgagccagattcaatccttcctccgaggtcacccctggagctaataaaggaaaaaaaaaataagtaaaggccgggatcttgtgggcctctcagcctggcaaagtgcctggcataaaatgggtcgcctggcttttaaggcagtgtgccgagcagctggggaaaggtcatcatgagttcacagaacctttaaacacactgggacttaaagccatcagatcccttttgctggctccatttaagttgttttgttggaggacaaaacctttttgcttacggctaagtacattttatggagcatttaatgattcttctatagacgtttgagtagctgtgttttggtttcaggggccgaaaataagtgcccagaatctcccgtcagtcttcttgatgtttattatctgggtggagggggagggacggggctgcttagcacatgttggcttctgggcttcattgttggcacttcagcagaagtgggaagaggcatatggccttcctggtgtcttatggtgaggaaaagaggacatttgaggggaaatatttttgaacaggaagacagcaagatcgtatttgtaggtgcgatggaaaagtagaacagccagtcagctttgggactcccaagtcctattaaagctcacatcttttcaaagcattttaaagattaggaatccatctctccctgtctgttggtaatcgtggggtgcaggagtctacaacagctcagcttacgtctgacgagctcttgtctgttacatcagtaccttgggatgtgccgggctagcggctttcccatcttctaagcacttggctgccaggaaagacggaaccctttgaagtatgagatctgtttatcttgcagttactatggagaaagggccctggaattaattgtaggttattgaatttgtcctttttaagaggaaaaaaaatgactacattatggtgctaattcatagatcttgagatgctagcatttttttgtgcgtgtttaacatttcatttgaccattattagcagtatcaggttgggttgctgagtttcaagtactagaaatctacttggactatctttggcaagggagagcatttattgggaggatattgagtagctcacatgatatcaagaagaccaaaaaaaaaaaaaacaaaaaaaaaaaacttggatcccagaagagaattattcagccattagaggctggctgtagaatgaatgccttttcttctatctgaatgatcctctagtcactttttctatcatcagatctctctggttaaaatttgaagtcccagggcagggaatacttgctagttgtgttctctctctaaggtaatctgttggaagaagtcagaagaaatctttagagctcccattgtgagggcaacatacttgtttttctgcttactaacaaggaagagacaatttctgtaaaaggatatcaagatgctgttaggaaggtgtaatggatactagtgaatgtgtcaattagatgccaagcactctgactgttgatacattcttgagacctacaatgatcagatgattcttttggggaatctatctgtctgtctgtctatccatccgtccgtccgtctgtccgtcgtctatcaatcatctatctatcattcgtctatctatctatctatccatccatctatccatcccaatacaaaccatatacaacctcatgatggatagggtttcaagactactgtcacgatcatgggagactttttctttcctctttttaaccataaacatctttgtgagatataaatgtcattagaaaccagagaaacagatgatacactcaatggggtaataaatatgtaaaggaccttgccacttattttgtagcagggaagaatgtagagtatatctgagactgagaacctaaatcaggacttacctttttttatagtctcagtccatccaccaaaccatagccatagccaggcaggacaaaagaaccttgttagttattaatgttgaattgctgtattaaaattctttcagtgagtgattctcaagaaggagtgatttttttcccccccacagggaacattcggaaatgtgttaagacatttttggttgtctcaattgtgtagagtgatgctgctgacatctacgggatagaggccacggatgttgctaaacatttgccaaggcacagaatcttgtgctgatttacagcatcatctttgcaaacattaagatggcagggcacagtaaaggtactttacttcccacagtacagaattatagcacccaaaatatcaagagtgcagagatagagaaaccctgttttagtaagagatgtaaacacaactcaagtcagtgtatgcaaagtgatgactcaacagggaagatacaggtatctcttacgtgactacatccagggtagctgggacccagggaaaatattaataccctaagactctccttctttgtctcctttctttgtgtcagtttcacttccacaaactagcttcctgcacatggtgggaagtatggctgctaatagaaggtgggtgagaagactcatcctgtgatatcagaacagaaagactctgtgtcagaaactcccagggaaggttttgattggcctggcggaggtccagggctcatcactgagccaatcagctatggcctaggtgtagagctgggtcatgtggcacagacatggcagctgaccctctaaacagtgtattgaggcctttcccagcaagaccaggatgattttaagccaggctgccaccccattggtgtctgctgccattgcatgttctcttattgccaggacatttgtaaatccgatgttgtttccagcagagctgtgtcagagaatgtcacttagccattgccagatcgttgagcaccctggctgaaaatcacaaaggcacggcacctagagaggaaacgaaggctgtgcatgtttccagggaagctgcgccctgacatttatggctgagccgagtttggccttgaaaaaaatcatccggtccagccttctgcctccaggcttgtgaattgataaaccctccaggacagacaggctgttgaggcacagcctgagatgatttctgtccttcctccctggtccaaccatggaggctgccttagtcggcttgtgtcctagttgatatatttgttggaatgtatttgaaactctggtcagtttctctgatgatattgatagttttcttttttttttttcccacttagatgaaatttgtcaagcctgcattgtgctaagccctattaaaatggtgccagagacccaattatggcagctacaaagccgttcaagagtaagcagagaaaaacacataaagggattaaagatcaaaaatgggattccagtgaaagtacattaggagacatcaggcagagacacatgaaagaattagaatatgaagaagaaagcgcatagagcttttgggatgtccttacttttcatccccccaaatcatttaattttgagcatgtttactcttttaaaaatgaattgaaatgatcgattgtacttttgtcaggtggacatgtttttaactctggtgtgaaatgaattgcagatgggttttctggcttgattccctcccccaaaccccccagttttttttttctttttgtcttagacaatatggtgtcagtgaatcatgaaatactgccggtgagcccatttagtgagttgggaaagatggtctcctgggctaggtggtgttggcaatgacactctggggaatggctgaggcccccacccccatcttactgtttgcaaagacgagactgtaaatcagcacaaagtgtgcatttgagagttgctgttttgagataaagagtgcagttcagtttgtagtcatcatcatgttggttctgaagaagtcctgtcacaagcagagctgcacagaatcaggtgtaaatctgtcattttggctagtcttcctctggtccctctctcttcgatggattccatgacaagtccttaggcacatgtttgatttgcactctgttgtttgctatagaaatgtgtacgtggcctctcaggaaagagaagtgaccctctgcctatatcatcgtgaaacatctcttccaggtttgcattctggagttaatggaagagatggaaatctaatcagctcacaatagtctctaactccagactctgatgctcacaacattctgtatatgtgcatcagtcagttcaatgggaatagtggagaaacagagaacaaatgtcccatcccatctgttctatctaaaggaggcagcttctccttagctgcagtcatttttttcaatgcaatagtgcaggctctgcgttgtcagattttctgatatttcaaaagaaggtaaaaatccagatttttgtggggatattcattatgatgatatatatatatgcatatatatgtgcatgagcacgtgcacacatgcgtgcatacacacacacacacacacacacacacacagacactacacatgatcaaacacatcattagcccaagggtcaccagtttataatctttactctaaagagagagccaggcatggtgtcttatgcctgtaatcccagcattttgggaagccgaggatggtgaatcagctgaggtcaggggtttgagaccagcctggccaacgtaatgaaaccccatctttactaaaaatactaaaattaggtggacatggtggcacacaccagtagtcccagctacttgggaggctgaggcaggaggatcgcttgaacccgggaggtggaggttgcaataagccaagatcctgccactgcactccatcctgggccacagagtgagactgtctcgaaaaaaaaaaaaaagagagagaagaaaggccgtaagtatttttcaaattagtgtttgatagtctatccattttggggtttctttccctgtttatcttcaaaagtgccatattttgaaagtttacgtattaccagaaaaccagcatcattcatggagtctttatatgcttaaaaagttttcttggaggtctcgaaacacccttagtcttaattcactttaaaaaaaaattggagccgggaacagtggctcacacctgtaatcccagcactttgggaggccgaggtgggcagatcatgaggtcaggagatcaagaccatcctggctaacacggtgaaaccccctgtctactaaaaatacaaaaaaaattagccaggcgtggtggcgggcacctgtagtcccagctactcaggaggctgaggcaggagcatggcgtgaacctgggagacagagcttgcagtgagctgagatcacgcccctgcactccagcctgggtgacagagcgagactctgtctcaaaaaaaaaaaaaaaaataaaaataattggagtgtatgtccttctacagtttagggaattaatggtgagaaaagcaagccagacagttatcttcagattaagtaacaaagaaagtgccctctaatggcctgggaggtttcattcattttttgtggaatgagaagggaggtgaatctttcttttttttaacacaatgatcctgcagctgagcaagaagtgctagatgatcctcctggctcgaacaggatgatggtgaagagatagcatggtggtggtagaagtcgtaatgaaggtgaaagaggaatacagaaaagaaggaagaaggaggtttttcacaactcagcgtggattggggtatcccactccggtgggacccacagtctgcttaatataggagattgactccaagtcttgccaccttcccccagcccaatagtaaaaagcaaacacacccaaacaaacagaaaccacgatgttcctgcagctctcgggggctgaccatgtcttccagaggaagctcaaagcctgttgttgcatgcttcatccagcttttctgcaaagtggaggccctagcaagaagcaaaggcagacagatggtgtcccgcagactctccctcaagccctttcatctctcctctcactattaattcatctgtttggatggatatgttcacgcatggaaccaagatgaataataatgaggtttttaataactccctgcatttgcattcctagttactctttacatggttctagctgattaaaatgaatcatttacataattaacatatggttatagtgttggctttaatatgctgattatctcaatacttttgtctggagtcaattggattctaactgtaacaattgtttgaagtgagactagtttattcctgggaggatggaggggctatttgccatggtgtctgattagcaatagcatacctttccaacaagtttgttgtgcttctgttttgtaatgtgattgaaaaataagtaaataataataataattgcagtgatcataatagctcccattaattctgggacaagtactatcaatttcattatctcactttcttgcagccagcctgcaaaacagcaaggcttatccccactttacagaggaagaaattgaagcttggaaatgttaacgggcttgcttgaagccaccatgctattatgtgtcagagccttgagctaggctttctgatcccagaattcatactttttaattactctaagtcagcttctgaaccttgagactattgacattttcaagcttggcactatgactatggccagaaaattctgttgttgaagggtttccctgtgtactgtaggacaattggcagcaactctggactcctccctgtggataccagtagcaccccttccctcattatgacaaccaaacattgccattgtcccctggggaggggaatggggtaaagtggccattgattgagaactactgctctaagttattttcttggtacccattaagacaaaatactaagaagcagacatgttatctaggttggtctttcagtgatgggtaactagggcctaactgcagtaatggtatttggaggtacattgtgatgtgtgtgactcctgtaactgattctgaattttccaattatatctgccaggaatcactgtatttgtcaatcaaagcgatctttgttttttatcaacgcgggtaagttctgtctccctcactttcccttcttcccccacgctccctccccactctttttaactcctctaaagggcatgcttgatattttcagatgtgctgccttgcagagttgatagcatgcatttcaggataccattctctcattagcacatcctaggcatgggtgccatccgctatgatctgattatcttgctagttcatattgaatttgaaagggacttgtgaactagtggccagttttcctgtttaggtacccgaggttttggaatgtgagtgctttctgaacattcatgcatatttgaaacgcatttttgctaattgcaggactgttgtccacaattagtctttggtaggcatgattaattgcaaagaacactgacatttatgcataaaatgcttgaggtcaaaaagaaatggagagaaatggtgactgcagccagggtgagtggaatactgatgcatggtgaccccagaagcaaagccccaatcaggaaattgtagcatcagcaggacaggtattttattgggatggatgtgtctgtatttttgacttgcctgtattttgttctcctctcctctaagcacctttagttttacgcaggttttcagaagcctgtctgatgttttcataaatgccaaggcctgccttttactctccttctgcccttctccctcccaaactggccccatcacttgaagctcataatttacttctttaacataacatttgtgtgttgtatgtgtcccaggaagaatcaagaagtaaacaaatgtgccacagtcctaccactgagattaaccagtaaacttttttttctgcttaaagtggtacgtgcctgtgattaataattcaaatgatgctagtaacggaagacgggaaatgaagcccatctccaaatcttggatcttactaaagctaatcagtatcagcggccattaggagaaagaaaaaagcaccattgtgtatagatatgcacatatatggccaggtgcggtggctcacgcctgtaatcccagaactctgggaggatgaggcaggcggataacctgaggtcaggagatcgagaccagcctggccaacatggtgaaaccctgtctctactaaaaatacaaaaattagctgggtgtggtggcaggcgcctataatcccagctactcaggatactgaggcaggagaatcgcttgaacccatggggcggaggttgcagtgagctgagatcacgccactgcactccagcctgggcgacaagagcaaaactctatctgcaaaaaagaaaaaaagatatgtagatatatgatacatacatgtgcatacagatatatgttgttttcacatactgacaaaaaaagccacatcagtctaaatgccctgtgtgactttatcttgcttaatttcacttgatgatatgccatggagcctccttcagtttttctacactaggtggctgtgacataccttatttaagtcattcccttaattcctttttttttccattataaacattactgctacacatgcatacactgagttatctgatagagatatttaaataaaacatatatatgggccctgattactttttactgccatgttaatttcctagcagtgtgattgttgggtccaaaagttggtgtctcataacttccatttaaagatgtgattcaaaacttacctcctactatatataatgctattcaattcacatcactttctcaccatcagtgcagacatcctatttgggcctcggagctggagttcacgtaaggatgagtaaccacttcatacttcagatcccatgagagcgggatcatgtcggtactagcaggctctaaaggacacagtgttcaccctgcttaggatcagacaactgcctagtctgtgccaggcatctgatacttgccttggtaataggattttgcttgaagttctccttatgcctctttatttcttttatttatttgtgctgacaagttagagtgtaagctcattgaagcctgtggccatgtacagaaagagaggtcacatcttctgccaaccctgattgattagtagtggctgttaggagctctgtctggagaaggattgcatctgacttaggaagaaggagtttcagaatcaattagtaatgtctgctaagtgcacagaatggtggaggggcagcctgtgtccccagtattctttttccattcttccataataaattaggattattattatggttattgagggcttacagaaaatttttgaatcaatataaaaagcagcaatgggaaaaggagaagagagggagaaagggagggaggaagagaaggaggaaaagagaagagcaggagacagagagagagaagttatactcaaatatacgaagaatatcttgcttctaggtggctttatatttgagcttttctatagttttgaaatttataggaatttaaaaacatagaaattgcatttttttttttttgagatggagtcttgctctgttgcccaggctggagtgcagtggtgcattcttggctcactgcaagctccgtctcccaggctgtagccattctcttgcctcagcctcccgagtagctgggactacaggtgcctgccaccatgcgtggctaatttttttgtattttttagtgagacggtgtttcaccgtgttagccaggatggttatcgctctcctgaccttgtgatctacctgccttggcctcccaaagtgctgggattacaggtgtgagccaccgcgtctggctgaaattgcattacttttaattctaaaacaacaattagttttgcaccaacctaaggaacatacgttacatttgaatttagaacataaagatcacaatacatgttatagtaaagacagtcttttgaagcaaagctacaggtactattaagaggcacagtgatcctgagatgggaaatggagggcagttctctgtcgttctgcagtttcttggttttgtgagaccactaagtgatgtccgttctctcctggcagaatagatggtgttaatctccagtcccttgtaataaatgctggactgtgaacaggagatggctaaaagagagtgcccgggcaagcctttatctttaataaggtccacagccagtctataattgtcagaaatgacagaggaaacagggcttctgctattttgctcagaataagaagtggtgtctgacctgtgttggcagcaataattgcaatggtcagttattgaagttgatcattgcaatagttgatacaggggcccagctctttgcgctgatattgaggaagccaccaggccccacactttggggtctggaaacattcacagagcaacttttttcaagaagatggacacattcacgttttaaagatgctcagcttctcgtgagagagagtttaggtacattctcattccactcaaatcttagcttataacttaggctcctcgtagcagccctttgcaatgaaactgtatcacttttgaagcttagcagatgggaattgtcataaatgatattttagtcacagatatgagccataaaacttgaaagataaagtatctttctgagacacacatggagaggcagatagacccagatacagcgtgagcttttctgcagctctgatggtgtggaacgaagggccaccaataggtactttattgcaggtgacagggtttgcagatgatgtggaatagtgggaatggcatggagcatgaattttggggattcaatatggggtcaaatatttaccatcccgtggaatcacatttcttatctttttctgaggctccgtgttttcgctgtgtaaggggaatagcggaatgtccttcttaaggtgtttggcacaatacagataaacactaaataaatattcctgtctgtcctccctacagcattcccctcaaatgaatgtgttgcttattgctagttatgctggattattctgctcagttgaataattcattagggcttgagttccaagatatggtgtaactgtatccagcagactctagccttaagccaatatgtatattaatgctttttactcaaggaatctacctggctcttagcaatcctaaccccacccccacatttttaacctgacaggaagattaatctgcatgagatgaagggtgattgtcatgtccaaactaaaaacaaaaaaattaaaaataaaaaatgacagaaatcttctagaaatacctaaacattccctcttttgtcttcaacacgtactcggtccccttcttgtgctcccaggagtcttttaatgcctttgttttcacagcatcaagatatcctggcaacctagagttaccgccatgaggtttggccaccttatctcaaacaactgcgtattttgaaataggtggtgatagcatgcttttcattccatccagaaagtgtctcttccatgacctgccagcactagtatttcaagacctctgcacttacaaatttaaacggagcctggagtaatttaaattaatgtgtacaacatctgtcttggtgagaggagatgtagagatattctccgtttatgcccatctggctttgttagagtagataggcgtatgtttcaggaggagaaagaacattttttatttctgctatgtttcagacattatgctagccattacgcattatcctgcttaatcttttcagtaacgttggtagattaatatcattatccctaccctatgataaagattctgaagatcagagaagtacatcgtttcagtgaccaagtcactgttaaatgacacagtctgtattcaaagacaggacagcctgattccaaaactacttctatgccatcttattagtctcaaggtaatacaagtctaatgtgtttttgcttctgataattatagcagtaactacttagggtaaattaaaatggaatatccaggaaccccattatggtggtaagagtataaagacaaattagcggctatggaatctcaatccaggaaagagagacctgcattgggctcccatgtgttacgagaggttttgtttttttgttttttttttttttaatcatcagatgttttgggtgttcccagctgtgcttgagtgcatttgagaaatgggtttatactcttctcgatcccctagttcttcccaaaaggtagataaggggactcacataaacagtaactgaaagtcattctgtgtgacaattctgtattccttgttgttttagtaaagtttgtcctgagagcaccttgcctataaataaatacagtgacaaataaaatgaatgatttttctgggttcctttcctactctctctccccccatgctttaatgaataattttaatctactttgtaattaagacactagcaataattttattatttggtactacttgggaaaagtaatctttgatatgagatactttgcaaagggaagaccttgtgcccacgtcctgccttaaatgcgaagtaaaggggaaacctggattcaagaactagagccattggtaggccaaacccctatcccacaagccagggaatgggatcttttaccagacactcagacatgaggtttggttttattttttattgttctgaaaagtacattgtaaaaaagggagtgtacatttctaaggcacttttctaaaacaacaagaaataatacaaatatttagtaagcaagggatgattgcatttttggaacatatatgtttatgagctatgtcaatatatatgttgatgtgataccatgaaagctgttttagatgaaattctgataaacagggcattatattgccacttacttgctcttaattcgattctattagcagctcagctttattaaaatttctcaaatgtattccatgtgaaatcattttatttcatatcgctaatgtatgactcaacgcagcatcgcctttgaggtgatccaggactttcatccccatttcacagatgagcactggagataagaacaggttaagtgatttttgcctgaggtcaaacatgctgggagaaagattagaagttggtgagtgtttaccacagctctgtgtctgtgataagtccctaaattcagattttccaacctccgagttttctgggttagacctccagctaactaccaggggatgtcatgttatgtaattaattacaactgtaattatcttggtttctgggtcatttgaagatcatcggtgctttttgttttcatggttcatgcagcagaggaattttttttccaaagtacaagtataattaatccaggttttagactcttaaataaccggaaagttaaaacgtcagtgcagaaactgagttcatcttggctgatgtcccttgcagtagagatggggagaattcagagctgttaaaagtcgtggtcatctctcttgaaacataaaacttccctaccagtgtctggatttcctaggaggtacccagtgcatagacccatgttgtatgaatgactggcctcatacaagaggtaaacatagtatccttgtatgtccctaagtgtcaggtggttgcttggaaaagcagtgatttccataggtccctgtaaagatttcttcaaaactgatggaaggtataaatgtttaaaattagctttcagtttccacttctttttcatgatatcttacatgaaggtaatctattgaggaaattaccttttatatcagtttaaatgaacttatttagataaaataccagtttaaggcattcttgactttgttctattccattcatggagatttgcttgacaggaagtgctctggcatatgtcagtgacctccaatgctcctggagcagatgatactgggacacaggtggtccgtatcacccacgtgaggtggtggcatgtatttatgtgctgaaccaatcggaagacatctcattcagaagaaccaggcctgtttaccttattcgtatgtcattataggtgacacacaggaagagtttctgaagaatcatttcatcattaagatatattcaatatgacagcttggctaacacatcaatcatttggaaaaaaaatactgtagtaacagcctaaggagaatttaaacccttgtgctctggaatctgtatttgcagggcaggaaaaaatgttttagatttgtctatggcattattctttatcagtataactttatagcgcttgaatgtctgaaagatgactcattcatttatttgtgtattcattaattcattccacatatatttgtagagaacctatctgggatctaagaacaatttcaggcaccagagacacaggggtaaacaagacgtctaggcccctgctgtctcagaacttaaatttagtgggacagataggtggtaaacaaataagaaggaattgagagtaacaagcacagtgaagtgaaatatgccaggtgatgaaatagcaaataggagattgatgctcccatagtttggagactcagagaagttttaaggaggtgatgttttagctgggacaggaaagaagacagccagggaggtatggagaggaagagcacggggaacagaatgtgcaaagtctctaaagttagaataagcttgacatgtctgaagaagagcaaagagactccggtggctagaggattctaatggagaagtaggaggcagaaaagaataattgagaagtagatcagtcagatggaggaggactttgatgggcggcagagtaaggcagtatgagctttatcgttgctgagccggaagttgttatgttatgcaggaagctgcgatgagtgtgtacacaaaccatctcctgatctcgagccttttcctcctgagggcaaggaggatcgggaggcaagggaaacgtagtggtgatgacgaagcttctatctttcagggtctacggtttagggattgagagtatgtgtttgctagcgagacctcacgaaaccaagccccctggagagtccctgacaaggacgaggtgcaacactgttagcggaatccatttcatcgcagaactgctgtcttccaagccttctgagccggctggtacttgtgtaacatttctgtcttgggtgatttccaactggatatgtcatttctaccaagccagtggcaactccagcctagggatgcatttaatctgggacatggtggtgggagaagcattaggcacattgtttttcttccttttttttgaagaatgcttggtacaaattcagttttgacctcccaatgtaggcttttatttcccaggcacttcctttttccctgcatccgccaaaccctggtgagctttctgctgcttttctcaatggctgatctaagtactgcagaacacggacactcttgggcacactgcaaagtcagcctggctccttggccattcctcttgcagggcacaaaaggaccttccaaagaggtggggtagtgtattattaagtggcaataacgaaggacttctttagattatcactgtttcaccagaagacacaacaggagagcacacagaccttgaaggaaatcccaccactgacatttagaatctggtggactgcaagcttagatatctactctctaaatgcagttactttatctatgacctggcaatattaacagtacttatctcatagaaatgtagtactgggtatgtttctggccagtcataaacatttaataatggtagccaatgtcatcacttgttgttaatagtggggatagcagtaaactctctttcctctcaaggttaaggggagtgtttggaagagaaaaaaaagctgagactgaatgacgtttagctttttgatttcaccataaactaaagagtttcattggtaactgtgccctgcctctttctgtccaaaagagtatcttatttttagactgttttaaaataataacagtattatctgatggaggagacaaaaatacttcagtaatagcctaattggagcgaataagaaaatagaacacttgtgtgcaatggaatactagaaagcagtgggaatgaatgaattggagctttatataagaagaatggcttctgccattatgactgtggataatttactaaaaaatttaaaatacactggagttttagtactttctgctgtccagaaatgcatacatatgtggtaaatatatatagacaataaagaaactcaaaattcaggatattgtctgttgtagaggtgaggcagagggctacatctcaggagggttttagacagggtatttagccacactgaaattatttcttaagctgggtagtaactacaggaattccttccttccttcctttctgcctgcctgcttgcctgcctgcctgcctgccttcctgccttccgtcctgcctgcctgcctccctgcctgcctgcctccctccctccctcctcttccttcccttccttcctcttttctcttccttttctttctttctagatagagtcttgcctttatcacccacctgaggtgcaatggcaccatcatatctcaccccacagccttggcctcctgggttcaagcacaatcctcctgcctccttctccaaagttaggactaaaggcacacaccaccaaaccttgcttattttttaaagaaaatttttagagaagagtgtcttgctatgtttcctgggctggtctggaactcttggcctcaagtagtcctctgacctcagcttcccaaaacactgagactacaggtgtgagctgtgcctggccagtatttatgttttgctgtataccttttggtatgtctgaactatatcacatcatgattttagagtcagaaatgctcagagtttagaaaataaccatcttcaccacatagaatcgtataaaataaaaaatgttttttctccttccctttcttcctcccccatcatttaataattgtttagtacatacctttgcagatattttgtgcatattaaaaatatacacatttagaacatatatgcttaatataaatgactttatgtctatgactctgttaccacttaaaaatagtgtacaggcttttcaatgttggcacatataaattatgtacttcagtcttaacatctgtctggtaatcatctttcagtgtactgtaatttaaacaaccagtttccctattgatagacatttgtatttaaaaaacaaaacaaaacaaaaaccagtttccaaactctggtctgctttcaattcagacgctggcagcagctcacaccgctgatcatccaaatgttttgtctttgctaggacgataacccagtcgtttcatacaactgttttcgtttgcacctgaatattccatggctatagccacagctagaaatccattctctaggggaaaataagaaatgtaataataaacttaaaatccctaatgagaaattcagatttcatagaagcaggggtcttctccctcttgctaaccttcttttccaagatgttagtgtttttcaagaatcgcaggctttttaaatgtcctccgtaaagtgtaaaggggaaaatggagagaaagaacagtattttgaatctccagagttctcagtgaaagtagacaggtctatcctagtgttctgtcttgcatgaaacactttcttggtattttgtctacatgagtgtttaatatttaggtcatagtttgtgaatacactggagatgttatgcgtcaaacaaacccagtgttctggcttcacagcagagtaaacagacacagatagttctagatgcttgaacttctcccacgttaaacttaaaacagcctctcatctcagggcttccatcaaagggattgaggccgtgtctctcaaacccaggtgcaagtggaaatttttatgggccctgacttttcttgttgtccttgttggctcataatattgccttattgtgcaagtaatgcatataacttgtgggaaaaggtatagtactataagtaattagaaagaaaaccatatttgaaatttaaaatccttaaacacatacctaattcctactcttcctttctgaaattcctgttttctcaatgatctgttagtaaaatatatagactacaaaaatgggttcatacatcgttcccccccgccttttttttttattttattaacagcttcacagtgttctgttgcatgaatataccctaaaaagaggatttgttttggcattggtgcctgttctttttcagtgttattcattattttgggatgttgcttttattatttttcatattttattttatttggtaggaaaaatgcaaatgtcccaccgtatggatttgggatttgcaagtcaggaacagtgggcacactttcccttaatggttggcgtaggcatttggatactgaatttactgtttatatcacggtttctccaccttggcagtgtggacgctgggctggatcattctctatgtggggactgctgagtgctttgttgggcatttggtggcatctctagcctctcctgactaaatgccaactgtagttctccccacactgtgatgcccaaagatgtctctagacttggctcactgtcccctgggggatgaaatgtttctccctttgagaatcctgcttttacgcgattggattcttaagttgtctgaaggatgatcttttcttgtagcatttataaatcagttggaagttggttctggattactgcctaaaataaaattcaacctattctgagaaaacaatatatttgagtagggactaattacctcttttttatttcaagtgacaaaagccaatatatcacacttagccactatgaagactccatttcagtaaactaattaaactaatcctatctggactcattattctcagttccactaaatattttaacagttgagatttatctcatttcataaattatatcatacttaaagctatccacagccctcaagagtttattttggacttttaaaaaatgtgactttaagctgctctggaatgtatatttttcatatcttttctagataatcattcaccttgattatgactaattattaaacatgatatatggctttaattaaatgaaagtacttggtttcttgttagcgcttattaaatactgacagtgttacaaagatagtgcagcagaggaaatggcataactcaccgaattgattccattttcttgctgtaagccagtgaagatacacattttaagagactgattaatgcgcaagatggcaagaacagtgtttttcatagttaaaaggaattaaaatctgtgtccatcctggattcattttctaacagaggatagtcacctaattaaaacgttaatacacatcccgctatttgtatgtacgttccaaagccagcatacattaaatagaaatttatcccaagtgcttcatggagaagccaagaggaataatgcctaagtaccacttcagagtaaattgctccctacttataatcgtgtaatgcaattaaattgaggagctgtaagctgcctacatcaagtatgtttagtttagatatttgcctttagacatctccctgtaaagggttccacattgaagagaaaagaaggaacatctagccaatgagctgttcattaaacttgacatatggtaagcaaggccagaaaatgcctaaagagtagagaattttctttggtatctaaagaaaaaaaaatgcaatatccagttgatcttagattctgattctagcaggtgttcatggtacagtcttgttctgtgcttcattcaagaatgggaaattcttgtttatcccgttgtccatgatgtgcttatttctcatggcatgcctgtatcaaaacatctcatgtatcccataaacatacacacctactacgtacccataaaaattaaaaaaaaaaaaaacgtaaaatgcaacaacactaggcacgcattttataatataacttctctgcttggacaaaattaggctccccagtggaggcaaaaacaaaaaaagcagatggcaaatatgttagtgacattgttttaagtgtttgaggtcatggagtcttcacattgaaataatctcttgaattatctgagttttaggctagccagggccaaggtgccagctgaattaatgaaacttggaattcatcttttgagttcccagtgaacatcaggaaatactttcctgacatattgacctccttattatccatttcccattctccatgttgaaaaccatttcatatttgagagctgagaatatgacaccttcatgataaatttaaaaataagatgcaatattattccagaattgccttaagttcccattctgtatattaaacgcctattcaaagggtattcagatccaagttacatcatacaaagtatgttaaagtatcccaagtatggcctggcgaggtggctcaagcctgtaatccccgtactttgggaggccgaggcgggcagatcacaaggtcagaagatcgagactatcctggctaacatggtgaaataccatctactaaaaatacaaaaaattagctgggcatggtggcatgtgcctgtagtcccagctacttgggaggctgaggcaggagaatcacttgaacccagtaggtggaggttgcagtgagcagagatcgtgccgttgcaccccagcctgggcaacagagtgagactccatctcaaaaaaaaaaaaaaagtatcccaagtatgagaaacatcagtataaatagtgagaaaacatatatacatatgttcttcttatatttacgggagagatatgtatgcttatctgtgcttttcatatatatatgaaacatatatgaaatatatatgaaacatatatgaaatatatatatgaatatgaaaagcaaggagtatgaaacttatatatgaaatatatatgtatgaatatgaaaagcagggaaaaggggacagtcatttagtgttgctgctgaaaatttcaatatgaaaaacgaggaatatatagctcaggtgcaacaggcacctttatatttataccattacaaaaacatggctctcctggtattttggttcttgaatttaggcttggagctgatattgaagagctgcttattgcagtgggttttcatgccaaacatagctgagtttgaatgacatttctgttactctggctacagaatcttgggcagtatcatttatctatccatctgggctttatttttcccatggggaaataggagggagaggggtcatggagtgaacagctttgcaggccatgccaactttggaattagtggagagaatataaggtaaataagaccatcctgtaatgacaacctagacttagacttgcacgaaatagagatgtaagtcaggatgagtctctcattcactcaacaaatatttattgaatgccaacccttctcagccgctgggtattcagtggtatagagtgtgaacaaaatgctgctggcatagagcttatattctagttgaaaggaggcaaacaataaataactgtgtaaattaatatatggttagtgacaggtgcaagtcagataattaaaacagagagtggtggggagctctagaaaggctcctatgaagaggtaagttgacatttaagctgagctcgcaatggcaaatcatgccaaggcagagagaaagaacattccaggaaaataccctaagaggagaggaccttggaatttttgaaagatgaacagatccctggaaaatagagagaggggcaccagagaggtctgagaattgggcaaaggccaggtcatacaggattttgttaaccacgataatgaatataagttttatatgaattacggatgcagagatttgcatttcacaaagatgactgcttgccacgtgaaacatagaccagtggggcccaggagaagaaggcaggagagcagttaggaagctgtctgggagtccaggcaaggggtcatagtggtttgaactggaaggtggttctgaaatggaaggtgaaggaaatggaagtaccgttgtagaaaattaacaggcagatctgggaaaacccagtggaggtgaagggagtgaattaaaatgattccaggatggagaggtcggggcttgggtgaatggtgccatggaaagtaatggaggtatctcaaatagaaagtagtgagtgggaagagcaggagtgagcttgcagaagttctagcagaaatgtgaaaggccatggttatttgccaagatggaagatagattaggtggtggtcatctcatttgggcgttgaaacttgttttcaaaacctgtacctggttttgatttctacacagggatgcaactggcagatgacatctcaagaggtgggtttgtcatggtggttattattgtacatgtgagacttttagcttttaaggtttttggtttttttcgagatagagtctcgctgtgtcacccaggctggagtgcagtggtgcgacctcggctcactgcaacctccgcctcctgggttcaagcagtttttctgcttcagcctctgagtaggtgggattacaggcacatgccaccatgcccagttacttatttatttatttatttatttatttatttatttatttattttttatttttagtagagacggagtttcaccatgttggccaggctggtctcgaactcctgacctcgtgaaccacacggctcagcctcccaaagtgctgggattgcaggtgtgagccaccatgcccagccagcttttaaggttttgccacacgctaaacaaggcatggtgaggactcttgggtttgagatcccaacagcctcagagatatcagatgtagggcaaagcgggtatctgcatcccccaagttctttccttctcactaaagtgcttgaagtactggtcctttatgatactttcagttctggagtacatgtgcagaatgtgcaggtttgttacatagctatacatgtgccatggtggttgctgcacccatcaccccgtcatctacattagatatttctcctaaagctataccccccagcccccaccccccaacaggccccagtgtgtgatgttcccctccctgtgtccatgtattctcattgttcacctcccacttatgagaacatgtggcgtttgattttctgttcttgtgttagtttgatgagaatgatggtttccaccttcatccatgtccctgcaaaggacatgatctcatgtttttttatggctgcatagtattccatggtgtatatgtgccacattttctttattcagtctttatcattgatgggcatttgggttggttccaagtcttttttattgtgaacagtgccacagtaatcatacgtgtgcatgtatctttatagtagcatgatttataatcctttgggtatatatccagtaatgggattgctgggtctaatggtatttctagttctatatccttgaggaatcgccacactgtcttccacaatggttgaactaatttacactcctaccaacagtgtaaaagtgttcctatttctccacatcctctccagcatctgttgttttctgactttttaatgatctccattctgactgccatgagatgttatctcattgtggttttgatttgcatttctctaatgaccagtgataaagagcatttattcatatgtttgttggctgcataaatgtcttctcttgagaagtgtctgttcatatcctttgcccactttttgatggggttgtttttttcttgtaaatttgtttaatgtatttgtagattctggatattagccctttgtcagatgaatagatggtaaaaattttgtcccattctgtaggttgctgaaacaggcagttttttgagtgcttgccacacaccaaccattgtgcaaagtacctaccatgcattatcttgctaaattagtataggattagtaataaattctatgagctatgttctatttttatcctcattttatagataagaaaactgagacccaggtatttgattaatttcacacagctgataaagagaggatgtggattctctaagtccagaattgaggccgtcagtcactggatcgtactgacatgatattcattcatatacccctgtcttccaaatgcatagatgtacaatagctgtcaggattgtatctccctgggtctcgtttcttatcaaaattgcacatttgctggcaagaagagagtggcacattgatctcaaactgtgaaataaatccatacgccttcagagaggttcttcgaatgtatggtcaagcattgcaaaagccgctgtgtgtttggaagaaaggtgaaactggaaggtctttggctcagggtgccattaggagtggtgtcggtggcagctgtgggccatcatggtacacatcctgcgtcaactccaggcctccccacaatcccatgaacagcaaagcccctcatcttttgaatgctggagaaagctccgtacgtgtagggcttcgccatcagtttaaaacgtctctggaattctttgattattttaatgtgctaatttcttgagctttgtttttgtgctgtctttgattttccactttcgcctttattttacgccattgttggaagggtcaaagcatcccagagcttaatggctctcttgttcagctattgtggggggaaaaagagcaaagcaaacaaaacaaaacaaaatatccttttttttgttttgctttttttttaatttaaaggcatccaaaaaattgtttcttttgcctttgatcaagatcatataaacataatcagtgtttattgtgtttgcataatcgaaaatagcaggaaactgatctcagattgcatggagctagaaaagattaagcctttccttcttggcagagttctacagacacacaaggttggtgtgatggatgcagcactcggtatccatgatgtgttcgggaaaatcctcagaagaaacttgcattgctttctggggaaattcctgaatacaagtggcaatgagatgcatgaaaattattttcagctgatgaatactgtctgaacataactattgctggggtgtataatttaaaatctgtagagtgaagtgtgcaatatatgggctttgggatacaacaaatatggatttaaattctactcctcctttttatcatctctctgcccgggataacttgtttcatccccttccctgagcttaagccccctcaactgtaaaagaaagataacaacccttacctcatatggttctagggaggacaacatgagataatacacatccaggcagtccccaacttaaaagtggtttcacttactttttttttttttttttttttttttgacattatgaatgacgtgaaacctttctgttttttcacatttggtatggtattcaatgaattccacgagatattcaatactattataaaattagctttgtgttagatgagtttgtccaaatgtaggctaatataagtgttttgagcttctttaaggtagagaagacaaagctatgatgttcagtaggttaggtgtatggaatgcaattttgatagaatattttcaactcacgatgagtttatagggacataaccatatcataagtcaaggaaagcatgtacgcagagcttaatagagtgcctaatacagagtaagtgcttaaaacatttttttaaagtgtgatacaagttctttggagagcctgaatgaattgggggtatggccatatgtaatatgttcagtgcagcaccattctttaataaattacaagttggtctatttctttgttcctttttatttttatttttatttttggaggcagagtctcactgtgtcacccaggctggaatgcagtggtgtgatcacagctcatggcagctttgatctctccaggcttagatgatcctgtacctcagcctcctgaatagctggcagcacaggtgtgtgtcaccacgcccagctaattttagtatttttggtagagacgaggtcttgccatgtagcccaggctggtcttaaacccctgggctcaggtagtcctcccacctcagcctcccaaagcacttggattacaggcatgagccacagtgcccagccagatgtaactatttaatgaaatgttgattggggtgtgcttgcttcccctgaagcctgattcttgatctttgttctggactccaggaccaaagatatcattgcttaatcttgcgaacaactctggaagatccttacagaatgacttgctttagccaaatcctatggtaaggcaaaacactacctaaaaacaataataagcataattgtcatccagatatgttgggaccctacagagaaattcagaagacaatctggctggagtttacagtatgtacaacagcagtcttggttaggccatggtattataattcagcaacaacaccaataataatattggtggttaaaatttcttgagtatatagaatgttccttctagtatgcttaaggcttgatatgcatacaatctttatggcaccctgcaaaatccatgagtccactgctgttttccaaataagaagatgggggttgtagtagtccattctcatactgttataaagagatacctgagtctgggtaatttataaaggaaagaggtttaattggctcacagttctgtgggttgtacaggctctgcttctggggaggcctcaggaaacttataatcatggcagaaggtgaaaacgaagcaagcacatcctcacatggccagcaggagagaggaagacagaaaaacagagcgagaagggagaggggctacatactttcaaacaaacagctcttgtgaaaactctatcaaaagaacagcaagggggatgtttgctcccattattctgtcatctcgcaccagacccctcctccaacactgagaactacagctggacatgagatttggggagggacacacagccaaaccatatcaggggtctagaaaggtaaaccaattttcccataacaatagagagaatacattataataagtaggacttgatccaaatctgagagacacccaaactcatgttcttaactatgagatttcgatacttggagtcagaagacttgggtttaagtttcagttgcagggaccttactcacatcttctaacctctcaaagccttgccatatcatctgttcaaaagaataccttcttcacaaaattgtaaagactgaatgagaaaatgcacctaaagcatctttgcacatcgcagagattatgcaagtataaggtgctatatttcgcattaacacctgagcatagatcattttcggattgtgtgagggatggtgaatttataaatttggtgatttttgatgaaaagaatcaatatgctgtctctttacagaggaattagtggttataagaactgacaatgcatttagagatttgtttttttcaataggacagaaagagactattttctttccatttataagaatatgaatgtgcttaagggaggacagattccaacaatcgagttgtttgctgtgatttgtacgccctggggatatggagagttgggaatgtagaaaaattacaattatggaataaaaaaagatccagggagaaggattttttttactgcctgttttgcttgtgtggcttggaacagggagtttcctggagggtgtggggtcttccttgctgaccctcgtgctttttggaggctcattggtaagccttgttgtgcctgttccttctgctcctagtccttaagaacatagctcttatccttaactgaccttttgcactgaatatgtgacagttaatccactggaaggttttagataggcagcatgtccagacactgccccctgcacgtgactggccccacctccgtcccaccttggtgttaatcccatggggtggattttctaggccagtctctttttagaatagcatttgctgatgtccctctaagagagtttttgggcatgtgccctggtttgtaaaagaagggccctcatggaggtagaggaaagaagtttcgcgtcccaagatctccaaggataccaattataggggtagctgggtacctgcctccctctgctcttcgtttctcaccgcaagagctctgctatgattttctccacatctggacttctttcctccctttcttgcatagctaacacccatgtgtgcttttggaccagtttccttgtcccgttcacaaaattaaaacttccttgacctcactgacttggttaagtacctttactgtatcactttataacttcagtaccttcatttgtagcttgcatcatcatttcagttttacaactttttatgtaatgatttggtttatgatactcttcccccaaaagactgtaaaggccatgcagatgaggaccaaatgtgttttttcttcctacgcatcctcagcatatgtgccttttatacagtaggcttttaacagtgactaaaaggaagagtgagtcggtggatggatggagaaatgaatgaatgaatgaatgggttacacaaccagcctgtccagacactgattcttttacgtaggctgagattcctgaggtaagggacaaggatatcaacttgcgttagtttaccttatgcactccatcgcagcctaaactgtcactgattacttgctgcccttagaatacaagctctctctgtcttccttcccctcctgccttttgcaatctcatttcatgctttgctcatttgccaccacaatacttaagccaggccagaattattttcagtgtttgaaagttgcacacccacttctcccttgcagattctgtacacgcttttcctccatcaaaaatgttttattctgcctcttcaaacattgcattttcataatcattttcagacctctgcctacatgtccctttttcatggaagccctccctccctgaatcctctaggttggacaactttcccctgtagtccccttgtatagcaccttgcatttccctccagatcacgtcccaaaattataatgaatatatgtttgcatttggacaatggcctgtttcctccactcaggagtaatagctacttgaggaaatgccttggtcatcaaaaagtgtctggctcctagtaggtactccacaagcagttatcaaataaaattgtaaaacccaggcactctttatggtcctaccaaaaccagtgacttgaatgggagatatttagggtcaaggaagaaagaaggcaggcatgttcatatttatttacctcctgtgggtttgtgatggcccctccttcttcttgggctagagtcagagccactttctcctaatcccctataggttaagctgagtaggtgataaagcccaagtcatagtagcataagcacaaggaattctgattatgttaagaaactgaaaacttcaggagtggttttggctattggtcattgctgaatctaagggtttgcataattactgtagggatgtcctcagtccgtggattgttttgactctctttggtgtcttggttttttgttgttttggtttggtttggtttgtttgtttgtttgtttgtttgtttgtttgttttgagacagagtcttgctgtgtcccccaagctggagtgcagtggcatgatctcggctcactgcaacctccgcctcccaggttccagtgattttcctgcttcagcctcccgtatagctgggactacaggcccatgccaccacacctggctaatttttgcatttctagtagagacagggtttcaccatgttggccaggctggtctggaactcctgacctcaggtgatctgcctgcctcagcctcctaaagtggtgggattacaggtgtgagccaccgcaccccacctggtgtcttgatttttattgctccttgcatatagtcaatggttctgagatctgacaggaaatgcctgatggaagagctatggcccatgcaggatctcacttcagaccttaatccttaagtttgtgtctgggaagatggggtacttgattggcaagatgctcgtcacttcttgctcacctctggatgtcaatccacaagttttctttggtatcttcactgtatgaaaaacccaactataatattacactcaagtacacacttataggagcacactttttatatagtttctatataattttcctaccccatctgtcttaggtcagatttcctagggataatgccatgcctgagatgggtgcaagtggtgaattgaaggaatgctctctggacaatgctatagggggtggtggtaatgaatcaggataaggcagaggaaggtatggtttcagggggaaacatagcctcagcctgatcttgtaagaagatctggattattcattgtgccaaggattatttcactgagtcttatccccaccccgtttcatccatctgtctttggccacaaggtgtcccccaggaaggggtggtagccgccttaccccttacctccacctttactccaggcatctctggctaaggtgaatcatgccagccaagtccaaacattcagagaagaattcaggttgtcagcagttagctgcaaacacccacgtcagcaggaagatggttcatcaagctagggaggatggctgaggcaccagctttaaggagtcatagaatggcctggtgtggtggctcacacctgtaatcctagccctttgggagtccaaggtgggcagatcacctgaggtcaggagttggagaccatcctggccacaatggtgaaaccccatctctacgaaaaataccaaaattagccgggtgtcctggtgcgtgcctgtaatcctagctactctggaggctgaggcaggagaattgcttgaacccaggaggcagaggttgtagtgagccaagatcgtgctactgcactctagcctgggcaacagagcaagactccgcatcaaaaaaaaaaaaaaaaaaaaaaaaaaaaagagagaaagaaataaaaaatagtcatagaatgagaaaaaaatctgaaattagagggattgctgtataaataatgacctctgcttgtattttctgagtagttccaattttacccagtcccttctgtctccttagtcttcagcctgaatctcttgcttacctcccctaatggccatatggggaacaggattttattaaggaaacctcgaaagggttgacacaagagtcaaacccccacacctttagatgcataggcagtgaaaccaacctgtacttcccatcttcttgcgtttccatttatccattcctcttggggtccagggtcatagcctctctactgtacctccaacgggtgccactacagtgtctggattctcgatcaccacctcccttttcagtttactgatcaggcagtttcggagaccacgccagggtttcatgtgccccggttgaggcatgaataacagcagtttgaattctcctttgtaattctcatccaggcaagtcactcttttttcctggtataaatgatcagatcgctgctgcagactcatccaggattcctctgccttattgtttttcaatccgtctacttccacgatcctctcttcccaccctccttgccgtcccctgcagccttcatgtctgtgcatacataaataaggctgttatgcacgcatgtgagaatatatacccatcatggtactgtgtgagcctgtgtacgtgctgaggaaatgtaatgggctgtggttgtgtgtttgtaggtgtataataagtttgccgcagactagggggataaatagagccatttgttgattcaaaccaatttttttttctcttgagttagtatccaatctgtagctaagaactgctgactacagcatatttccaagtgtggattttttttttttttccctgacagccaagacctaactcttgcctgatctatgtagatgcattgttcaaattacaaagcttaggtgacagaattgctctttttactgggagcccccaacacacctgtcatcagatagaagggagaatgcagaagtcatcactttacttagaaactcagcagatgattgaaattatttcttactactaattccccttttagtggagataagccgctttgttcagctgtaaatgaaacattagggtattaactgtggagccagaagtattggggaagctaagattttatctgcagtaagaacattttgggcaataaattgttttgttggacggaatactaaatctcttgagttacaaagaagcagagctcattaaggggaatgcttaaagcagaaaacaaggcgagacaaaagcttattacctttgttgtggggattgagggggtgtttgcaggttctcatgtatatgtagcatggaagacttatgcagtacagttattaaatagatgtgtctatagacttgcaaatgctctatgaatatgtccaagggacaaatacatttctgaaatatcaatagcaatctgcaataagttatgaattttggcgtacatatttaccctcaaagactagatttttgtttcctgcgggtgaaattttcccgtctctttgccacatccttcagattaattgactggcatggttacataaatgtttgtaatagagaagagtaagtgccagggttatccaaaatattgtcgcaaaatacacacctaaattaagataattatgtgttgggagcatctatcggcagggcttggcaaggaggggagctttctcttgatggagaggaggctctttctgggacactgaattcatgaatggtgggttctggattccccagggtgctctcagcttgtaagtgtcaggggaggggattgagggctgttcttttgccaataaccagggcggaaggaggacgagaggaagaagacagtgccttcttttccctggagttagcaaccctctgctgtgtctccaagagcaaggctgtggcagtacaactgtctacctgtctacaccggctgctccttcttgcctttggacagaagatgacactcacaaactgtggcccctgagcaacagtgtaaacgggcatacctcagttacaagcggattcaaatgtaatgagaacaatttcagagctatgcattttattcttctgtttttctccctggatgactcagggcatcttttcacagactcccaccctgaaggtttttattgccatttctgcgcttccctacacgtcctgattcataagtggatgctcaggacacagtcactcagagtagcttaatactctgcggacctcacgtgctgagttctcattctggacttaacgttactttaagctcagtttgtacctttccttggttctgtcaatggaaataaggacaacacttctcaaaacacagcaggtgggctgagagtggtgacttacacctgtaatcccagcactttgggaggctgaggtgggtggatcacttgaggtcagaagttcaagaacagccttgccaacactatgaaactgcatctctactaaaaatacaatcaattagccaggtttggtggtgtgctcctgtaatcccagctactctggaggctgaggcatgggaatcacttaaacccaggagacagaggttgcagtgagcctagaagatgccactgcactccggcctgggctatagggtgagactgtcaaaaagaaaaataaaagaaaaaaagaaacatagcaggaaggtagcagtggacaaatgaagtattggaaacacatagcctacacattcatgtgagctttaggagaacgtgaggtctaacttgcttaaagaaaacttagcacatgaaaaatgaaaactatttttttcagtgcatgagtgatcatgatctctttaattaaaagtgcactgaattgtaagatcttttaccaaaatgttaccatctttatcttctatctctggtgctgagtgtagtaacaggaagagatttcgaagtgaagactttagtaagatagaattgtgtgtattgtgtttaaatctggggtgtatttaaaatgtaattgaaatcacaagatatttaacatgctattcactttgcaagtgacttttcaggaccacttatctgcagactgtaggacaccagtctatgaacgttggcttataggagcaccaggtctccagttgagttaattcctcatacttgtcacatagggggcatactaagtcttcctgagatgagtagaaacatagatccacataaaaatgaaaagaacccactggtgacagagggtctcagagcctccagtttttttctgaactttgaaagtcagtaccaaagagtcagaactgaatggaaggacactaaaatcaatacttttcaatgtaacatcacaagcgttgggactctgaagaacttgatgacacatgattcagaagcaaagtgatatttacataggaagactgtcctcgccctctggaatgattttgacatgtgtattcactcttagttttggctcttagagtttaagtaatagatttacggtggtatgaacacaggtgttaaagagttctgggttcaagtcttgtccacgtcccaagctgtggaactctgaataaacctcttagtctattggaaccttagttttctcatctgtaaaacagatgaaactacctgattttttaggccctacttggctcttaaatttctcggctcagtgaacaatgcaagctttatgttataaaccaccaagacatctaagcttcttcccttacggccgttagtggattaagcgatatcctcagagcaactgtttggtgatttaacctcccccagttgctctatttcctgggttgttcatgagtaattgataaagaatttgcaacactaggattccacatggaagaaggaaatgcctcttttggacccatttcaaacaagcattggtaggagatgcctcagacgcttatgcttaaagcatcagtatcattgcctgacagcttatcacagtggcaggagcatagggttgaatcttatgtttttctttccctctgggtgacacttacaggatgcttaagtttgctggacctcactttcttcatctgtaagatggggacagagaactatctcagtgttacagaaaatttgaagatgaggctgaagatgtaagattttgttaatgtctacagtgttaaagaatctcaatatatggtggctatgattattgctattcttatattaacttggtgataggcatcagtggttgaattatctggagaacccagaaaacagaacagatcttgcaaattcagtcgcttacccagatgttagttgtttgatccccagtgtgacaaatgccaccttcaatctctctaacatttctaggcaagaaattattctctcaggagactgccagagaggcaattttgagcttgaaacttattgatgtgatgggctatgaccaggcaacttccgtagtcggggcatgtgctgagtctgactacagtctgactacaaatcccagctctagccccatgtggctgggggccagctattttcattgtggggttagactccctggagggaataattctgagatgacccttttaaaatgtaatccttgtactaaagtggggctagagggttccctattcattcatacggctactgtaacaaatgcccacaaacttggtagctttataacaatagaaatttactctcttccaattgggaggcaaaaagtttgatgtcaaggtgtcaacggaaatagtagacactaggaactacttggggcaagtgttgagtgactgttgggtactctgctcactttgtacctcaaacctcagcatcacgtaatatactcatgtaacaaagctgcacttgtacccccgaatccaacatgaaagttgaaattatatttttaaaaagcaatgtcgggccaggtgcggtagctcacgcctgttatcccaacattttgggaggccgaagcaggtggattacctgaggtcagtagtttgagaccagcttgaccaacacggagaaaccccatctctactaaaaatacaaaattagccaagtgcgatggcgcatgcctgtaatcgcagctacgtgggaggctgaagcaggagaattgctttaacctgggaggcagaggttgcagtgagccgggatcagactgttgcactccagcctgggtaacaagagcagaactctgtctcaaataaataaataaatgaataaataaataaaaataaaaatgcaatgtcagcagattggctccttatggagactttggatactttgagggaaaatccataccctggctctcttttagcctctggtggtgtctgtcaatacctgacatttctgggcttgtagatgcatctcgtccatttctgcctccatcttcatatggcattcccctctatgtcttctgttctgtgtgtcttctaagaatttgtcgatggatttagggctcacttaagtttaagatgaccccatatcaagatcttttaacttgattacatctgcaaagaccctcttcccaaataaggtcatagtcacaggcacgaggggttaagacttagacatacctgttgtggggacaaaattcaatctactgccattttattgtgaactatccttgcatggagaaacagttcattttaacttagaatattcaacaacacaaagctaacacttttctgtgggcgatgactatgtaccaggcattgtgctaattgataaagggcattatattttaaagttttatcttaacaattatatgaggtagggattatggccttctctgatttattgatgagaaaattgaccctcaggaggggaagaccatttttcttagtcacccaactaagaaagtggcacagttggtatcctaatccggaattttctgattctgccatttatgctttgaacaattatgctagaagttctcaaattttgtcatgcataagaatctcctggggttgttaaaattgcaccttccccaaagctcccatctctacagagattccgattctgtaggtagaggggaggggcaaggataggcattaaaaataactgcattatgcaattctgccccctctctcctcccactgaacccatctttaaggaaactgcaacctcagcacaggggctagcagacatattcagatcatctctgaagacagaaatcctcaaaagtgaaaaaacacaagaaagtccaggttgcttttttttaatttaaatttatagtgaaagctaccttggcccacagctttctccctcctggtcccttacaaatatattcctttccggattcttcaagaacacagtttgtattaccatctcccagcaagaagaaatttggaaataggtggtattgctcctaaccccttcctaaatttgagtctgctcattcttcagccatttggaggttttccacttggatgatgtccacagagctaggggaggaaaaattcttctgcaaagcacagtggatgaaccatcagtctgcagtaatccagtcaattaaaaatggatttcagttcccagcagcatggtggtgatgttaggaggagtcagtgtccacaatgctgttggtgcgcttgcccattaagtgatatttaggggatcttctgccatagcagaaaacagtgcggttgatgatctttgcaactaaagaagcaaaattgaagtctcacataccaccacggtattttatttctaatatgttaccctgccaaccttggaaccccgcatgaaactcaggaatgtgaagggacagaagtatgatatattgcccgatgcagctgattcgagagggggtatccaaaatacagtcccaagacatccaggagaatttgcctgaagagagggaacatgtaatggtattagaaaatccagaagatctaagctgcctgatgaagctattttttaaaaaatgtatcttcattgcatttatttttcatcacacagtagttggcgtaaaaccattctctctgtgaaagaagtcaaactacaaataactatgcaaaaatatatagagaaaaaggtgaagcttttcatattttaaatagcatctgaattacattgcttctttcaaggaggtaaactttgttgagtatttagcagttgttccagacttttctctgataaactttcaacttcaacataaaataatgataggtgttttgggaagccatagatgggatggctgtatggatcgatagctagatggctaaatatgttgatagaccctcaaacagattaggtaggtaaaaaatagaaaaataaaaagatagaaaaatagttaacaatgcaagcctctgggcagaagaaatttttccctatgttgtttatgctctgtgtgattctggcaataggtaaatgcattgattagcttctttgaacccacttttcattatctatcaagtagaggaaaacagtgtctttgttgcttgcctccagaattgaggatgacagtgaggtaatgaggaaatgtatttgaaaatattatggactcaacagacatattggcacaactcaggagatgtcataggcccagcttctataagatgatataacctagcacaggaggccaaaagagtttccaaattgcataaaggaaacttgattgtcctttaaaaatggctctggagaaattttatacccaggctcatgtcatctctcagtgaggttaaatctccaaaagaggaatgtcatctgttaataatacatcaagcatgcagcaggtagatgttcttttccttccctttaaaaagttatttttattttattttcatttttaatgtatattttaatgatgcagagtgtcatgttcctcagagtcagactgtatcctaaagtaatggtttggttaaaatatagaatggatttttgccaaattgaaaaatatatatattgtgttataaaactcgagctgtgatgagcaactctttgaaaatacatttaagtactcactgagtcttgtctgaagactcacctgtaagggagggtcaactaagttattcagtcccggacgttgttaactgccctgaaagtggtggctaataatttccttttgaagtgaaaagtagtaagtatgttcctgaactccattatcaatctttaataatttcagattaaggcattgtacttctatacaaaggaatatcatctttgaaaagtggtcttaaataaaatttcacaaataatagtatcccatcctcttgcatttgagaatttctgccgagagataggagaaaataaagactccttgctgctgtcaggaggtcatcgttgggaacagacttcaaagtatgtgaactttggtagtggaaagatgattattccttggtttccagatccttatgcataatttgaatatgagtggctttcaatgctaagtatatgagactcccctctgttaattatgctgtttcagatgagcctaattggacagccactggcacctaatatggtaaatatttcatataacgtgactttgagaagaagggtgcccccctccttaatcccatttgataggatggtgtaacctcaacagcagggatagcttaactctagaaagagttgttatttatctgagggcacctgtaagggggacatcacctaactcattcagtcctagacattgatgcctaaagtataaactgtggtctatagatgtaggaaggcttggaggcaattctagaaacactgcagaaaatttgcagtttctcctccaatctgatcttgaaggaggaggtgaacctggaactccccgttcacgatgcagttgtggaataaaatgaggcttgatttctcctggattatctgaccacttctttttattttcccccggctctatgggggtacaattaacaaatataaattatgtacatttaaggtataccatttgatattttgatatatgtatacattatgcagtgaccaccactctgaatccagtgaaggtatctatcagctcagagttccgttttttggtgagatcacttagaatctagtctctcagcaaacttcaagtatacaatacagtatcattaattgtagtcaccgtgctatacattagacgtctagaattcagtcatcttggataactgaaattttgtattctttgactaacatctccccattccctgctcccttcagcctctggcaaccactcttctcctgtctgtctattcctacgaatttgagtgttttagatcctgcatgtaagtgagatcttacagcgtttgtctttctgtgtctggtttattttctctagcataatgtcctccaggttcacccatattattgcaaatgagagaatccccccccccccactttttttttgcccagtctggagtgcaatggcacaatctcaggtcagggcaacctccgcctcccaagttcaagtgattctcctgcctcagcctcctgaatagctgggattacaggcacctgccactactccatgtgaattttgtatttttagtagagacagggtttcaccatgttggccaggttggtctcgaactcctgacctcaggtgaaccacacacctcagcctcccaaagtgctgggattataggcgtgagccaccatgccggggctccttgttttcttaatagatgaataatattctagtacgtacataaattttaattaaatattattcttttatatatatatataacctttttaattcattcatttgttaatgggtgcttaagttgtttttattattgtgaatatgccgcagtgaacatgggagtgcatatcctgatttcatttccttttattttattttattttattttattttattttattttattgagacggagtctcactctgtcacccaggctagagtgcagtgactcattctcggctcactgctacctccacctcccaggttcaagcgattctcctgcctcagcctcctgagtagctgtgattacacgtgtgagaccccatacttggctaagttttgtatttttagtacagacggggtttcaccatgttagtcaggctggtctctaactcctgacctcaggtgatctgcctgcctcagcctcccaaagtgctgggattccaggcataagccaccgtgcccagccgacataggaatttatttagtgtcaccttgtaggtcactgacctatcagggacaggcctccaagcttctgacatccagtgatagcttcttagaggtgaatgatgacggctcctgttaacattttctggcaggcactgcgtgaagcacttggcataaatgacctccatagataggtgctattatcatttctgcttcacagttcaaaaagtaaaggcttaaagaatgtaaataatttacacctgagtgaccagtacctacacctcagaagagaccctgtctctcagtcatgctgtgctgccagcgttggaaataggtagcaagtctgtggatattaaaagaatgctttttcagaaaaaacaaacaaacaaacaaacaaaaccgaatgcactttttaattatctgattccttgttgtcacgtctttatcaggtagaatgcacaataggttatcattcccttttcactgacgcagaaacagatgtgggctctcctggaatgtgttatgaattgggtgaggggtgccgttcaggatggcgttcctgggtcaatggattttatttccagtgagtagatatgtgggcgtaggtcctcgtttctcatgtctactccctctagtagagatgattttactccacagcaggaaagatgcctgctacaccacaaagggtattatttcggttacggtaataacgcataagggtgtgttttcaaagctgggcagtgcatgcttgccaggttgcagggtgattcttgagagctttctgggcccatcctagagaaaaatctccagtgaggctgcagttgcaatttatttcctcattctagcaagaaagctcttgacgatacagcagtgtttgttttctgcttggtaaagtagaaaggaaaacagcagaaattagcacggcgcagcgctgatgccagcccagaggcagggcctctcctggtagcccccccgctgcaaacctttgccgctggaaagccttcagctgcgatgagattagcagatgcagcagttcactccaaggcgctgtgcagttttttccctgttccaccaggtgttgccagagaacattgagcggagctgagctccgggcgaagtgtgttcccagctgctctggaacactcgggctgttctgaaggcagcaattaaatgagttatgctgaccggagcaaccctcttccttgcacgtttaaatatgcctcccgtgtgcgcctcatgcctcacatttcaaataaacacatttttgatgtgcctttggatctgctcacacattgttatattggaggaatcagagcaagcaaggctgtgcggatccaggctgcaactcaggtcccagctgcacctgtggtcagccttccctgttaccagaaagtggacagtaagcttggatgacacagagggggttctcagtgctagggtttttgcctggtaagtaaaggtagttccttctaacacctgtttcctttccactcttccatacctggagcattgagatcacagtcctaggtctgtgattctcaggcagttgtggctctgtgtccccagggtgcatttggccatgtccagagacatttttagttgtcacgactgggcagttgagggatgcaactgacatcgagtaggtagagcctgagatgctgcaattgatcctgcaacacacagagcatatcccccacaacaaagaattacctggtttgaaatattggcaatagtgaagggaaggggagaaaccccattctggaggtgaaggctttcttggcaagatacccgcattgcccaaaacacagagtacaatctttgaaactgtggtttttccagaaaacctcatctagatcatgacacctaaacatcatgcctcaccaaggtaacatccccaccaaggattaaagaagagttgccatatgccatgggcctactatgtgccaaataccttgttcatacggtttctaatccttacagaaataatgttgagtgggattactgcactgcgttatagaagagtaaaccgaggcccagagctcttgctttccttgttcagaatacctggctactacgtatgggagccttgttttcatccagtcccttccttttactgtgtcaccctgtggcccagagggtggatggatgtgggtttccaaaagaaaacctactttcgaatcttgcttttgagtggacagtaaattagagagtgatgcaaaaacatttagaaggaaaaacaattaaaaaatacaaactttccggaatccagtgttggcctgcctctaaaactctctgccttccaaagtgaccacgcacccacatggcagattgttacctgacaccttctgagtcccttttcagttactgctttggcaaattactacaaattccgtggcttacaacatcacagagtgactctcttagcgttccagaggcaaaaagactgaagtaggtcttactgtactaaacttgaggcttctgcagggctgtttcttctggaaatctaggggaaagtccatttccttgcattttctagtttctagaggccacctgctttccttggctcatggccccttcctccgtctccaatgctatcagtgtagcattttcaaatctctctctgtctctgcctctgcgtttgtatgtcctgtgatctcttaaggacccaagtgagtatgctgactaaccctaagataatcaaagataatctccccatctcgagaccctgatcttaatgttttttattttcataggtttttgggggaacgggtggtatttggttacatgagtcacctttagtggtgatttgtgcgattttggtgtgcccatcaccagagcagtatacactgaatctgatttgtagtctttgaatcacatccataaactccctcttgccaggtaaagtgaggattaggacatgagcatgtttgggagaaggatgttactctggctaccacaggtagtttagagctgccactgctagggataatgggaataaagtaaaggaaaagcatagaattttgacttcaagggatttgtatgggtgtgtgtgtgtgtgtgtgtgtgtgtgtgtgtatgtgtgtggtgcagagaagaatggcacacagcaaaaagaagccatgatactaattattctcagacaggtatgattatcatcaatcatatgcatctttgtatccccagaggctgctatgttgcctggtaagtggggtggtaggggcacagtttgtatttcctgtgttagtttttgtagggaaggtaagagcagtgttcaatagaaatacagaagaaagactgcttattatagcaaccaaaatatggcagcatacctattatcttaattgccgttaacattcaccttaatacaatgctggttgatatgcagaataataacctagagactgtgcaagtcttcacagtgccttctgtatcttcatagattcagtctattccattacactctggtgttgtacaggttttcatatttcactgggggtgggaaaactatggccctgggacctaatctggcctgcggactattttcctagacagaacattatgggaacacagccatgcccatttgtttaccaatcgtgggtggctgcttttgggccgcaatggcagaattgaataatcacaatgaatgtatggcccacagtgcctaaaatatttattccgtggctctttacagaaaaaaagaaactgataacccttgctttacacaactggatgctggcaagctcccttagggaggacagaaaggttgattaaccagaacacaacactctcacaacatgggggtcagaacatacacattctttgaattacagtatttgtgacaacctcctattgaacgtcttactgcaaataataaaagtctcaagttaagggagactgacactcaaatcatttagatttttttttctcagctatgtttagtgagataaattgtgcttcactgcagtgacttgtagatgacaatacagcagaagaacttttaatacggcgactgtattcattttgaaattttaaaaaatgttagactgtgtctgagcacagtaaaccattcaaaactgtcactgcacagagatgaatgggagaaacagtgcatctctgaaaatattccgtaaatatccttaaattataacgtctgtttgatctgctgagaagtagctaattcccgacacttttcatctctctagactgcccatcgattgtcctgagtattgcgattgctgttcctgataactgacttgataatttaatttaataagaccttatcttggtctagaggagcaatcaaggctgctatctcctacagcacgtttctccaccattgacattttaggccgaacatgtacttttttgttataggtagacatcccatgcattgtaggatattgaacagcatccctggcctcctatccactttatgccagtagcatcccctccctccttgttgtgttgttactaccgaaaatgtctccagatactgccattgtccctaaggcatgggggcaggggggtggttaacatattccccagataagaaccattgttctagaggtatggtgttggaagcgcttggcacctttcatgtaaatcattgcatgttgtcatcccaggtgaacttttcttcttttctttttgcatccccgcccgtcaattcttcccctactttctcctgggctgggcttttcttcatgtctaaatgcactgcaaagacgagattgccttgaactcctccagcttttcccgataaccctgagctgcgctgtcgctctaagccagatcagcagaatccggcctgtgatcaggttccgggagctggaggacctctccgtctcaggctgctgtgatcagagagtctggagaatgagaatctctctgatgtggtcttatcaggctgagcctaatgtcaaccctgttagaggagctttgtccgatctgcctgtagctttgttctgaaccgttcagtaacagttcactggagcagaaagagccctgtgaattgatattataaacccacatgcctgttttattcattgtggaggcaacagaatataacacaagtatttatttttagtggttggagaatggcatttctttccccgtccccattgtcacagaatgcagaaaacagcacagggctcctgaacacaattctattagaaagctgttgccagttgttcctggtttcgattattttgcactatcctaagcagtgtatgtctgtgcattgaatatgtatgtgtgcgtaatacatattacgttcgtttggatggtcttaataaggagccacataccatcagatgtaatccaatcactataggccagaccttctatccttggctattcccttaaccccatcaccaccttgatttcgttggaagttagattttctagaaaaattcatgaaacttcaacatgcttcattcattccttgctctgggcattccttgctgaaggtcaggagctgtgaaatttctctttagtcccattgctttgatatggcagaggctgggcaatgaagaaattgaagtgtggaaaaatggagttccggcaatgtcttaaatgaggggaggggtcttatcgaggaggctgtgcctgtggtctgagctgacatttctctaacagtgagaccaggaagaggaccaggggacacagctggatggctgcaataccagggtcccttcagctgcaattaaagctgcatcttacattggagtcttcagtgatgatgatgatgatgatagtagtagattgaacataggaaattgctgtcatttgacaattgttaacctacataaatgtcactttcctacagcgcaacttaataattgtacacataatagctcatctgcgctgggtgaccgctatggtccaggcacagtgctgtaggcactgcatatgtgttggctccttagaccaacacagccactgtctattacagatactgttattgctctcacttgacaaataaggatgctgagctgtgggaataatttgcccaatgacactaaatggcaaaactgggattaaaacccaggaccttaagactgcagcctcggctgagcgtgatggctcacgcctgtaatcccagcactttgggaggccaaggtgggtggattacatgaggttgggagttcgagaccagcctgaccaacatggagaaacccggtctctactaaaaatacaaaattagctgggagtggtggtgcgtgcctgtaatcccagtaaggaggctgaggcagcagaatcacttgaacccagaaggcagaggttgcagtgagccaagattgtgccattgcactccagcctggacaacaagagcaaaactctatcccaaaaacaaaacaaaacaacaaaaaaacaaactgaggtctcttctgttaacccctatcctcctctcttggttggataacagttttagactgatgctcctaattcccacagaggggcctgcattttcatcaggcttgaggatcatgagttttcacgtgtgtgtgtgtgtgtgtgtgtgtgtgtgtgtgtgtgtaaatcaccctaattgtggggagtactaataagttccatcgatctactcttcacctagtaatcaacttgaattatttatttatttatttatttttcgagacagagtctcactctgtcacccaggttggagtacagtggtgtgatcttggctcactgcaccctctgcctcttgagtttaagcaattcttgtgcctcagcgtaccgagtagctgggactacaggcgtgagccaccatgcctgaccaatttttgtatttttagtagagacggggttttgtcatgttggccaggttggtcttgaactcttgacctcaggtgatctgcccttctcagcctcccaaagtgctgggattacagccaccacacctggccaatcaactttgaattctaagaatgggtgacaaagaactttgtcttgagggttgtgtgttaagcaagagccatcaggtctcatcctcctcagtttagccacaattccacattagtttccccgacagtgtatggaatttcagttctacactcttccttctctaaatttcacccggtctttcagagaggagacagggccctaacagacttagcaaagatgttgaacacatgaaaatgggaagtactgtttaaaaatggaataactcttttcttcccccaaatctataaccccagtctaattgtaagaaaaacatcagtcaacttccagttgagggacatcgtgcaaaatatctgactgtcaaggtgatcaaagacggggaatgtcaggccaggcgtggtggctcacacctgtaatcccagcactttgggtggccaaggtgggtggatcacctgaggttgggagtttgagaccagcctgaccaacatggagaaaccccgtctctattaaaatgcaaaaattagctgggcgtggtggcgcatgcctgtaattccagctacgtgggaggctgaggcaggagaatcacttgaacccaggaagcagtggttgtggtgagccaagatcatgccattgcattccagcctggacaacaagagcaaaactcctttcaaaaaaaaaaaaaaaaaaaaaagatagggaaaatctgagaaactatcacagacaagaagaaacttcagagtcacggccgcccagatgccatgtggtgtctcagatgggatcctggagccgaaaaaggacattagatgaaaactaaagcaatcgaagtataggctgtagttaatcgtgatgtattcatagtggttccttagttgtgaacatgtaccatgctactgtaagatgttaataatagtgaaaattggctggacaccgtcgctcacggctgtaatcccagtactttggaggactacctgaggagttccagactagcctggccaacatggtgaaaccccatctctactaaaaatacaaaaattagccaggcgtggtggcgtgtgcctgtaatctcagctcctcatgaggctgaggcaggagaatcacttgaacctaggagctagaggttgcagggagccgagatcgcaccagtgcactccaggctgggcaacagagtgacattctgccaaaaaaaaaaaaaaaagttaataataggggaaattgtggagtacatggaaattctctgtacaaacttcacaacatttctgtaaatcgaaaagtatgctgcaattaaaattttatttttaaaaagggaaaataaacataagcccacacaaaaaatatggactaatcaaatactttctagatttcgtgtttatagcgtttctcacttagtaatacaaagcattctatcttagatttctcccatgtctgttagactcccaaaggcttttaccccatggtaaacagcataaacaaatttgtatggcttttttaaattcagattttcccaggctgatttaatcatggaattacgactgggcatggtggctcacgcctgtgatcccagagctctgggaggccgaggcaggcggactgcgaggtcaggagatcgagaccatcctggctaacacggtgaaaccccgtctctactacaaatataaaaaattggccaggcgccatggtgggcgcctgcagtcccagctactcgggaggctgaggcaggagaatggcgtgaacccgggaggcggagcttgcagtgagccaagatcacgccactgcactccagcccgggcgaaagagcgagactccgtctcaaaacaaaataaaaataaataaaaataaaaataaaataaaaaataaaaaaataaattatggaattattttacttgagaagcagtgatggggaaaaaaaatgtaggtcacaagcctccctgatgacaattcctttcataacaccagcttttcccaggacacaccattgagacaccttgacatcactacccagaagcattggtaacctctttgtgcctcaacactgattctcgcctgtaaaccattcctctcccctggccaccctcctgcatctgaccccctgcctcccttccccagtcttcctctgtagcaatgggtcccacacatccctgaatcacttgttaaaacctagatgtccagccttgacccccagagttcctgattcactgggtctgggatggggcccagaaactttgcatttctcacaagatccaaggtgaggtcaacactaccagcctggggaccacactttgcaagccactgagatgccctctgtctccttgtaaggctgccatccattccgccatagattccacgctttgctgccacccccctgccccctgcctgcccctttgcttgtcctcttgctattcccaggcactggttgcctgttttctaacataaatgtcaaaaaagtattcctcagcgggtgtggcattcagaaatggataggattcaaacaagcaaagggggttacttggtttaagagctcagtttaatgacaagagtattttccttgtagctttgtagagctggatcccaggtacctctcatgaagcccatgaacttggtttctaccctataaattgaggttgatgagactcatcactttggcttttgcgaggattaattggatttgcattcgttaagtgcagagcctggcacattgtaacagctcattagtaattactttccaaactccaaggagatggttctcagatgttggtgactatcatcacctcctgcagagatgtggaggtgcagagtcctgaccctgcctccaaagactcttactcatcaaatttgggagtgagataagaatctgtacatgttacaaagaaaccagaaaatcccaattcaaggggtctacagacaatccattcattcgttcttcacttagttatccaacaagtgtttcacatacacttccatgcaccaagatgggattgcaggtggtagggatacagaaatggacaaaaccgagtgctcaccttggtggagatgattggcagcctgccttacacaaggaactctatgttcactggccaggttatgggaagtggtacaaagttggagtaaaagtaaggtaagaagatagattggtggtcaaaagtctttctgagaagattacatgagaggaaagatggaataaaggaagaaaaatattgaaaaatcttcaattaaaatgtgattctttctaatgtgagccacagaatttaacacagatctgtagtagtcatcttgagtgtttttcttttgatagaaaagtgtgactttccaaccaatatagtaggaacttgttgaaggtctaccatatcccaaacacaatgtttttcaaatattgtttttattttattttatttatttatttattttgagatcaaagctcactctgtcacccaggctggagtgtggtgatgcgatctcagttcactgcaacctccgcctcccgggttcaagcgattcttgtgcctcagcctccagagtagctgggattacaggcgtgtgccaccatgactggccaatttttgtatgtttagtagagatggggttttgccatgttagccaggctggtcttgaactcctgacctcaggtgatccgtttccttcagccttctaaaatgctgggattacaggtggtgagccacggcgcccagcccttatttctaatccctgtaacagattatgcaagggaaggtgtttcatcccaacattacagatgaggggagttgtgaggagcttatatgatcacatagtgaatggccaaagatggctctttctatactctacagcctctgacatacaaagattcagacttcatttccaaagtcattagcagtaccaactgtaatcctcttaaggaactaattattttgttaccattttctgtatttattatattgccatgccccatggcttacaatcctggctgtgccttcaaatgtcccagaggcaggaactgagtgtctggggtattaaggttttctcagatgatgcatctgatatgcatccaatgacaggtaccactggctagcattataatccaagataaatccatatcttctgcctgtggaaccagatggagttctggtatcaaaatacagatctagagggtagctctgagccagtgcacttgaagtttgtggtcatgatgaacttcaagctcatgtaagagattactgaatttcccagcaatgagtaacggaccaacctatggagaaggcagacagaatggcaatgtggaataagcacaggccctggcatccaaactgggtttgaaacccacctgtccacttttctggctttgtgatttggggtgacacacaaaatttataatatacgtaatattattaagaacacagtaggttcccagcattgtattctctgttctctctcttaaaagtgccaccctctaccaagaagcactagttgaattccaagaaggcaagaaaagggctaccatttcttctctacccagcaatggttacgttaattttccagtgcaggaaagtggaagaaaataagagtatatatatatctttccaggcccttctttccaaagttatttgactctaaacttagcatcctctcccgggaagatggaactgtcctttttgtgcatttgctgtgataactttgggcccagttacgcttgctacgaagcttgggctggtagtggtttaggagaaaaaaaaatcaagtgaaacttaggactgtcttctctcttctttcccgaacttcatctttgcagagatgatctcctctttgacatgcagagtactcaggcctctttttctcttcttgtcctttctttcttattaaacctccagccccccaatctgaaacgattgctcccattttgtattccatggagctgtaatatttgcccaatgatgagctccattcagcagtttgttaactgaaatgggaagtgacagattcaataaaaggaaatctctgtgccaaggaaacagatattatttctcccctcgctctccctttctgtgtctctcagactactctgtgcccggaatccagagactctgagcttacggacaagtcaaagctttctgttgatccatgcccaactaatttgatcagaatagaggtttttattccctgtagttcttctctctcatgcttactgatatgattgagtgcctgggagtcacccccaacctctgctgattgttagagggaggaagtgatgtacaggaaagtgggtacatggtgtgctgggaggggggccttgtagacaagatggggacaattgtaaacagaagatcggggctaatgtaaaagtgcaagatcctcttctggggacagccttcttgtcttcatggatagtgcatatagaaaagcacccacgattcccagtcattgaaaaccagaggaccccagtggcaatggatacccatttaatctctgagaaaatattaatgagtaaaaggcaagcgactttagggatgtttttttttctttccacatatatgtggacactagttgtgaataataatgacaatgacgatagtgagtagatatcatgtatcaactccctactaaatgccaaggtttggtctatgcacgtaacacatattatctcattcaatccccgacaacaaccctctgaaggaggtgtccttattatccacattttatagcagaaaactggggcttagagaagtaatgtgtccaagaactcatagctggcaggtaggagccctgagattccagtgtggggctcgtaaacttacactttgcctaaattttttttaaatgattgagttcattgttcatttatatttaattttaagaaatagcacaaagagtccgggcatggtggctcacacctgtaatcccagcactttgggaggcggaggcgggtggatcatctgaggtcaggagtttgagaccatcctggccaacatggtgaaaccccatctctactaaaaatacaaaaaatactggctgggcgtggtggtgtgtgcctgtaaccacagctacttaggaaactgagacaggggaatcacttgaacctgggaggtggaggttgcagtgaggtgagattgttccactgcattccagcctgggcaacagagcgagactctgtgtcaaagaaaaaaaaaaaaaagagatgaccccatatcctgttcccccagtttccccagtggtaacatcttatataaccaaagtacaccaccaccaccaggaaactgaccttgatccaatgcatccgccttattcggatttcaccagcttcacatggtattgtgtgtgtgtgtgtgtgtgtgtgtgtgtgtgttcacttctctgcaatgtctcacccatgtagcctcctgtgatagccaccatagccaacatacatcatagctccatcacaaagatcctaggctctactctttcgtccctgcagtgacctccctccctgctccatatctcaggaaaccttaatgtgttctccatctttataattttgtcatttcaagaatgctatataaaaagtatgtgaaaggcttcatgttggtcaccctctgtgcatgtgtgtggttgcagaattagtcctcacacagagcttgattgtctacttcacttcttgacgcactttcgttcctctgtcatctcccatctcccttttcctgcagatgtattgggttgagacttctggattaggtaccctgttggccctagtatgcagcctatcacccaatcaccacaaccaccctcatcccacagatgggctccagatgtcactgtgtggaggtcctctatagattttcagatcacattcagtcactggaggccaagacactccctgtcactctctgcccaaccctccattcctaacctcacctctcccccacggccaacctaggtccattagccatgctgagcttgaggataagaggactagtttccattgctggtccatagtttccaccccagaagcctccatgccccatactggttaaaaagttattgcagaagaggtttgccagaggtaaaccaggtcttccagagtataccagaaaggactgcatgttgtctgtttgagtgggggacttcatgcccaattttcacagggcaaagcatctcctggtgtcttgtgtggcaaacagctttgatacttgcccatgtcccatggtgtccaggagacttttcattaaatgaggtgaccactgcccctttagggcgtgagccaggcatctgagatggagattacgcattctgtgtctctgcctgacacaacatttctgttttcctgatggcttatctgatgccattaaagtctctacctgtaaatagtcagtagacattgggtatgaaagacccaaacaatatttggctgaactgttcgttgccacagagtattattagattagattggatcttagatattgaagaatttttactcccttacttttgcaaacctggaaaaaaaattgatgctatctgctctctagaactaatactttatggtcttatcctcttttctcctctctctcactgtgtctgtgtctctatctctgtctttctctgtcttcctctgtctctctcacctcttttttctcttctctcctctaaaggaaggcattgactcttccagagccactaagagtcgaggtttttttttgttgttgtttctgtttgttttgttttgtttttgagaaagggtctcagtctgtcacccaggttggagtgcagtggcacaatcagagctcactgcacccttgacctcccgggctcatgctttcctcacacttcagcccctggagtagctgggactacaggtgttcgtcaccacgcccagatagttttttttgtatttttactagagacagggtttcgccatgtttcccaggctggtctggaactcctgggctcaagcagttcacccaccgtggcctcccaaagtgctgggattacaagcgtgagcaccaccaccgtcccccacccccagccaagagttgtttttatcatgtccttagtcttgttggttgctgccttgtccctttacctgttgttcctcttcaatcattgcaacagtgacactccccttagctgggcatcaaacacagacagaagcatattcaattccaggagtctccactgtctctcatctgaatttaagctggacacctcgcttgtgaatgcagaggggccagcatcccactcccgccttggcgcaatgcaaccggcacctttgagggggcagattgtattgtgccttgtcaggcccaccacggcttttgttttcctgcgcatttgaataatacatctgattaccatggcaaatgttgcggcatatgcaagcttggacctcctgcctaattagctgttgataacagggccccctgccctttcccctctccgcagccctcagggacatgacagttcttttatctttcttcaaaattgacttgctctcccgaccctccagtagttcctgttttgtctgtttacctctcctgcattttgcaagactgttaattttccgtggcacctcctatctggttgtaattaacacatcgcacactgaagaaatagttctgctttttccagatgcctaatggaggcatgtccttttttttcttttctccactaattataccactgtattttagcaacctgcattgacctaaaaggatctgttttctttctttcttcctttttttttttttttttttaattgttttggttggaagaataagtatggttttagaacccagtttgggcagaaactgggaagagaatgaaatcattagtgatatatgttgtcactgtttcttttcatagcctttaaagtaacaaatgagggtacatttgttgtcagccttcctgttcagcgtttgacaactctttgttagatgtgggtaacgtttgctttggatatatgctctctctccagtctaaatattctgccgtggtaattatacagatggggcacatgacctattccgtagagtgtggaaattctcagcagattgtaaatagcctctcgtcctattagattttaaggaagctaagcccttgcctcccaaacatgagacatggaatctgtttatcatcttatgcttaggcttaagatttaagctgtaatgaatactggttcaaagagattgaggtataagaaggaggttggtagttacagcaataaaaacaggagcaaaaagagcagcttttgtgaaggactccggctggaataatgatgatagaattgtctaaatcgatacatctcttgtcagactcatgtctgatgtttgaatcaaccaggccttttctgcaagagctttcctcaagaatattgaattatttattatttgtatctttttttttctttccctttctgatgattttttttccttctgacttagtgaaatttgtttttcatgctgccaggttgaatgttgtctactctttgataaatagcagtaattgggcatatagcaggggtcatgtacaaatgtatgacttcaattacatctagagcatttttttctttatattgatcttttttttttcttataagatctgttctctatagcctgtggtactgagtactttaaagaattattctttgtccatgtatgtcagcatgcactttcaaatctatatatcttttaaaatatatatatatatacacacatatatatacatatatatatatacacatatatatatacacacacacacacacacacacatatatatatatatgtagtcctgcgctttcctgaggctgtacagacgtgggaggcgaaattgtgacgcctccacttgatgaaccatacctgactcttttgctcatcttgcagtcttgtggcggtgtcatttctacggttggcttttcttgctacaggttgggccaaggtggagaaggcactggtattgaccaggaaagttgtatgtaatagaaattgtagagcacagtaggagaagaaaagtgaaatgaagtagacatgggaggcagaaagacaaagagagagagaacaacctatgttgtaattgaagcttaagaaaataccatccttggacactttcttgtttctgattttatctaagtatcttctggttgattcttaaactgcatgtatttatggcacatgtatttgccagtttaatggacacttttccatctaggactgtttatattcaggcacccatacgtacacatatttccaagggtaaataaacaccagcctgaatgtttggtgagattagctttggcaatagtgacatttcccaggcacagccaggttttctaaggcaggaatctgaggtctgatgatattactgctctgagcgtacctaacctacagtttgaggaaataaaaggtaggttggaagactgccgaggcccccagttggctgctgcttccagagactgcaggcttactcagtgcttactgtcccatttccactggcctggagatggcctttgccaaagggcagtcatagaaataacaactccacatcattccttgtttggttctgcgtttctgtaccatggcatcgtgctgtcgtcagcagttttctgacatgcaaaataatgatggggcactgaattatattttgtaagggcatgcaaatagagagtgttcatttcttcagcctttttgaaggagaagtgagcccttaaaagtcattttcgggtaggaagtgtacacacattattttatgtcatgcccagtccctaaagccatatctgttccatatttttcagagggagaaaatagaataaaaaccctcagaggctctgagtgataaaggaaacacagtctcagttattatgctgtaggagatgaagctgggacttaaatagacaaagagaaatggagttggctttggtcgagcctgtgattctgggccacatcgtatttctgtgtgtatgtttgtgtacgtgtgcgtgtgtgtgcgtgtgcttgtgcgagtgagaaacacttggatagaactgcctctcccaccagtaggctgttaggcacggcactcagaaacagccctattgttttagatttcctttcatatcatgtaggcgtctataccatgccacccacacaggagagcaagtgagctgtgaaatatattcattgttagagtactggggaaatggcggcaagcaatcggaggtaataatgtccgacaggcaagggaggctgccaacattacctgcattatttcggttgcctttttcattataggttcgggaaataggcagcaattcgattatggcatgatttggggtggaattgcttgcactccgtgaccccgtcactgggggatcaaatgagaagtcaaatcaaataaagttcatagtgcattaaccggatggagcagtgccttacccactcagcacgatttttcatcttccaggggtttgtgactgcagcctagatatctctgcaccttaaggcatggggaggattggctgagatgtataggagtgaggagaggcggccaatagtgtgcaaacccctcccctcccatgtgtagcgccgagtttctctgcagcttgagcaaagcagtgtgattaataacaaggaggaaacctgcttgttggattattaatttcccatcccctttgccttattttttttctttgccatattcctgatgctttttcttctgcctcttttctttttgccatttgctaaagcctctccacccctccttttccctcctgtggcccacacttttgcccatggagatatccactagtcctttacactgacacctggccacccaacctcgtgccggctggcttcacacctggggtgagtttatctcttcccttcggggattctgtctctgaaactaggagagagagaatgagggagaaagagagagagagagagagagagagagagagagagagaatatgaatatgggtccagtggtgttggagccctgctgtattttaatcatagacttggccttcttttaggagtgacccaaaaagcaagaccagttcgtggggtacctgtatccaaccccatttcagctgctgtgtggaaaagtaggatttctcatagttaactgattaggtattttctcaccagttctaaacacaaagagtgcatcttgcaaaaatataaaaagttgtggggggtgggggtgcaggcaggggagataatgactggtaattgcaagctgtcatactaaaagatatttggggtgcaagagttacttctgccagcagaatggtagaatggaggaagggggagatttggaaggctttggggtagcttgtgaggggaggtactttgcattaaaacttctgtcaccatctgtactttcgatttcacagtcctaccctcacactactggaaaggagagtttcatactgactgtgggcacaggggagtggtttgcaattgcagcttgtgctgtttatatggtgcatgtgatttggggaccttctgggttctgattcgctgacctgcccagaggaggaggctgggccactttcttttccacattatgtattgcacacctctgttctgtgtctctcctcacctgctttgaaggatttctttccctctctgcaaatctctcccctcccgtaaatcagcatgattaaatagcagaagggtggaggtggcgccatgcattatgcacatgagctgtctttaccagcctgtccatatgtctgaaggaaaccttgtgttttaatcccaagaagtcaccttttttgaagattaccttgaagcatccaaaagctaataggatggagaactaaaggcatttgacattaattgttctgtctatttatataacttaagcacaaggcagcgaaaatcttccaagctgattatttctttggtttattctgagtctcttttttaagcattcagagcttcttaagtaatgaatttttaggaaaaagagccatgcaatgataaagtgactccagtagcagatttttgtcattttttttaaaagaagtgctcaaatagggcagccatgaattttatttgtgtaatttacacttgaatatgaatatatatatatacatatatatgggggtgggggtctagctctgtcacccaggctggagtgcagtgatgcaatcttttctgactgcaacctctgcatcccaggttcaagcgatgctcctgcctcagcctcccgagtagctgggaatacagaagggcatcatcacacccagctactttttgtatttttagtagagacagggttgcgccacgttggccaggcaggtcttgaactcctggcctcatgtgatccacccacctcggcttccaaaagtgccgggattacaggtgtgaaccacctcacctggccatacgcttgaatatgttttattaaatatgagattactggtaaggacttgatgtttacatcatagctgttcacaaggtacataatgcatttattttgtttcttatgtagtgcccaggataagaaggaaatgaaagaacctatggaaggggatacaatttcagctttgacagtttgggatcatagtattatcctaaaagcaagcaaacaaacaaacaaacagtgccagctgaaacaatcacataatcacctttctagttattttttcttcaggttctgggtctccctctggaaataacaggtgttattttgactgaatgaccccctactgaggtaaaatttggagcagaatataatacaaattatattccaaaggtgataagatacttgggagtttgagcaccaagaagaatgttatcttagagatggtatgagtataatacaagttggcattattattattttgacataaaagggggaaattattgtaaatctcagtgtgttgtctgtatcaagtactcattttttaaaatatgttttttttccagggaaaggcttatactgttgggaaataatttcttttagacatttagagaaaaaaatgtgaaaattatgttttgaagtgcatttttgctgtagaatgctagaagtccattgttgtttaatgcttcatttacagcatgcggatttacaacacactgaatgagagaagtggggtttaattttttcactatgacttcttataaacccgcaaggggtctatttgatgagtaatagttgagttgacttttacctacgagttaccttctccacgtcttcattgcttcatttttccctcaaccggatcatgtaatagaaaacttcctcaaaacctgttcctacttgagaaatttcaaaggatggaaacccttctttgaaggacttaaaattacatttatatcaggatgaatcatgtttcgactttaaatatcaccttatttctggcggtctcttttgtttccaagtggcaaatgttccttctgaaattacatagtttcctcttgctcattctgtttctaaacttctctggataaatgtgtgaaaataaatgaaattgttaagccctgagaataagcttggaaaatagaagttatcctacctgggcaaaagctccaaacattctaggggggatagagacccctcctccctcttttaacaaatcctcccttgaactggggagagaaaggatcgccttccaggattttttttccctgacgtgtaacagttcttaaaatactgccttgttaatttgtttctattttacatgagcattatacaaacagtgataaacgaaatgtatcattttttccccataaagcctcctcccagattctcctcagtgtttacagaaatgtgctgtatccatgagctcagatcaattgtttatacacattggtgttcatttgttcaaggcggcatctgggcctcggatgtcgggagagacccactgaggcaaagcactattaatagaaaggcttatctcgtttaagggagtaatcattttaatatactcaggaaaaagccagcgtgcaggctcttggcccacccttgcctaggcagggtctacaccttccagaagcaaacacagccgaaaagagctcttaaagaagtgattacagagtcatgattgctctacaaattgagtcttttttctgcttgacagtgatcctggcatcgtctccccgcttaatccttactagcaatttgcctatagttgcagctaacaagaggtgattagaggggagttgccagtcaccacttaacacccagctctgggggcaccatgggcacaggctgccgaattgggcctgttttcttattaactccccacctctgaatgcattagcccagctcttagctaatgatagttttcaagcaacagcgtgagttcctgagcagcatggtgatctgactctccagcatgcagctaggaaaattaggaaggagagggagaaagcatgttgttcttcaaaccaaatagatgcgccaagggagaggatctcccccaataaaattaggcgcacgctgtgctgcgtggctgtcttggtcttggaggttgtgggttgacacaagaaggggacatgatgcgttgcatattttatctgtcctgtggaaggtcctgagaataccaacagcagtggatcttgggttagaagctagagtgaagtggtctgcagacaggagactacacctacaggggtgtaagcagagaggcaaggcaggctgtctgggggacaggtccttggttatcatacatgagggtgcatcagcattcctgcacggcttgttaaaacctctgagtctgtggcagatacacaccatggaatactatgcagccataaaaaaggatgagttcatgtcctttgtagggacatggatgaagctggaaaccatcattctcagcaaactattgaaaggacagaaaaccaaacactgcgtgttctcactcataggtgggaactgaacaatgagaacacttggacacaaggtggggaacatcgtgtgaccggggcctgtcatgcagtggggggagcggagagggatagcattaggagaaatacctaatgtaaatgacgagttaatgggtgcagcacaccaacatggcacatgtatacatatgtaacaaacctgcatgttgtgcacatgtaccctagaacttaaagtataataaaaattaataaaataaaataaaacctcgagtttctgattctgtaggatgtaggacggggccaagtaatttgcattctaacaaatttccaagagatgctgatgctgctggtctgagaacccccaagtttgagagcccctgctgaagttggacaggcttggttttgcaaaaatgcgaaacgtaccaaatgtaccctccggtgacttgcttaacaactgtgtgtagctctcccagtgcagaagaaaatccccagtctctaaccaacttctgagacattaggccatcctttcccctccaattttaccttcccttgcccaagctaatttaactctttctttcttttcttttctttttcttcttctttttatttttttttatttttatttatttattttttttgagatggagtctctctctgtttcccaggctagagtgcatggagtgcaatggctggatctcacctcactgcaaactccacctcccgggttctagtgattcttgtgcctcagcctcccgagtagctgggattacaggcatgtgctaccacgcccagttagttttcatatttttagtagagatggggtttgaacatgtttcccagcttggtctcaaacccctgacctcagatgatctgcctgccttggcctcctaaagtgctcagccaccatgcacagtcttaatttagctgtttcttgaacatactccgtgcccccatatcagatatctttttacattccaagaatgtttctccctcctatttgctcatcctaaaagttcttacctgtcttttaagttgtggctcaagtattgcctcctccaggaggccccagctgcatttgtcatttcctccaaatctgaactccttatatgctgttatgtgatggatgtatcacgttgcatgatagtgcttacgtatcttttcccctgaagtcaggaatcccttttattcatttagtttctccaacacctagcattgctattggcatatcgtcactgcagtcaactttttttgttgaataagttttgtatgagatatatttgacctatgagaattaatatctttttttttttttttttttttgagacggagttttgctctgttgctcaggctggagtgcaatggcatgatctcggttcactgcaacttttgcctcctgggttctagtgattctcctgcctcagccccctgagtagctgggattacaggcatccactaccactcctggctattttattattattattattattattattattattattattattattatttgtagttttagtagagacagggttttgccatgttggccaggctggtatcaaactcctgacctcaggtgatccacctgccttggcctcccatagtgctgggattacaggtgtgagtcactgcacctgaccagagaattaatatctaataagcgaagaccaaacattggagtcagacagcttacatttgagtgttcacacaatgatatatgtggatttttctttctttctcttttattttggctttgagggcaattcacttcccctctctgagactcagtcttactcatctttataatgggaataatgataatgataacagtagtagaagtagcagcagcagcaacagtagtagtgagtgacactactcacatctgcacatgtaggtcgtaaagtacaacacagtacaatgcctggcgctctgcaaagaaaaaaagtgtatcaacagacaggaggatttctattgttgtccttgattctactgtgagacgtccacactggtggaaaggtgacctgtcttgtggaaatgaatgtgtggaagtggagaggacccgactccagagctggtgggaaatcgagcggcataaggcttttctgacatctcctgatgtgaacactgtgaatataatcttgtgaaccagagcaagtggaggggacatctactggacagaggcacagcaacatcctctctctggtcaccccttccctgctcacccatccccggccatgctggcttcttcctcctgctgaagcactcagggatctcaaggacttggcacaagccatcctgcctctccttccctcacccccttttcattcatcagctgttgattttggtgtcaccgtcctctgagaagccttccctggctagcccatcaaaagtgatcctgcccagccaacttttattctctctgccagcacactgtacttttccttcatcacattcatagctgtctgcaatgatattaccttgaattttagtttacagtaagcttcaagagaacaggaagccacctattttgtcctctcatacacccagagcctagaatctagaggaggtgagcagaaaatagtcgtcaggtggatgaatacaggatgggaggaactgataaaaactgccatataaccatcatgggacatggcaaaggtagataatatatcttttcccttgggaatttacaatttttattgggaaaagtgcatgggtagagtatcactcagatatttctttctgtgcttccatagaccctattatttccctaacagcaaactctgcctttccattcttcattactccaactaataattattgagatatactatgtattgcacactcttctagaagctgcagaatgtatcagtaaacaaaatacacaaaaatctctgcctttgtgggacttgtgacagtgttgcattgacctacttactttctccctgcaatcattgagtttctcttggtctagggccatttgtcatcatagtttttccccagctcctaacatgattcttcacagagagtacatgctcaaaacaaattggcggaatgaattgatttttaaaaacttgttctactttcttgccactaagtctataatccaaccaaatgagcttatcattaatctagcacatttaaatatttttggataaataatgttccattggcccacagtaactattccagcctcatgtcttcactcatagccattccctatttcgaaaattatttattgttttgttgtggtggtggtttatgcaattcccaaaagcaaagctgcagcatcttactgctgataatattttgaaacaacttccttctttgaattaaaaatggtacccacctaggctgggcgcagtggctcatgcctgtaatcccagcacttcgggaggctgaggcaggcagatcacaaggtgaggaaatcaagaccatcctggctaacaaggtgaaaccccgtctttactaaaaatacaaaaaaattagccagccgtggtggcacgtgcctgtagtcccagctactcgagaggctgaggcagaagaattg[136 bp omitted]atggcatggaatagtacattggacttcaagttcagtggccagggtccacacaggaagcctggtcgtcttgctacctggatggccaagtgcaagtcacttaactttttataatctaagcatccttattcataggaagggggcttggttatcatgaatattaaataacgtgtatgatgtgactggaaaagaaccagacgtagggatatgccaaagaatgtttgtttgctagtttcttagactcagaaaaatagaagcacgtgtacttgaatctatgttgtatggtagttttgctttcacaatcatcaaacaggagtctaagcccaccctggtcctctggctttctactaaggcacaggcagcaccagcttttccataacaacaacctcaaacccaaactgactaattatctactgtgtgccatgcactgtgctagtgttttgcgtgattatctcgtttgattccttaccttaactctaacaagggatcctattttttacatgtcttttattattattgttgttgttattttgagtaggactctcactgtgttggccaggctggagggcagtggtgcaatcatagagctcactgcagcctcaagcttgtgggctcaaggaattctcctgcctcagcctcctaagtagctggggctacaggtctgcaccaacatgcgcagttaattttttaattttgtgtgtgtgtgtgtgtgtgtagatgggttcttactgtgttgcccagactggtctcaagctcctgaactcaagtgatccttccactttggcctcccaaagtgtgggattatgggcgtgagccaccgcgccactgtgcccggcttaatatgtcttttatttttaaaaaatgctggtaaaatacacgtaacataaaatgtgtcatcggtgatatttaatgcaaccgccatcactgtccagtttcagaacatttttattacttcaaaaggaaccccatatccattaagctgtccctctccattctgtcctctccttagcctctggcaattgctacagaacaaagacatggagaggttaagtggcctgctttagacccacattactgagtggcaaaactagtatttgaggctgggaagtctgctaccctagtgcagaacacttaactgttaaggtaattagctccccattagaaagacctttcccccaccatccagttcacaggaggcaggggcttgtttctagctaacacaaaagatgattttctctgaggcctcattacgggatgccaagcattcccaccagtgggcagcctgtggcacctagaaggtccgctccttccacttgctttccttacacccagcccagtgggaaggagggtgtcacttcagcagtgggggcagatgggtcttcagatcccacaggatgcccccacactgtgctggtcatccaactcattgtcaggtcagcaggggtgcctgctggcacccagagcttttgcctggggcggaaatgtggctgtctgacttttcttagttttcatccttgtcttaaaggtaggatgagtctcccaaggtgggatagaatgctgggagagaagtgaactttgggattttggtaaaattctctgcacaaataactcccagagagaagggtaatctgctaccccactcatctttactctttgaaaaatttaggatcccaatcccagaagagaagctttttgtgaattctcctaatgcaatcgttgtgcttactgaggctgcttggagagactgtcactcaggttgcattgcaccttaaagacataggatttcttgtcttaacaacaggtatgcacaaacattttttttataaaggaccagagagtaacacttttaagctttgtgggccatctggtctctgtcacaactactcagctctgccattttagtgtgaaagcagtcacagacaatacataaacacatgggggtaactgtgttctaataaaactttatttaccaaaacagatggttggctgaatctggcctatgggccatagtttgagagccctgtcctagactccagctgatggccttttctgtgatgtgtggaatctcccccaagcattctgttgattcctggaactatggctcctttgctctctctgctgcttcccagcttgtgaatttgcattcatggtcatctctgttttcaggccatcataacacagaatcaacagccttatggtgttgccccagaggattcaatgtgtcaagtggcattttcgaactgtgtagaagacttctctgcagcttctgtggagggaaacagggaaggaggtttatatcttgtagcccccagcaaatgccacgcaaaattcccgcataatcttgttttcccaggattctttctcagcagccttggaagtgggatagttggggttggtgtgcccattgaattcccccaaccaagtactcaaacttgctgatcctcccttctttccttctgggacttcttaggaggaagtctataaaatctcttgtctttaatatgcaaaaaggttttcttgcctcttctagtaaaaacacatagtgggcagagacggtgagtaagggtccagttctaattcaaaccctaagctcttagtttgcattctccacaataaaggcagtagtctctctaaaggaaattctcactgatactttttctcctccccacgtcatcatagagacatggcatggcctttgttctaaggaacttcaagtctaataggggataatgaatgttccatgtagagcagatacaaaacagtggactgagtccataatgctgtgttggagtacagacaaatgcgcggtgaaatcttgctgaaagactgcatggaggaggaggcatctgaattgagtcttaaggggttcatgtcacacaggtgaagcacactgacttcacgtgtttgaagagttgtctgggagataggttaccaatttagtttctacagtatcagagatagaaaaattcatccatcccttctaccatccttctgtccatccatctgttcatccacccatccacccaaccacccatccatctaattatccagtcatctaactatccatccagccagccagccagacagctagccagccagcctttctaaaaatacttatttaacacctgtgtgtgccatggagtaagccaaatgacagggagagaaaggtaaatgaggccatctccaaaggagttcagagaaaggtggtagataggtatgttagacaattcatttataagctgaatagttaagtgcaattttgagtatttgtgagaacgatgagagggaacagttaatactattggaaactgctcttggaggagtcaagcctgaatgatcagaaagacactaaaagatgtaaagcaggtaaaaaggaagaaagatcagggctgattttggagagcacggagtaaagtttcataaaccaggtaagagcttaggagatgacagacatgtggtggtataagagatgaaggaggggcggggcgcggtggctcacggctataatccccgcattttgggacgccaaggcaggcagatcacgacttcagaagatcgagaccatcctggctaacacggtgaaaccccgtctctactaaaaatacaaaaaaattagctgggcacagtggcgggcgccagtagtcccagctactctgaaggctgaggcaggagaatggcatcaacccgggaggcggagcttgcagtgagccgagatagcaccactgcactccagcccgggcgacagagcaagactctgtctcgttaaaataaataaataaataaaaataaaaataaaaaaaatcatcaggagatgaggagatggactgggaaataagacagaggcccaaacactaagaccaccatgacctactggactgcatcctttagaagccctaaggggatcctaaagtttagaattctaaataaacattttattttagaatacttttacatttacagaaaagttgtaaagacagtccagagagttcccatctacccagcgtctagtttgccctcttgttaacattttttttttttttctttcctgagattgagcctcgctggatcagccaggctggagtgcagtggtgtgatctctgctcactgcaacctctgcctcccagactcaagtgattctctagcctcagcctcctgggtagatgggattacagacatgcaccaccacactgggctaatttttgtatttttagtagagatggggtttcaccgtgttggtgaggccggtcttgaactgttgaccttcagtgatccgcctgccttggcctcccaaagtgctgtcttgttcacattttgcatttatcatattttacatatggtacgtttatcacaactaatgaaccaatattgatacattattgttaactaatgtctacattttattcagatttccttagtttttacctcgttcttttctgttccaggatgtcacattacaattaattgccatgtcttcttctccccttctggtctgtgactgtttcttagactctgcttgtatttaacgaccttgtcttttttggagtactaagcaggtgttttgtagtgtgtccctccactgaggagtttgtctgatggtgagactggagttatgggttacggagaggaagaccacagagacagcgtgccatttgtatcacaccatgtcagtggtacatattatgaaaatgacttatcgctgttgatgttcaccttggtcatctggctgaggcagtgcctgtctcatttttcctctctttgcatactgtgctctttggaaggaaatcactatgagcagttgacacttacgggtgaggtgtttgttaggcttcacctccttgaagcagcagcatctacatccatgaggcttttcagcaggacctgggtaaaggaccatcaggtggaaaatgcaagatgaactattgcaagccacattgaaggagaatttggctcactaccaggaacattgcctgcccccgaagctatttagctgtaggttttggccttcaggtgggcttagttgcagggctaaataattttctttaaagagcttcatcatccaggcaaacatcacagccacagtgccagatcctgtgtcaaagaaattaaaggctcattcctccatgcactaagttgtgtcataactgtaggagttggcctgctggggtatgtgtgtgtgtgttttcccatggaaatgaccaaagcaggcagcacttgttgaagtacgtcaacattactgcagcacgtcattccttttatgacatagcgacctcttttcttttctctgcgctgtgatcttcagttaatttttagggagggtggggcatgaaagctccctgaacatcgtgagaatttctttccacagatgcaaacaactctgttatggagagtgtaactcaagatagcctttttggaggacagattggaagtacatttccagttctcacattcctctcttttgaccgaggaatttatattttttcagtagaagtcattctattcttattgtttttgtttttatttttctatttgacaatgaatcgtgagcatctttcctatgggtggatgtttatgttatttccggttggttttcccatcctctttcattgtatgccaaattactgtggtaggcaaacttggacaaacgtgtttgaacacatatagtgcgtgtcatatattttgtaataactggaatttcctgttcaaaggttggggatgtgtgaaatttggacagtgtccatcagatcactgtcaaacacaggtggagacatgtgtcttcacaacccagtgcaacagcatggcgttatgcctcatccatccaacaactctagggggcaggcataagtagtcccattttaaagatgcataaactgaggctccatgaggttaaaggattggcgctgggttaactctttctttgctatcaggcatttgcggaggatcactcaggaacctttgaggatgagatgtcctgagctccagctcctggtgtctgacctcccatctcagtgaaatagctagaaaattatttggtctccttgctgagattttcttaacatattttaaaatctcagcctggtgcagtggctcatacctgcaatcccagcactttgggagaccaaggcaggcggatcatcctaagttaggagtttgagaccagcctggcaaatatggcgaagccccatcactactaaaaatacaaaaaaataaataaataaataaaaatagctggtcatggtgatacgcgcctgtaatccgagctactcaggaagctgaggtaggagaatctcttaaacccaggaggtggagattgcagtaagccaagatcacaccactgcactccagcctgggtgacagagcgagactctgtctcaaaaaatctcctgacaccagaaagccacagagcagaagcatcacagggctctctgatttgccataggatcgtttaatctgttttatgatactgtgctagtagaattttccaagttcacaatcacaaacaaacatactatcctcaactgtgctagaattaaattatctttgccccccccccctttctgttatattaaattagtatccttcttctccaaacaggcagctcccactttgagggtgggggaggagtacttgtccatcaaacatggggaaaatgactcctacttccatcgcacagtgaatcataggctctcccatgtcagattctgtggaaaggatgttaatagagacaaaaggacactgttggcgcgttattaatgttaaaaattgttgacgttccatgcagtgtgtttttctaattagagccaagctgcagagtaccatttccataatcaacatgggaacggaaactcagcaaaatttcatgtatttgcaatgaaactgctccccggcaacataaaaatggcttttataacataaaggctgtaattagaataagtcaaatcagttggaaacgattaaggccggagtaggcaaagctgccttctaaatatttgtctggagattagcctactcctgcagctctgagaagcatctttgatttacttatactgctcgacgtggcaaagataatcttgtggaaggcaaacgaatacagatttagatgtgctggtcggccccttctgcaacttgacaggaggcagtccattggaagcaaagtcagaaaaaaaaaatgaatatagggtcatattagacaaattgcttaaaaaaaaaaaaagcacaccgcgatcatcaatttaaattcttttaaaatgtgctaggtctttgaagcttttaggatgcactttagaagtccacgtggaataatccctgcatgtcagtgcgacagttgatgtgcgtctcattgtatttaaaattatagttctgagatgggacttgctccgcgatgcttgtctgacatcagctattaaaatacaagtaaatcttggcaggtgggaatttaaaaaagaaaagattatataagaaaaatcagaatggttaatgttaatttactaaccagggtacagtggctacagagagttcttcatgtcctctctctattaagatgctgatgcgagaaacaccttatgtttgccagggatggggatggagattgtaaagtggatgtgagggggtaaagagtgctactttggatgtcagtccatggtttgggtcctctggggccacggtgagcatgatggtgagacaggttcattttattaaattcagattagccgttttgccctgtcctgggagggcagaagaaggtaatcaaggagagatggcgggacaataactgctctggggatcagactggaacatccacggactccagccttcctttagaagggcgtaattcgtcctcacagactcctcactcatttgtaaacctctctgaatcccaaacttgtgtgcgtgtctgcatttagccattgaaaatataatcaggctaatgcattctcttactgaattttaaaccagcccattaaaactcctttaacgtgctaaagtcggcttcagagagggtttccatttcatctttattgagctgaggctatggttcattctccctttgcaccacagtgagcgcctgtcaataattcaatagcgtagccttgatgggcccaggcccaacctagactttcaaccacgccaagcagcttgtcaaagcctgatgctctgtcaatggctgagtgatctatactgcatgaatcccccccttcagctcttgatgtgtccctgggaataaaaagaaagccatttcagaagtcagcccagtgagaagcacctgtatgtagagaatctttaatgagggcaggtcgcgctgtggtggagcagagttcagcggaaaccaccgcactttgttttgttgagccaacgcagagtctctctgtgcactctcagtgtgcacagaggagcatggtcctcgcgctggcaaatggatgcccttgtccttctgcttaagtcttctttacgcaggccttcgcgctgtgtcgtcttcaccattgcaggaggccttgaactcagaaaatccagtgcaaggagcaaaacatctgaatcatatgatcatgccccagtggctcttcttcaggtgccagtgacggtgatttgaaccttcatgtccctcttttcatggaacgtcatgagtctgtactggctaaagagtgctgtgaaaggcagattaaaaaaaaaaaaaaatccagcctcacctttctttctgggtggaggaaaaggcatccattcactttaagaagaaaacaaatcatttgtattcttcttgtctggacacaatttttaacccagaattatccacctagttcctcccatctccaggccttgtaagtcgataggagatttgcaaatatctcccttaaagaaaggcaacgaggagagcatttaatccatgctttaaatgcaaaatgtcttgagtcccaacgctgctcagtttttcctgaagataaattttagctggattaaataactgttttaaaggcactattcatgcaagtgctgtctcatttgtgactgtatctgcattgctaatggatgtgtcttttcctcatgcatattctttcctgagcatctaccgccaaatttacagattgcttgcttgtcaaattgggatggggtttgaggaagaggtgacaatgatctaggtggaaaagagaagtgccagtgtgttcaaagctaatagaaaattgttgctttgtattagcagtcaaggctccaggtttcctgaaccacaaaacaaccaaatcttttctttcttttttttttttttttttttgagacagggtctcattctgtcactcaggctgcagtgcagtggtgagatcacagctcacagcagcctccatctcccgggttcaggtgatcctcccacctcagcccctcaagttgctggggttttgccgtgtcgcctaggctggtctcgaactcctgggctcaagagacctgcctgcctcagcctcccaaactgctaggattacagatgtgagacactgtgtctggccccaaatgttttatggtaacataaattcatgccactgtggcctgctggtcttcccaattaaacagcagagagtttgttatcccagccacagcatattagggtggagccaggtaggtatgtgaactaacactgtgaaaaaacaagattgtttttaaggtaagctttcgaggagggggaaaggaggtagaaaatgaatatggtgatttcagagaagaaaatctctcccaagcctatgtccctttgtatgtccacaaccccagttaatgatgggtatggcttatgaaggcactgagagcccaaggaatgtggccagcattaggcggcatttgagctgggtcagtgaatcctcaggcgtataggcaattaggacttagagatcctgttgtgattttcatacttttaatctggagagttgcttaatgaatttattaattcatttatttttagcctcacaggttttgctccaagactcaggtgaatgagtaacacagtactgataaagttgagcttttctgtttagggctggggaggagggaagaaggaaaggaaatgaaacccagggctttgcatcttcctcttcaacttcatcccttcctctctattcctcacatttagcagccctcaagggggctacaaggaatttttcagggtccagcgtggcctaatatgccaacttctgatatagtacagctcaattagcctggcatggttgtgcacaaatgtagtcctagctgctttggaggcagaggtgagaggatcagttaagcccgcccagagtttgacgttgcgctgagctaggatcatgccactgtgcttcagcatgggtgacagaggacccatttcttaaaaaccaaagaaaaaaaaaagacagctgttattttcctaagatatcctctttaaagagaaatggaacaagtgacctgccttcctctatatgaggtggggctcacaccagggttctcctgctcaccattggcccaggaaactcaggaaattaatgctgcatgcgcatgacttggcgattcgacctctgaaagctctgcaaggctaggaatttatgctttaagaacaatcagcatcaaaggccttggcagtggtggagctgttagcatattagttccatttgagatggtgaaatgccttggaaactaaaaaccctacctaataaagtttattttcaaaggattagaggtagagttttgctctgagagatgatgttgcctaagcctcccattacagaagagcagagatgggactctagggattcatggatgtgccagcgtcactgggtagtggtaaaaactaaaactggtatctgtttctctcctactataatatctttttcacgtcagggcttgtaaacctgaaatctacactttagtttcacccatatgatttgtttttgcttttttcccccctgttattagctgccaacatttagatatgtaaagattacatttaaaatcgaaatttttggcttcttgcaaaaaaatcagacgatctggcatattgagcaacatccgcacacttcacccaccagctggagctctgtagcacctgcacacctcagtgtggagatgagctttccactcccaggtcaacacagaccctcttactcaggactcaccttcgcccagcctgcttcacgatccactggctgtcacaggcatttgcctccgtagtgctctcctcccacccttccacaaataaacgtgcccagagatgctggcagcctggaagctttgcatctgcattggggctgcccgttctttgctgccatgcctgaagatttcagtagctctttgtcagcacaaatgagcttttcccctagttcatggggagaatgggatcctggcacatagcagaaaacatctggtaatgaatccattaggcaggctgttgctcagcctccaggtgcccaggggtctgagtgctgggctgaacatgatgcatgaacgggaccccagagattttaccttttggccttcgttctgccagagctccggcttggtcctaaggggtctcctgactactccaatgccaggtgttctccccagccatccccaagcgagaagctggccagccttctggattccctcctctgccttctccagcagcagtccgtctcccagcacagccttccttaggcacacaaaggagaagacagagatcatttttggcagacgtaaggagcagcatttgtcgaactctgggccctgcaactctgtgaacagacctgcatgctgtacaaaattattagaagccctgtgtctcagggctcaaggaggttgggcagggaggtgagagtgaataaaaatgaggaggccgcaaactgcttttgcccaagggctggttttaatgagcttgtccctaatgagttgtccctgcaactagcttcaggcctaaacagatgaggcagggattctgctaaatttttgataggatttgcactggttttatgagaaagcaagcagtagagagtgcaaagttgggtcatgaatcttttacgagggtggatggttgtccgtcttgtcaaccggaacgagaaagacctggttgctaatagaaaccatggcctcagacgtcgatcgtcacccaccagatcagctaatttggtcagggtggctgggtgatttgttttttttctgattcaggacctggcctatggcccctgagaaggatttatctgaaaactccatcaaggagatgatttgagccattgcctgttcctgactaatgatcttttgtggaactcaagccatattggggatttatacctttctcccatagtgcactgggaaggaaacaccatcaaacactttaattaacatcctttttactttgggcagccccattcgtatcaaaaccacaaaccttacccttcagttgcacgagaacactcttaccaaggataaaatgtgattttcgattcctatggagatgtttctaatgtttctaacacccgtcaattctaggatcgcgtggtacaggagatttcatgtactaccaccttttttttaaatattaaaagctgccaacaaatgcatttctccagtttgattcatataccaaaaggcaattttcttggtggcttagaaggttacagaaaatgcttgatcagcagcctttactgtgctgagtgaattcctaccccatccccctcctgtctcacacactctctttcacattaatcatgtaattgatttaataagctctggcttcaagagctccccctcccctctttctttgccccctccccctctcttataagatttcagttcagcgtttgactggtaggctaagaaccttgaatcctgccagatatgaacccaacaaccttgttggtgtaataagtatcctcatcttatatttctgtggctccttgaaacataatttttaagccatttcattaatagagttcaatgtaataatgtaaaaaagtgcagcgtatttctatatatgtctgtagatgtagacttctgtatatatctacttttcacaaacttgaaatcatttcacatgtgttgtcttattcaaacctctctaaaccgaaaactttgagagttgcccagaagagatccgttgctcctattttatacattacaaaaccgaagtacagacagatgaactattttaagaccttgaggctaattagggatgcacgtggcgtgaaaattttgggcgtctgaacttcctacaatagggcactactgattctgtattcctttgttgcctgaggcattcctttctctgggagaaaccaaagctgtacatatttatcttcaagagaaacttccactttgcctatgaagaaatagttagaattgttttctgtggttgcctcaagttagaggtgctaatatacatggaagttaaacaagaccacacatgtgcaaaactcttgatgaatcacgttattatactaaaccaacgttatactaaaccaacattagctagggttattagttcagattatagttatgcaggtcttccgtgttaagtctcatgtaaatatcttctggagcttacatgtgtagttatctatgttctaacctgtttcctaatgggtcatccagaaaacgtgggtgtggtctggctggaacagagtccctaggattgtgtcagagtcattgtcgtaagatatacctattcagaagttagttatctagatgttagagtctagagatggggcttcaatgagggatgtcaatggcagtatggggaaaagagaacagagttgaagactgaacagcctagggggagagcagaaagcaaaggcagctttataaataataaagatgttctgcaaaaattcctctgactgggttctgattggcttgggtagcctttttttttgagacagggttttgctgtgtctcccaagctagactgcagtggcatgatcctagctcactgcagcctcaacctcccaggctcaagtgatccttctacctttgtctcccaagtagctgtaccataggtgcacaccaccacacctggctaatttttacattatttgtagaggtgagggctccctacgttgcccaggctggtcctgaacccctgggctcaagtgatcctcccacctcagccttccaaagtgttggggttacaggcataagccaccgtgccccactgacattttactcttaatcctggcctgtatttaaagggtctgggtgaatgcagatagatagacagttactacgcgtaacagcttaccatgaattctaagtctcaacaaatccgtaatcatggtgtgtcatatgaagaacatgttctaactcttattgctgagcctgactttgaagtgtttgtttttttttttcttctttttttcttttgggaataagaaaaagcaacgttcttgactgcccggaaaaatactgtcttgtcagctggggatgcttggtgctgatgaggaatgtggtacagggtggggatagtcccttttaaagggctcagcatgtgcctgggcagttagcaaggattaaacaaaggaaagttggtaatattactgctagtatgagtatgagtaaaatgaacagtggaaagaaattaataataggaaattagtgatactatgtgtttaatatgcatagagcctctgtaatcttagcttctgaacaatagcactccccgctactcctctcttaatctggaggcccatgggtctccagtacccttatgcaccagctccatttgaggaaatgaaagtaggaatcacaatatttgccctggatctgcataactaggacaagcttttgaaagtggaagaggcccataaatgaacttctcaaaatgcacttgatacagcatcaaataggagtgacaggtccataaatcaagggattggggtcatttgattcaaatgtaaattgtcccctgcccagaaaactcattgccatgaaaccctgcacagaatccagagaacattttcttctggtctcttagaaattcaaaatacaagatctacatggtaccacagtttttgttgctgttactgttgttgttgtgtggtttttgttgttgttgtttttgttttgtcttttcacgcgggtgacgtttggagatgcccaaagactgatatcccaaaagtacctaatctacaacaacaaatatttatagaacctttatctcaatatttgctcattgaagtgggttaataaatgtctgttgaatgctctcaattggatggtgagtattttccattttagtttagctgtgaagcttcgctttccctcctatgccttttgttttcttgcctaaagaagcccatttcaagagtcggggatcttctctttctaatctcagcctgcccaacaatttgtagcatggtcttgctacagccgctttgctcccctgctactccatcttgtctgagatctgggttaactgggacttaactccttgtcaaagatgctgtgtgaaatgactaattaacaccagagaaggaaagagcattgtcattgacaaatagggcttttaataaccagcagttctcctggttattaaagttggctcttgagtctccccagacccatgcgaattgacaggaaggaggatattttagttccttctatgattgagttgcttgtcacttgagtttgtaatctcaggagtcactttatccatgttgtcccaggaatgaaaatggtgtgaatctaatttcagaagttgaggagaagtagaacaaggaggccatgattttctagtataactagacaattattttcagcaagttctccctcactgttgtggggtgagtgctcacatttgcctgccgctgagctatgttttaatgaggttggaagaagcaagaaggttgggaagattgatgttaattgcatttctaccatacactaagcagtgagcagatttaggatgactagtgtcctatagttctctttcaagatcagatcaagcttcctgaaccacatgagcctgtcttctctttacaccagcagcctcagtaactccctgttgggcaaccccatagagcaaacaccagaaaccccagaatttttctcttactaaagaagaccctccactgtcaacttaagctcacgttttcctatttctcaagccaaggtaggtctaggtattttttttttttttttttttttttttttttttgagacagtgtctcactctgtcacccaggctgcagtgcaggagtgtgatctcggctcactgcaaactccacctcctgggttcacagcattctcctgtctcagcctcccaagtagctgggactacaggtgcccgccaccacacctggctaatattttgtatttttagtagagaatgggtttcaccatgttagccaggatggtcttgatctcatgaccttgtgatctacccgccttagcctcccaaagtgctgggattacaggcgtgagccactgtcctcggcctcaaggtaggtctgggttttatgagatgtgacacttacagaatttgggagccctccgtaagaaaaacattcacactttgggaggccaaggctggcagattaattgaggtcaggagttcgagaccagcctggccaacatggggaaacccccatctctactaaaaatacaaaaattagccagctgtggtggcacacacctgttatcctagctacttgggaggctgaggcagaagaattgcttgagcctgggagacggaggttgcagtgagctgagatcatgccactgcactccaggctggccaaccgagtgagtctatctcaaaaaaaaaaaaaaaaaaaagagagattccaatgagattcaaaattactagtgcagagttgcagagttaggggtagcataaaaacacattgcctgaagtgatggtctctgaagcctaagcccagtcaccttctcattatccatttctgttcccagttgaaactttgcagtaataaagctgattttataaagtggtcaagagctgtatcccaaacttttccttgcatcttcagctcttcctgtctatgaacctctgcctctgttggcctagtctctcactatcctcttcttttattaagcaattaagtattgattaaaagccaagtctagtgagagctaaatgcatttgttgaaggttataggtcttgttatgggaaagcaggagtggaatgtagttgaattaacctagcctagaacagatttttctgtgtgttctatgaattagctgtatcagcatcaaccccctggaggggaggggccaacaggcatctgcgttaaatatgtacattcctaggtcccttccaaagtactgaatcaggatctctggggttgggatgtagggatttccactctttagaaacacccaccctcctttcttctgaagcatgtgaaagttgtaaaacaactgactaatctaagggccactgaaagctactcttaagatgcagcatttacttgagactcaaaggatgaatggcagctgccaagtgtattaatttcctaccccttccatagcaaattactgcaaacagagcggcttaaaataacagaaacttattctcttagttctggaagttggaagtcgtaaatcaaggtgtaggcaaggtggattccttctgagaactctaaggaaggatgtattagttgattctgatgctgctaataaagacatacctgaaactggaaaatttacaaagaaaaagaggttcagtggcctcacagttccacattgctggggagacctcacaatcatggtggaaggcaaaggaggtgcaaagacacgttttacatggcggcaggcaagagagtgtatgcagggcagcttcccttaataaaaccatcagctctcataagactaactgactatggtgagaacagcatggggaagacccacctctatgattcagttacctccaaccgggtccctcccatgacacatgggaattatgggagctacaatttaagacgagatttggctgggggcacagcataactgtagcaaaggatttgttctttgtttctctcctggctcctggtggctccccagcaatcctgggtgatccttagcttgtggctgcattactccaatctctgcctgcattgtcacacatacattttccttctatgtttgtctgtcttcacctaatcttcttgtaagggcaccagccattggatttagggcccactttaatccggtataatctcatcttaactaaatacatctgcaacaaataaggtcatattccagtgttcttggtagacatttttctttcccctgtttttttttttttttttttgagatggagttttgctcttgttgcccaggctggagtgcaatggcgcgatatcggctcaccacaacctccacctcccgggttcaaacgatttttctgcgtcagtctccggagtagctgggattacaggcatgcaccagcatgcccggctaactttgtatttttagtagagacggggtttctccatgttggtcaggctggtctcgaactcccgacttcaggtgatccacctgccctagcctcccaaagtgctgggattacaggcgtgagccaccatgcccagcctgacatttttcaaataaggtcatattctaaagttctaggtggacatttttaaaataatgtctcattacaaagtcctaggtggacatcttttttggcagggggacactcttcaacccaccatgccaagtgaaagtagtcagtgggggagaatggcagtgaaaatagatggatgaattcagaatgaatagaaaacttgaagaggtttggcaggagtgagccctgcttagttatcatccaggtttcactaacgcgccccttgccaacatgcagtagctctgagtcatgatctatcatattgccctgttttgtaattttgcattgtttgtttacttgtttaggaccatctctttaacctcgttagacttgaaatctctactcaattcaagcctgcacatccccagtgcctgaaaccatggctgttacatagtaggtcttggtgataatttgtcagttggataattttagctggagaaaaagaaacatgtatgtgtgtgtgtgtgtggggggggggggttgttttgttttgtttttgtttttgtttttttcacccatcctgcagaaaacactgcttctgtgacataaagagaacaccttcacagggtaaagtgttcttcccatgaggtctaagaggagtctcaaatgcgaggggcttgaagacatttgtgaagggacactatgaaacatatgagagcagtgagaagtggagagttgtctctctgactgcagtagaaggatggcgaaacatcagggagggagaagggcactccgggccagtattcaggaggagagccttgtggcagcttttctgggtgtggatttcagagcctgtcatcatagaaagaaaagaaggaactcaatctaaagtataaataaaaggagagacttggccgaatgcggtggctcatgcctgtaattccagcacttcgggagatggaggtgggtggatcacaaggtcaggggatcgagatcatcctggccaatgtggtgaaaccccatctgtaataaaaatacaaaaattagctgggcatggtgacatacgcctgtaatcccagctacttgggaggctgaggcaggagaattgcctgaaccagggagtcggaggttgcagtgagccgcaatcgcgccattgcactccagcctggcgacagagcaagactctgtctcaaaaaaaaaaaaaaaaaaaaaaggagaaacttacagaaagcaagttcaaaaaggagggactgtggatgataaattctataccactgtgaatgttaactcgtaaggatttgaagataacggcccccgactcccacttaggttacagatgaagatactatggcccagggatgctgcgtgagtgtcttaaggaggaaaagagcgttaatgtgacatctgggattccaggctcctttccagacctctcccctttttcacttttccgcctgatttaaagtgaaaagaagggtgttggcatctattaatcacctactgggcgccaggcatggatgctaatggttaggtcttcaggttgctgagtgggtgttgaggaggaggaaccagtgaccccagtagacattgaagaggctcaatgacagcaggaggattcaggggtctggtggggtggatggcatgcgacgggcccagcatcagcagtgagagggtaggagaatggtgagtttcagggcatgcatccacagcgtaggttggtaactaaaaggccagcccaggaagaggcctctgcacatgaaacatagaagtggctgcctccttcaatcactgttctgattagataagacctgggcttcgcttctgagtggtaaactcagaggcagctgggagtccctgagtgacaaggaggagactggcatgccaggtagggcaggctgagggttaaggctctggagggagaagaatcgtactcagaaaacatccagctttctgggggatgaggttgtgcagtctgggtgagggacatcggatttctatggaggctttttggatgggacctgatataatcatataatattgaattcagttctatgagcttttgctatgtacttattctgtgcaaattctgcaagggatgtcttgaacggatggttctttcttgcattgaatgcaaatagtaatttattttgattgagatagttttggaaatttcggagcagtgaaatccaagtatttcaacctggcaggttgaggcaataggtaagttaacttgggcgggctcacttttctatacattttgtgctcgggaccgtaatgcaagcccactgcaaatggcaacttcatgtatcaacttataagcagtggtggaggagatctcaaccctacactcattgctccctctggctcttagagactggcttctaaattcctggtgagttgcaaatattcttagattggactatgctaacattttgaaattaaacctacctgtctttaaatgagttgttggctgcccctccccccgccccgtattctctttgtgaagtagaggcttccagcacttttctgaaggagaaaacatttatttctcattttgtagaggcaagaccaaatttgtgtcagcttcagctgagaccactggccagccctccttctcacctcccagttccctaatctaatttatctcagtggggtttgtgggggttcatttaagcagcagaagctctgctataattgttgcatgtgccagcaacgatttgtaccatctgggtatggaatgaggtggggtaaggtggtttggaaagagaaaggaacagagagagacaaagagactagtacgaccaaagagaaagattcttattccatgaccaaagcaatatcattcaaaaatggctacaaagcaattggatactaaggaatgagaagcaatgtagttagagtaaaatgtcaaagtataatgaaacagaggaacatcactactttatgatccagccaagttacaggcaggtggcagctgtaaatacgcatataaataacaatatggatgaaatgtcagacctttcagctggcttggttaaagcactttagtaatagtctatttagggtaacaatgtagcttgacaatttccatgaaaaatacatcattggagaatgagtcagcccgcgttagcgtgtaggtgatgtgcattgtgctaagagcttagaacaacacacggtgcctggtgcatcccccacctgcctagaatggccagttgcttcatattccatgaggttacgttggttttctggcattgggttgcaaatgcttgtctttcccattacagaaagtaccttttctctcttatcagtaacacaggaaaataaataaatgatcaatgcctcagatccggggtcttacctgtggaaaggtgtggattgatatctttatttattcatgcatgaaatgtatcaggcacttgctgtggtgccaaggatctaaaaaagtgaacaaaaagatgtataggctcagacttcatgaattttaggctacactgcttaaaacctttaatgattccctattcttaggataaagtcataactcctgatcatggctgccaagaccatgtagattacttagagtctggtgaaagaagaaataactgaataaaatggtcacaaaaggtaaatgtaaaattgcagtagtgaggccaggcacagtggctcatgcccagaatcccagcattttgggaggtcgtggtgggtggatcacttgaggccaggagttagagaacagcctggccaacatggtgaaaaaccatctccactaaaaatacaaaaattagcagggcatggtggtgcatgcctgtaattgcagctactaggggggctgaggcaggagaatctcttgaacccgggaggtggaggttgcagtgagctgagatcgcaccactgcactccaggctggatgacagagagaggctttgtctcaaaaaaaaaaaaaaaaaaaattgcaatcatgatacatgctacattgtttggtagccaggatggcttcctgaaggaacaggtgctagacttgtgatcgaaggggtaggaggttaaacagagaggtatgagagtagcattccaggctgtgggattggcatgtatgaagatcctgtggtaggaaggacattagtgagtatgaggaatggaagagatcattgtcctcatagttgagctagggaggtggagagtggcccaagtcaggtggggataagtaggcaggagcctacatggtcttgccggccatgatcgggagttatgactttatcctaagaatagggattcattaaaggttttaagcattgtagccttaaaaggacgagcaggggctggtcctttagaaggcattgtgttcatagtgtatgacagtaagccaggagctctgagaaaacaaatggcactttgatgagcaggcactgtatatagtttcatacacatgttaaagcgtgtatagaggatgtgtaaaacatccacttcatgccaagcactggtcaaggtactgagggtgcctgagtgtaagacagcatccttgcctctgagcaatgcacagactaaggagatggaagtcatagaaaccactgactgaagtgttgggcaccctgatgagattatgaagcacggaggagcaccttcagccttaagatggcattcctagagttcatgtcctctaaacagagtcttcaccaaaggctagaagttgtcctcgcaaagaaggagtggaggaagtgttggtcttctggtagggggattaagaaagccatagccagctgggcacaatggctcatgcctgaaatctcagcagtttgggaggccaagacgggtggattgcctgaggtcaggagttccagaccagcctcaccaacatggtgaaaccccgtctctactaaaaatacaaaaattagctgagtgtggtggcccatgcctgtaatcccagctactcaggaggctaaggcaggagaatcgcttgaactcaggaggctgaggtcccagtgagccgaaatcatgccacggcactccagcctgggcaggagggcgagactccgtcccccaccaacccccccaaaaaaagtcatagccaatgtcttcccaggaagtcaaggaagcaaggaagatgcccaggatcggtagacagaatgctggtgaagtagatgggggtgggccctcttgaccagtgtcttgccagattttcttaaaactgtaccatatcaaaggcagattgtctcccaagttatcaagtcaaactcgtgttctagccctgcagctcaccctgttttccatcatatgtgtgttataggctattatagatatgatcaagttgagtttataaggtccagaattcccatgcatgtgagaaagtgtaaactgaagccacctgttgggttatgtcccctaccttggtgcatgaaggaaaactacacaaagatgtgtggtatcaactcatggagacaagactctatctacaggatagcaaacatttggatagaacttgagaaggaatatggtggaggaatgagtttttatctaagccaagatccaaccatctctcgatgtatacattttctaccatgaacatgtgcaattgcccatctgtgttttctttcccttttgagattcctcttgaccttctgggtcctggggaagtcctcaggacaaggatggacctaggcgagttacatcaggtaccacagtgttaaagagtgattatcacagtttgctcctcacactttatatttggccagccctgggccaaccccttttcccagccctgggccatacccttttccaataataaagcccattttttatgattttgctcatgggttcatttattgatttgttcaaacacaatagggcactacctatgtgtcaggtaccatgctaggcacaacggattcgatagcaaaccagaccattgtattttctgccatcttgaagcctcagattgcatctggaatgaatattattagaagcagctagattttgattggaaattctctcttctgaatcctttagcctaccaaatgctttggttctagctaaataagtggtggttttatttcctttgtaatacctgaatatgtattccttggatacatcaccctccctatattgagaagtttcacgtttcagcagcctcattctttctcatccttgtggaatgcatgtgcatgtatgtctctgtgcacatgcatgataggtttctatccagccttactctccatgcaagaatataacagctcccagagttgtttgcaagaaaatattaaatatttacatagatatggacattttgtggggataatataagaaatcttattcacacttggccgggcaccgtggctcatgcctgtaatcctagcacattgagaggccgaggagggcagatttctttagttcaagagttcgagaccagcctaggcaacgtggtgaaatcccatctctactgaaatacaaaaaaaaaaattagccaggcgtggttgtagtcccagctactcaggaggctgaggtgggagaattgcttgacctcaggaggtagaggttgcaatgagccgagattgtgccattgcactccagcctgggaacagaatgagactccatctcaaaaaaaaaaaaaaaagaaaaaaaagaaaaaaaaaactgattcacatttcaatcaatgatagtcactgacattgaaacttactatgagccactgtgatgtctaagattcattctctgtttttattcttacagcacccctattaggtaaatattattaatgtcccctgtttggaaatgtcaagttcaatcccttttattaagggcagggccagctttaagggcacattccctgcatggtcatgcagggccccaggctttgaagagccccgcatgtggtcttatgctatagctggaattcttaatgatttttgaacaagcgttcctacattgcccttttgcactgcccccagaaattatgtggccaatcctgattaaggggcagggcagggctctgtggagggttgatgtacccacagcatccatccctttaacagttcctccacgttaggaccctcctctcaacattgcctatcctagagggacccccccttatacaaatacagaaggtacctggttcattcttcaagctgtgtgtggattctcattgtgaagtgaatcaccttttaatgtatagtcacccaagtacatctgctatgttgatatatcacttgttttatgggccgggattaattccaaagtaaacactaagtactcagctgaaaagctgtaaacacaagacaggacgtgcctctccaactcccagcattgtttgccaaggttgcaagtccctctatgctttatcctgtttggcgtaacaaaatcttcgtgtaatttggtctcagcagtcatttcaaattgattttaagagttgcaggcaagggggtattgtggttgggagaacacaccttcacgtgcattttgcctccctttcttgcctcagcatcacccaacggtcttcctgggatgttcaccttcctgagcttgatgggtgcccgtagaatcgccacctatggctgtgctctgtgcaagcaggcctgcagtggtagcaattgcaggaggcagtctactccaagccttctattcaagccctgagccctggagcagggctgtatcagcttggaggaaagggcatattttgggtattcttccactcggaaggtgtactttttttctttttttttttgaaacggagtttcgctcttgttgcccaggctgagtgcaatggcgcgatcccggctcactgcaacctctgcctcctggatccaagcaattctgcctcagcctcccaagtagctgggattgcaggcacgcaccaccacgcccggctaattttgtatttttagtagagacggggtttctccgtgttggtcaggctggtctcgaactcctgacctcaggagatccgcctgcctcagcctcccaaagtgctaggattacaggtgtgagccaccgcgcctggccttgggtatgcatttttatcactcatacagcgggtccatgaatgcaagcagtggctccagatatccaggaggtcacacagttgactgttgtgtcatggaatagcaaacactatcttccgatctgtgtcctgggtgctgggcctcctgacattggtgacccagttctgaattccagaatgacagttttaacattagattttgttagtttgtccatcttatttttatggcattagtgttgcgtggattgaaaatcacacgtacacggacacatctatttacgtataaatatgccttgccttgcattcttctatcttctttacttaagtggtgagatgtttgggtttcttcatgcagtgactttggggaagtccctggagctctttgatgctctgttccttcttcttcaagctgtatttgattgtgaatgttccttgtgaagtgttttaaatcacaggtatcaaatcccctttgcttggtttgagggatttgcctctgttgccctcatattttcagcctaagagggccctccccattcctcccagggacatctaaaaacgtttatcttcttgtgtgcagtctggaaggttcttcttacgagcatctagcctcacaccaagcagccaaagttgtcttaaaaaaaaaatagcatctttgatatgatccacttggccacagcagcttcatcaccccctccccaatactctaatgtccagttaacgtatattctcagtccctccaacaagcatgatctttgtgccccaggacatttgcacatgctgtttcctgaaaggctacattccacagttcctaccctggtgcctgcttggttggtatattcagccttgctcagcttggacatctcctctttaaggacatacttcctgattcaccttccaaatcagaacaaagcttcctgttctttgccgtattccagtaagttgccaactcactggacattttctcatggtgtgcaccacacgtctatactgccagagccatatgcattacaaagacagggaccttgtctctctggagccctaagtgtgtccttaaggtttgcaaaggaccagcgtctaatgaccatgtgaatgcaggaattatgtgattgtgtgtctctctgccttcccctaagtctgccgtgtccctgggccagtccactttgtgcccagatgctcactttcccatgctgtcctggagcatgtgctcctcaaatctctccttgttcatgttctgagaaagaaaatagctcatgctaagctttccaagtagacagaaaatgagccatgcctctctagctgctgttttttaaaattttattttactgttgcttattttttgtcattgttaaaggaaaaaaacattgacttctctgacctacttccctagcattctttccctttcctcttggcccctttgcaagcccttgaatatcataggaatatattccccttaaggtctttttgaccactatgtcttttgtctagaatgcaatttttttcaagttcttacctagttcactccctctcctccttctcagcttagctcattaccttttcagataagacctccttgactcctccattaaaatcagaccccctcttcactcccacacaccctgtgttcctttcctagctgacttttgccatattgcttatcaccatttgacatactatgtattttatgtttcatttgtgtctgtctttctgcactagcatgtaagctccaaccgggtagatattttagcatgttttgtttgttgctatatccttgcagtgcctttcacaaagtaggtactcattgaatatttgttgaatgattaaacctatgaatggatgggtgaatggatggatgaatgatggatggatggatgaatgcaatagatggatgggtgagtggatggatggatgatgggcagatgaatggatgtaacagttgggtgggtgagtggatggatgaatgacgggtagatgtatggactgaataggtgggtgggtggatggatgggcaaaagaaagaatttggccttgggttttaacatcagtagtaatctctactttctagacattgagttttaggatggataccaacaattattatgttttgagacacactttctggagaaagtccagagatccttttaactcacttggcatgggcaattgttaccttgcacttgccattttgtacaaaagtatgtttggttccgtgccttccttccttctctggcaaattgaaaattatgatggaaataagaatttccaaaaacctgtggaggtgaaagaagacataaaaacaaagccacagattattgtacatttcctgttgccagattaaagccttgcatccactgtgtggaacaatttaaaatttcatctgttaattggaaaagttacagatattgcagccattcaccttatattgcggggggacagttctagtttaaaatattctactatgctgtgtctgtaaatcacagaaattacctagaaattgcaccattttggcatttcaaaatattgcttgcacctggaaatagcaccagaaaatctttcccagatgcagtttgatttggaaaatataataaatgtagttttgggatttaacttttattctggtccatcttcttttagatgcttacgggccaccatacatacacatttattactacttttaccctacccacttggtaaaagttttgtattttatttttttaactgacaacttgttaaagacagaaattatgttttaatagtttattggttggatacttttagcaacaagtaattgaaaatggaaataaaattagtttaaacaagagaaacaggtatgatttcacaagaatgttagcaagaattcaagggatgaggcagacttagggttagataattcagttaattcatcaattcgaaaatatcattaaggtttcaggtttttgcaatatttctcctatgctagtctgattgtatttgcttatcctcttaggctgtcattcctcctgtttctattatagctgccattgctccagacatcatgtggaaactgcaacacccagaagaagaacaaaaaatatccctgtttaattttcctttttaggaaaatctccctagccagcccacgtatctcttccacagacttctggtatttcattggccagattatatgatttgccttaatcatttagcaaaatatatatatatatatatatgtgtgtgtgtgtgtgtgtgtgtgtgtgtatatacatatgtgtgtgtatatatgtatgtgtgtatatacatatctaatatatatctaattatgtatgccttatatataatatatacatatatatatctaatatacatatatattagaggggaacaacacacagtggggtctaccagagggtggaaggtaggaggatggaaaggatcaagaaaaaataactatgggtactaggcttaatatctgagtgatgaaataatctgcacaacaaaccaccatgacacacgtttacctgtgtaacaatcctgcacatgtacccttgaacttaaaaaattttaaacaatgagatatctaaatgaatgaatgaatagataaataaataaaagctattgtgttgaagaaaaagaaattattaggttcccaaaactgcatttccagcctccctcccaaaatttctgatttgatatgtcttgggcagagtctgatattctgcaagttttacaagttccctagtgatatgaaaatggctggttcttggaccacattttgagacccatcaacatggaataatcaagattgatctccttgacattgtggagaagctcgactcccttgaaggacaaggaagccatgtagtgagtgaggtctttaggtttctgttagccagataattatcttttgtttagttagctaagaataactgatacagctgacaacttatggcaataacattatatttcacgtggttgataagaattgactgaggatgaaaaaacaaaggcaaaacaatttttttttttttgagacagtctcaccctgtccccaggctggagtgcagtggcactatctcggctcactgcaacctccacctcccaggttcaagcgattctcctgcctcagcctcccaagtagctgggattacagatatgtgccaccacacccggctaatttttgtatttttagtgaagatggggtttcaccatgttggccaggatggtgtccatctgttgacctcgtgatccgctcaccttagcctcccaaagtgctgggattacaggcatgagtcactgtgcccggccaaagtaatttttaaataaaattttatagaataattgaggatgaatgtagaatttaagtctgagttgtggttaagtgtatttcagataccctccaagaacttagaattgacattcagctctacgcagtattccaggtcatttgtgtgtctgtttttgcatttccaaaagccgtacgttttcttggaattcataacaaccccattcactgggttgagcaaatattactggaagatgatatgataatccacatccagcaggagaaagctggggctcacagaggttaagagtttcccagccctcggaggtagtgagtgttggcattagagcttacagcagcatcctctcatatctcttagcgacttctgggatgtgagggggcacaggcattttgcagtgactgtgagagccctcagtatcagaccatccttggtacccactccagagagacttctaccctcccatttgttcttgtcttttaatttttcagcctcctgtgaggtgaacggatgtcaaggaggattaaagaatgaaacatgcttattttctctccttacgtgcctgaggacaggccagtgagctgtggggacaatagaactgtgaaaatcttctcctggggttcttttcttggtatttggcctgacataccagggaagctactacctctgtgaagttgtggagggctcctgcccagccttcggagggaaacagcgggtcacaaagagagttttccatatttacatgattgcatttgttgctgttttaatggctgctgtaacaaatcaccacaaatttaacagagtaaaagaaacacccggggtcaggagttcaaaactagcctggccaatatggtgaaacctcatctctactaaaaacacaaaaatttgcctggtatgatggtgggctcctttaatcccagctactcagggggctgaggagaatcacttaaacccaggaggcagagattgcagtgagccaagatcgtgccattgcacgccagcctgggcaacacagcaaaactctgtttcaaaacaaaaacaaaacaaacaaaaaaacccgccatgtattatctcacagctctgtgggttagaagtgtaacttcggcatgactcaactgggtcctctgtttagagattcacaagacggaaaggcagaagttagcagggctttgtttcttactaggggttgtgagaatgaatccacttccaagctcactcagctttgcctggttcagtccctggcagtggtgagactgaggccctcaaagctttgctggctgtcagcagggagatagccctggccttcagaagctgcccgtattccttctcctgctgtccagcgacagctactcgagtctctttttgctttgaatctctccatgtttctcttttgccacatcactctgactctagttggagaaagttgtccaccttgaaaggctcattccatgagactgggcccacccaggtagttcagctcttctcctgatctcaagatctgtaacttgaattacatctgcaaagtccttgtcttagcctgcttgggctgccataactaaatgccaaaaactggttggcttatcaacaacagaaattcattgctcacagttctagatgctggcaagtccaagatcagggtagagtgaatgtcaggtaagggcccactttttggcttatagaagattccctcttgctatgccctcagatggtagaagggacttgcaggctctctggagtgtcttttaaaagggcatgaatctagccaggcatgctggctcacccctgtaatcccagcactttgggaggccatggtgtgtggatcacttgaagtcaggagttcaagaccagcatgggcaacatggtgtaaccacatttctactaaaaatacaaaaattagctgggtgtgattgtgggtgcctgtaatctccgatactcgggaggctgacacaggataatcacttgaacccgggacgtaggggttgcagtgagccaagattgcgtcactgcgttgcagcctgggcgacagagtgagacttggtctcaaaaaaacaaaaaaaggtacaaatccccatcaacagagtcctacccttatgatgtaatcacctccttaaggccccgtcttctaataccatcaccttggtgttaagatttcaccatatgaattaggggtgagaggacttaaacattcaaaccatagcagtcacctttgccatgtaaggtaacatatttatagattccagagattagggcatgggaatatttggggggccgttctgcctactacaatgatctcatcacaatgataaatgttagcagacattgctctgataacgacaacagctgctattttttaaatgtcactctataccagccactgagatagatacttcaaattgattggatcatttaatccccatcacagaagagcaaagtagagactattattcatctcattttacatgtatattttttaaaaagccaagacattgaatgctttggtgtcttgccctgggtgactcagaaggaaagtgtgaagctgagaccctagccaggaggtctgactccaaagccttggctgctaatctttttgcataacccatgtcttccttgtatctatgccatctttatgatctgcttacttgtacattgccactcccttctggtgctcaatggctctgatttccttaagatagggttacattattcacccattacagaccactccaagacatgtgttttgctcaatgattgtgtgtgcacctgtgcacctatgcacatgtatataatggtggacagtttagccattggagctccccagtaggagccagtgacattagtcacatccagaaacacagtaaaatgatcaccatcgcaggtgaacgctgactcttttccaaaggaatatcgcagaagctggtaaaacagtcgcatccaagatcaaacaagacatcggccactggaggatggtggtcacttctgcaaaatggatcaggaggatttagaaagtcattatggcagaatgggatttggggttgccaaggcctattggacctcttttctagtaatttcacccctttcagggacatctacaagctattgttaaaaatccctgagtgtttggctctccatttcgtcttctgttaaatgaggcaatatctacaatgtcctctctaggcttttaattggatcccccctccccgcccgaaatacttcttgtattgtctgtcttttttttttttttttttttttttttgagacagagtcttgctctgtcgcccaggctggagtgcagtcgcgtgatctcggctcacttcaagctccgcctcccaggttcacgccattctcctgcctcagcctcccgagtagctgggactgcaggcgcccgccaccacgcctggctaatttttttgtatttttagtagagacggggtttcaccgtgttagccaggatggtctccatttcttgacctcgtgatcagtccacctcggcctcccaaagtgctgcgattacagggatgagccaccgagcccagctattgtctctcttctatcccttggaattgccttaagctagcatgttacctcttccagggcatggcacgcctcctgctgtctcttacccggtgtctgctaagctcatccttagaaccccaagttattttctacgtcaggggctttgcatattttactttttccacctagaatcctccttttgacattctttacaaacctagctcaatcttgtcagcaaactctcagctcacatgtcacttccttagaggatcctctgataagcccaattgaagtacacactcattacaacttgtaattaattgattttctggcctgccttctcgtgttgggtgggatcctctacaaatctgtaggcgccataagggcggagaccttggctgcttcatttgttcttgtgtctcagtgcctcagctgtacatgtaagtgaaataggtgtttgtggaatgacttgggagcagcaccgtcatctctactttcctataaggagtcttgtgcatggcctagcacatattctgtccccaagtccatggaaagcactgcctgccaggctatttgtgtcatttcaggaaaataagacaaagttaatagtggtggtaatacttcactagcttccaagatttgtcaggaatatgctgtctgcttttctaaagcccactctttactggagtcttagagtataccctggggatcctttgcttctgggtcaataggagcactcattaaatgcagatttgtgggtccctcttcaagccgatgaatcagaatcactaatgctgaaccccaggaatatgcatttataacaggcaacccaggtaattcttgtctacaccgaagtgctggaataactgatgtcgagtgtttgatattaactgttatctgttcatacatacatttttttgccccaaagcatctcatggtgcttctctaagcaattttgttgcttaaaagaatgacagactggataactggaagcagacatctctctaacagatctcatcgttccagttttaagtagaaagtgcatcatctgtgttttctgatcctgagcttaggttggagtaaacctgctcagagactttctccaggattagctagccctggggcacaggggaaaagatgcctggttttaggcaacagtgaacaccatctgggtcagcaataggattcaactgccaaaaagctagcacagttgtaatttgcatctaataaaaggagatttatagaacaacaatccttacagctctactctgaagtattgtacgtacagttaatgtcattgctgtttatggttttaccagacctatactatttaatagagataataaaggttaagttaagtgaatgcttatttcatgccaagctagcgcttctaactgcattatctcattaaattcataccacttcccagtgaggcaggtactcatgtttccattttaaggataagaaaagaggggcttagtagctcggttttaaaaagtcaccccaggtcctagggtggttaatggagcccagatgtgaagtttgcttcaactccacgatgtcctgccttcatctgagcctccccaggaagacagggctcggaatattcaggaaatgtcattgatctggatcccagctctgcactcactagctgtgtgtccttagcaaggcatgttactttctgaatctcagtgtccacatctgtaaaatggcaacagtgacgcttacctgcatgaattattcagtgatgatgcccaggtatccacatcattcctaggtgtgtgcaatcaagggagttatttgattaaacaagctgctctgattatatacacaatgctaggttggggacaccatacttccaaaggaataaggacaaattagagcaggaagagaccaaaatggtagaatgaccaggaatggtctctatgaatttgaggattttcagccacaggagagactgatttaatcaacacatatttacagagcacccactctgctccagggccctgtgttaggcacctggaaaacagaggcgaaccaaacagatatgtctcttatctctatgtagcttcagaatatttagcaaacactgcatataaatatgtacatattttaaattgcgatatgaaggataagtaacacaagcatctaacagaggtaactgatagagtatcttctagagaggaaatcagacttctttgcatccctatgtgctaatataagaattctgagttaagcataatgacacggagaactttccaatgagtctcctaggcgacctctcaatagggaacaagtgctaaagacagacagctgctgggtatggctgttgcagggggtctcatacataccaagtcttatagacttggcagtctttaaggtcaaccagattttatctgtctgccttctagggttttcttgaagacgtgcactttgaacaaagaggacattgggatgtaacaaccacagtggttgaaaaaccccaaatgcccagagagaacattcaacccttagaatgttagagagggcagtataatataatgggtgagaacatggattttggaatgaaataaacgtgggttcaaatcccagctctgtcatttagtagctgtgggactttgggcagataattcaactgtaaaattgtggtatgataataagagtgaccttgctagggtgtctgaggattaaataagattgtatacctacagaaaagtggggatataaactcggatctgtctactgggacaccccttatcttcccatggtgcacatgcaacgtcttccccacttccacttcatctctttggaaattacttttgccctgcctgacttcagtctttacagagtccttctttgtttcctgagagctcaatctatagccaaagtaatgagcctgatctgattcagcccaagaactctggtcattgaacttgacttggtatgtccatcatttgtacattttggataacaggttattgctaagagggaaaacctttagctgaatccaatacattcactgcaagtgaagcagaaggaaaatgcctaattccgacttgttagccgctgaacttctgagaacagaatcagcttagctgcttgcaaataagcgagcatcacagaacttggttgagctggcaagaaggtaacaagctgtgtgtgaaaaccctggcattaaatctccacagtaaagttgcttggtacacaggatcaaaagagctgaaaagggtaaggagacaatgagcaagctcctttctgcatacccgcccgacctttaccattgggaacaccccaaagagtgtatgctctggcaccttatcaaaaaataagactgtgctttagattataattaaaacaataaattcttctcccctgcgtgtatcccgattagattgttgacactgtgtcaagctgttagggagataaactcacgctgctacttgcactcaacatgccgcttatttttgagtcactcggagggtgtttttttttttttttttcctggtgacaacttggaaataacccattggagtttccttccttctatttctctatgaagttattaacactgatacacatggaacttcggaaatgggacagcttccatcttggtgttgatgtaggtcccagaatgagccttttaggaatctggggaacttatgtgttggtgaaaatgccagaggacacatgcatgcataggatgctttaaagtcttctgaagataggttgtttaaactgtggcaggaggtctggggtcagcctctgagcagggatttaggagattgtctggctcctcacccttgtttctccaagcatcaagagcaaactctttcttttgggtggatgccactgatggctgaccaagagtcaagggtggggaggttgcgaggatcacagggtcccgtccaaatgacctgattcaggaatttcgggtcttgagccatggtcccagcaaggctgagtaattttttttttttgaggcagagtctcattctgtcacccaggctggagtgcagtgttgccatctcggctcgctgcaagctccaccgcccaggttcacaccattttcctgcctcagcctcctgagtagctggggctacaggtgcccagcaccatgcccggctaatttttttgaatttttagtagagacggggtttgaccgtgttagccaggatggtctcaatctcctgacctcatgatctacccgacttggcctcccaaaatgctgggattacaagcgtgagccacctaattttttttttaattcttagtagagacagggtttcaccatgtcggtcaggctggtctcgaacccctgacctcatgatctgcccgcctcggcctcccaaagtgctgggattataggcgtgagccaccgcacctggccccagcctgagtgatttttaattcctaaacctatgaggctatgtttgtctcatcttcagacctttgcctatgaggttttgtcacttgcaatgaccttacaatggcacgcttttcttgggccacctcagctcatccttcatatctcagcttgcatgtggcatcctccataaagctttttaaaataatgcatattttattttgaaatagttttagatttattgaaaagttgtgatatagccctgagttcccatgcacccacactccgtttcctctcttcttaatgtctcacatcattatggtacatttgtcacaatgaataaaccacattgaacatggaaatttccccttttaaatatttttagtgtacaattcagtagcattaagtatatttatattgttgtgcaattactaccattgatctccagaactttttcatcttgtgaaactgaaattctgtccccattaaacactaatttcatccgtcctgctcgcagcccctggctactttctactttctgtctctctgagtttgactacgctaagtacctcatataaatggaatcatacattatttgtctttttgtgactggcttatttctcttagcataacgtcttcaaggtacattgatgtgttcaaggtgctacagcatgggtcagttttttttttttttcacttttaacattgcataatattccattgtgtgtatataacacatgttatctgttcatatgtcaatggacatttaggttgtttacactttttgattagtgcaaataatgttgctcagaaagcctttcttaatctgactgtataccccaggtgcacccttgggtcatctctatcatagaacttatctcacagagtataagagctgatttctgtgtctgcctctcacactagacttccacatccttagtgcaggtgccctgccagtaagttgttcaccattgtttccctatgatgtagaagagttcctggttcatgtgacatgctcagcaaatatttgaaatgagtgattgtaggaggaatgaatggatagttggttggttggatggatggatagagggatggttggatgaatgagtgggtgggtggatgagtggatggatggatggatggatagttgaatggatggaagaatggttggatggatggagggatggttgggtagatgagtgggtggatgggtgagtggtaggcagatgaggtgatggatggatggatggatgggcggatggatggatggatggttggatggttaggtgggtgaatgagtgagtggatagacggatgagtgtacgtatgtatgtatggttagatggaagagtggatgaatatatagatggggggaaagatgaatatatccagaggatgagcccaagcagattcctcaaggagtagaatttgatttatgccattgatctcactggggtggtcatgtgatgataaacaagagttcagggcaaagaaaacacaccaggttaaagtagcattgagcatagaaagagtagatctcagggcgggatgggggagtataatttgctttactttttttttttaacctaaaaatatttttatttagtgtttcagtaaattaaatcaatgacagtcttttccatgatcctactgccaagatagattttattgaacttttaagtataaaaatagtgcacagacagataataataggagaaaataaggaataaaatgaaaatgttcttcccaaccagtctctctataaagataaccacagtaactacgtcttgtttatttgccattattcttggggggattttctatgatttgtgaatatgtgtctgccatgctcttttttaacgagtgcctgtttgttcattgcataaagttaacaccacttaactgttcctcactgagggggacatttagctttaggctatttccaacagaactgcaatctctttaaaataccttgtgagtatatccataaggtaaattatttgaaggaaaactgctgggctaattttttttaatgtacatacacttatacattttggtagatgttcccagatgcccttccccaaagtttgcaccacctgatgttaccatgactcatttttattgctgtcagtcatttagtgtgggtgaggcacccttgttaaaagacataaggttggagcacatagtccagtttacttctgaacatcagtaggacatttcaaaaaaaatgagtcctgctattccctaatttataataaattctgagacgggggtggagatggcttctttacccatgagctatgcacattagatcaaaaaatgggggagaatccagagatgttgaactcaagcgtgatttgaaattctgtccattttcttgccctcagtggatgtttttaaagtagaagagacaggaaaggttaagactttcagtctctttcccttaagagtgatgtgtgattctctactgtctgggagctccagggcctgacccacagattggctgtcactaatgctgggaagaggtgtcactagtttagcaacccttcattctatgccatttcctgcttccatgggtcaaatgtcagcaccgttcaacacgggctgaagaagctgacaaaaaaggtgcttgggactggatctttcacagagtacaaatgaggtagtagtggaacaattggtgaacacactttagtatatatttgacacaatttagctgctatgcctggcatctctccttcagcatatcctgcctggtagttatcattaaaaaatcgaagaatatataacatgtttataatttcttctttttatccatagttcaaagggagaagcatagcttctcttttaagagatagaaagatatagacatagacttagatgtatgtcattattctcctttaggataaaaggtggctagggctttataaaatttcagtgtaaatacatggagtaccatgtatttaccaaattaccaaatagtaatttggaggaggggatcttcgtcaacaacataaactttccattaacagtaataccctcttgcagtgtcacacacgagtctttataacttaactcatttggaagtcaattctttccagtgtggctgaactataagtctgaaaccagtgttatgaaacttgcaaagaaaagattaagttattctgatatgaaaatctttattttagaatgcgatatttatgcagtacacagtgcaaatatacaacatagcgtttactgtgaaacgactccttccacttctgtccccagcaattcagttcttctcctccgagactgcactgtagctatttttgagcattaatccagaggcagtcaattaataaacaagcatattcacacaaatagtagcatgtgatcatatgacaggaaaaccaagttcccagactgtggcaaaattgtttcactaaggataaaagttacagaaagtatacttgtttggcagagtttattagataatattattagataaaagtgttagcaggataggatgaattcatggaaatgtgggatttctcttatgtatgtattgctttattaagagcaaacgcaatattaatatcacaggtttagacgtctgaaaaacatacagggatttggctatgcctttcataggctgtgtgatgtcagcaagctctccattcctctcaacctcacagtccttatattcaaaaagcagaagaatgtctctgtccaagggttgatacaaacgatgaatagcattagattaaaaggatctccgctaggtgcagtggctcatgcctgtaatctcagccctttgggaggctgaggtgggtgaattgctttaagcccaggagtttgagaccagcctgggagcatggcaaaacgccatttctactaaaaacacaaaaactagctgggcatggtggcgggtgcctgtaatcccagctactcaggaggctgaggcatgagaattgcttgaactcaggaggcggaggttgtagtgagccaagatcacaccactgcactagaacctgggtgacagagagagacttggtctctcatatatacatatatatatatttatatataatgttatatatacatagtatataatatatattttatacattatgtattcaaggtcctttatacataatatatatgtatatatgtttatatatgtacatatgtattatatatataatatatataaaggaccttgactatagtagtatttagcgaaagcagtttgcttgttttcctctttacctgctacccatattatgagttacaggagcagctcctcaaacagtaatatcttgttgtgctttatatggctaaatttaatggttaaaaaagaaagagagagaatgtggtggaatcaaagagtagtttcttctgatttactagtatgctccctccccaacctccacttcttggctgtgttcatacatgaatggagtgtgtagacattcattctcatctactaattgctttcttcatagacaattctagtgattacagggacattgattctaggggatgtgccaaattacctaagtgccatccagctctcaaactttttgtaacctccctcaagcaccttttgaactctacctattaactggcaagcaatcgagacgttatttaaaaatcaatattatcttttcattaaaaacagccccccggccgggcatggtggctcacgcctgtggtcccagcactttgggaggctgaggagggcggatcacgaggtcaggagtttgagaccagtctggccaatacggtgaaactctgtctctactaaaaatacaaaaattagccaggcatggtggcgcatgcctgtagttccagctactcagggggctgaggcagcagagtcgcttgaacatgggaggcggaagttgcagtgagccgagatcgcgccattgcactccagcctgggtgacagggcgagactccatctcatgaaaaacagaaaacaaacaaacaaaaagcagccccccatctctctcagctgttatgctgctgagtaaatggcctcttctcacctttttgtgttccccagtgcacttcaccttcactgtgaaggtcatgtattcatgcttctaatgttttacaattaaggataacatctccactttggtgaatttaatgagacttggcagtgaccccagtgacctggtgaacagccaactatttaggttggtgcaaaagcaattacggtttttgcctttttatttttaaaatggcaaaattaaagtggcaggaccgcaattacttttgcaccaagctaatattaaggagcctggctctaaagtcggactggctttcatcccttattacttgtgtaactctgggtaagttacgaatatgctttccctttccagttcttaatttttcttctgtaaaatgggcataatcgtagaactggacttctagaatgtctggtgaggattagatgagtataaagcgttcaccatgagggttctaatcatttagccacagtaagcattctttgtgtgttggctgttactgtgaatgccatttagttacctgaatccattcatccacttcgtctcatatattttccaatatttatggagtgcctgtgttggtcaaagcaccaatgcagagccgccatctttccctttgatttttgaatgtcccaggatggtactctagatggttccacacaatccagctgttgataacaaagacaggttgttcaccaaatcagagagtctttgagagttcagaagagtttaaaagagacagatgggtgcctctttcatggccccgagcttttctgtagaggttgtctttcacgtggagacatctctgttccttttattttctgttgactcatagcaactcgggagggagattattgaagaacaaaagggaggagtgtgtagttctgttttcaacactccttcaaagggaggagtgtgcagctaccgattaatagatttgaaggatgggcattcttttttttttttttttttctttctagatggagtctcgctctgtcacccaggctggagtgcagtggcgcgatctcggctcactgcaacttctgcctcccgggttcaagcaattctcctgcgtcagcctcctgagtagctgggactgcaggcgcatgccaccacacctggctaactttttgtatttttagtagagacggcgtttcaccgtgttaggcatgatagtcttgatctcctgacctcgtgatcacccaccttggcctcccaaagtgctgggattacaggtgtgagccacacacccagctaggatgggcattcttgtagagagagatagctaagatcatgtttctggcatccaagctcttggttataactctgggtttgctgcttgccacatgaatggcctcggacaagttattgaacctatctgggcctcagattccccatatgagaatttgattgtgttaaagtattagggtagctaacagagcacctgaaagttattaatttgaatatatgttggtaacagattataaagttgtgaggtagcatttatttggtgcttactatgtcccaggaagtggggtaagaagttcacatcatgtctggcagtgtagtaacctgcagaagagcca[131 bp omitted]ctcccacctcagcatcctgagtagctgggaccactagcacacatcaccacacccagcaaatttttgtagtttttgtagatactagagatgctgttttgccatgttgcccaggctggtcttgaactgctgggctcaaatgatcctcccacctaggcctcccaaagtgctgaaattacaggcatgagccataacttctggcctagtcagaatatttgtttgaattcttaccctcacaattacaagctgtggccttaatccctttccttaatgctttcttgtcttcagatcctccatctggaatacgtgaagatttaatgagatgatatctatataacacgctttgaaaaatgcctgacacgtaaagatcacttaataaatgttggttattcttactgtattaaacatcccaattattagatggtataacttgcccaggttcacacaactcagaagatacaagaggaaaacttgagttggttttgtcagctcttctgcagacgtagggggctaaatgagtaacattctgaaatgaagtcttcggcatctccaagggataaggatgcctggaaatttcacctttggggcacattctataaactgtacaaaattaaatccctcacttcatttccccagaaagacccctctgaagcattgctctgtatccttgcaaatctgtaccacgagacaaggggatgtcagtaggatttggtctccccacaaaatccctgcaaagatgtatgaggctgcatataaattgcattgaatgggctaacattgcttttatgctgaatatcggcaaaaagtatgaaatggagattacattttcaattctggctttttcccccaaagctttaccaagctgccctcatcctcacccctccatcatagtgcaattgcattggtgtggagtcctagctctcctttccttgctgggaagtgtacctaacacttgctgtcaggctggaaccgtgggtaacatgttccttaacagcaagtttctttattttccttcccccacatctctgtcctttttttctcactactttttgttgttaagacctgtcacacatgagaatcacaaaaccaactacaaataaatggcattcttgtggatgctaaaatcggtatatctgtctcttgggttgttcagggtagaaataagacatcgatgcaaatatggttcatccaccggcaatgagacacaggcttattatttcttcctgaaatacatatattcatatcatctatttcagtttgtatctccaaacagccctaaatcattgtgaggacctgggctccagtttgggtctatgaaaagagggtttacccgtggggggtcggggggtggttgtgcatctggttttacatcagcattaattccgatatttcaacagccccttcctgcccacattccttgcctctcccttctgccccctgaatattattgcctggctgactccccaaagagaaaatgtactaagcgaacttgacagattccggctggctccatatggcatggcctgagtttcgtgttcctgggacccccaagctgctctcaccttattacgatggtagtaactacatgcaagtcaagtccactgcattggttttaattccttgggccctggggactagcctcagacttcaaggtggcattggatgcaacatcatccactgcaaatatgacctttcccttctcttcccataaccacacagctggggggaaggtaggtggaaaatagaccctgagtctaggaaaatcttcgaaaaatgcagagataatatcagagggctttgctagggctggcagcagagtctaacaaagacatcttaaagcatcttgttgtttattgcttgatctgaacctttgcactcccacacataattgagactttgactttgattcataagtatataatttgaattcctccttctctctacactgttttaaagccatggagaaaattaactccaaatcgaataagtgcatttcaaatggataagcacttgcaacccgatgattaaggagtgcagttgaatcccatatgtttttaaataatcagaatttgttagaatgcatctgtaaaagaaagttttttgacagcttttcacttcacccagagtatatagaaaatgttgctaccttcatgtaatgtagtcttccatattctgacagaactatcattgcgtagaatgaagagaacacaaagagggcagagagtcaccttgttcaaatagctaaaagggatagcaagaggaagatagactttactccaggtggcccaagggaaaaaaatacatctaaagggaaagattttttaagggagtgaggagtgggaggagagttagagaaatagtgtagcaatctgagctgctgaagagaaagtgctttagtgttcacagtaggggctgcagtttgcagaggctagagagggggagtccctggtaccatgtctgaagttccttctaaccctgaggtccttgatgctgggcattggcacacctcacagtgagatgatttctgacacaaactggattggtcaccattataaatgattcaacttatttcagaagccacttttgccagctttccgctatatgcaacaaaaacctcaacctctgaatatgaaaaattcaatccatttgctttccttttagctaaaaggaacccaaaactgactccgcttattgctggatttgtatgctacttgctaaataaatggatctagtctagatgccaacaataccctgaggatgtagaaaacctcctttgcttgagtcgagcgccttgaaatagctctgttgcatcttgaacggggctagtttgttaattcgatgagtaaaggggagagtaccatcatttcgtttgttcccgtgcggaccgaacacggtattagcctctctgcagatacaatctcacttagacgtaccagccactgtgagagtgtagaagagtttatcccgaatccacaaacaggaaagtggagtcataggcaggaatgcactcaggttgtggtgggaagtggatcaaaacccagttttgtttttttttttttaattttaattttagggacagggtctcggtctgttgcctaggctggagcgcagtggtgtgatctcggctcagtgcaacttctgcctcccgagttgaggcaactctcctgcctcagcctcccgagtcgctgggattacaggcatgcaccaccacactggctaatttattgtattgtatagttttgtagagatgggggtctcactttgttgcccaggctagtcttgaactcctgggctcagtgtatcctctggcttggcctcccaaagtgctgggattacaggtatgagccggggtgcctggcccaaacccaggtattttactctacaatgcttgcccttttctcagcccttccttgcttgcaggacacctgaagtcccttgagctgctgtctatgggaaaggactcaagagcctgccttttcccgggtgaaggtagctggttgggcctggggtgtgaagcatgaaacaggtactgtgcatctcaccacagctcagagatggaaggatgcagcttcttctgcttttgttccacttcaagtctagcccctcttggggctgcttctctccgaggggaagtggggcacctggagggggggcaggtgtaggtgattggagctggaatttctctagtgtgatagtggcatcagctccacattctccccagcatgtcgaatttgtaacaaagctagatgtgaagagtcttccccagaacatccctcaataatttgttttaataatagacattttcagcttaaatgtgagtttttatcggagatttcccccttcccaatttgtgtcagcaaccgttattaaattcctaggaaaaggcaaatgttggggcttggtcagaagtgaggccgacgtataggtgccagttccagcctgatgttccccaccgatgtccatgtgctgactcagtaaacaactgcctttcttctgaatggtctatgtgagctgttgattatcatgttcttaaagaaggctgaatatcttgtgcctttcttgttaagcctgtgtgtcttgggacagctacacacactctctaagttacagttttctgagctttgggtgaggggatgttcgtctttttctgcctgcagcactgggcctcgggaagcaacttagggttttggctagagcaaggacagatctgacatctagtccttcttctgtgttttctgtcaatcccagtttccctctctttcaacctgagctggtagcactatccttttactgtttagagggttaagagagataacacctagtatatagtagctgctcagaaaatttctcgtttccacaaatgagaaagtgaatgcaatagacatttgagaacagtaaatgtgtaatagaattattagttctttgttctaattgtcaccggctccgtttaaaaaaatacatatatggtatttactttgggaaagctgcaagccctgtctccatcacctccttttttcaagcgtggactcattttcatctgcggattccctcttgcctgaaggccttggtgccgcatgagcaagtgcagtgctgagagctgtgtatggagctggaagcacaggccactttctgctgccgagaaatcttctgccctccgagggcacaggcttgactgcaaggggatgtgggaagccatttgtgagaagtcgtaattaatgatctgctgggccttggcacttatggaggaagcagaaagcagctgggaattgaaacagcctcttggataaaagttgtcctcctggggctgcttccctctgaggggatgcgagggacctgggagggaggggcaggggtaggggtctctgtagtgcgaattactcaatgctactgtcttttccacagcttatagggctgctacctgccatgcatgatatccaagtgatatggccaaagaaccctagctcttgagacaaaacatcctgggcttgaattctagctcttcctattgctccttacatctggacagttgccctccatctctgagcctatttttttcatttgttcaatgaggatggtgctacatactccgcaaggctgtctggattagaaactgagtaacataaatggaacagagtaaggactcagaagtacttgggataaaatatacagcaagaaacatagagcccccgtcttcagggtgcttacggttttgtggataatagaaatcgcattatctatataatgtgtaaacttgtggatatttctgtagatattgctgtagaatgtatgcacatatgtcaggtgatattagatataaattgctgctaaattattcagatacttctcataatataaattgttcttctttggtggaatattgggatgcctctgtagtgcaaattactctcttttggtgagttagcaagaatctatcataccttaatttgatcttacttgctgctaggctgatttgaaagttaacttacccttcagatgactaagggctattaaatccctgaaggaatcttgcagataactacagcaaataacaatatcttctattgaaaacatatttggtattccttgtaccaaccttataagaatgctttgagtatgacatgaactacagatactccttgacttaggatgggatcatactgcaataaacccatcataagtagaaaacataataagtcaaaaatgcacttaacacccctcacctactcaacatcacagcttagcctagcctgccttaaaagttctcagaacacttatattagtctgtagtttggcaaaccatctaacacagaggctatcttacaataaagtgttgaatatctcatgtaataattgaatgcattactgaaagtgaaaaacagtatggttattatgagaacgcgagatacggtttctcctgaatgatttcactttcacaccattgtaaagtcgaaaagtcttgagtcggggcgatctgtattgcctacaaatcaagccgtgcagcgtccacacctagcaagggctagtgatggttatcatagcaacaagtcctcctgctctatagtcataacaataatattttgtagcatctattccattgtgttgcatgaagggttacagaatctaatatatgcagaacgctgggcacagtgcctggtgcattgcattgtaagagctcaaacagtgtcagctgcaatcatcctcattaattctatcttcgcagtaactctgtgaagtgctttagggaggcgttacagtcccactttaccggtgagaaaaatgaggctcaaagaggcttgttcagtccgcacagctgacagtgattgctgcgtcagggccagctgtagccttattcctgaatttctccttatacctcttcagcccctccttccatttcatcccagttgttgttgttgttgttgttgttgtttcttaaatcaagagtttgcatgcatcttccctttgattgcctgggattttttttttttttttttttttttttggaaagcagtcatgaagatattgcctagcctcgggtacacaaattctggatctgctttccaagagaacccaggaggaagaagatgctgtgacaggcatttcttatcagggagaggctcccctgcttgcacttcgaatccacaatgatgaaggaattttccttcctgggcgtatttgcttatgttcttggatgtgctggtaagcccctgcctacccacctctatgtaaatgagtcctcccacaagctcgggatgttctgtccccaaatcctgaacaccatgtacaggagatgggcttagatgttgcagaagcaaagactgagaggggggcagcttttggctgcaattaactccctttttgactttatcctgggttggaaaagaccttcacctggctaggagatctgaaaatgtgcctatgattgtcagctgattttcccaggtcatgaacctgggcccctcagcctggaacaccgtgggaggagagggaagccaccctcgtcactaaaaggtgctacccttttattcaccttcctcaagttagaagaactgtttctccagctgtaccaaggctgtgctggaattgggatcgcagagcagtgcagaatatttattaaccacctactatgtgactgcggaaatagactcatcaaactattttgggtccctcctggatgctgtgagagacctaaagtaaatcgttgcaatacttgggttcttgacgaagagcgttggcttcacaatctggcagacctgttgtcctatcccagatcagacttactgaacctgtgaattggggcaagttatttatctcttctagattcatttcccttacttgtgaaagatggtaataatgtgtgtcatgtaaaaatatgaggatattagataagcactttgtggtgtcttggacctaaaaagcagttagtgtgtggtggacattgtatatctttaatatccagacctttcctgggatgccaaccttgttatctacagacatactgcctgagggtggaggtttgaattgaggatacagataggacagtgttcttattggggtggctgataatagaataattgcttatttatcttataggttgggaaatattggtattttaaaggtgggttttccagagttgggtataagttcagctacccaagacaacaggttactggggctgtatggctttgcatccagagttaaaagccaggcctgggaataattaaaatacttttcatcctgggaaattctgctttaactggtttatagcagaggctgcgcatcagatgttttcaaaattaagtgatggtttatgtacaatctaattcatccgcttaagtgtacagtttgaattttgatgattatatacaatctcacagtctccactacagttccttgaccttaagtttccttacgctttattttcagtctattctgcccccccattccctaacccctggcaagtattaatcagctttctgtccctgttgttttgaatttcataataaatggaatcatactgtgcagagtcttttttgtttgagtcctttccctgagcataaagtttttgagattcagccataattgttgcacatattaacattttgttccttttcattgctgagtggtacgtcacggtaggaatataccaagatgtgtttatccattcaccagaccaattaatggacatttgtttctagtttttggctattaagaatgctgtggaatttgagtacatgtctttatgtggacacatgtcttcattttggggagataaatccttcaaagtagaaatgctgggagacatggtaagttcagatttaacattctaggataccattattgttgttatccaaagtggctgtgccattttgcttttccactggcattgtagcattgggtatttatttattttttagacagagtctcactctgtcacccaggctgtagtgcactggcacgatctcagctcactgcaacttttgcctcctgagttcaagcaattctcctacctcagcctcttgagtagctgcgactacaggcgcccactaccagagctggctaattttttgtatttttagtagagacaaggtttcaccatgttggtcaggctggtcttgaactcctggcctcaggtgatccgctcgcttcagcctcccaaagttctgggatgacaggcataagccacagtgcctggctggcattgggtatttttcgcacagctcccagatgtttatattgttatgtatctaactagcatggatatcctctgggctctgttttttctgatttaatggccacctttgggctatcagatgaataaggatattgtcagtatcaggaaagtaaagaagacatttgtcccaacccatatgccccaagttgttcaaaactattgaggaaagagatactgtctgggttttcataactcagttgcatttttatgtcttgcatatcaaaatttgtatgcagggttacgttccccaacattaatccacttttttttttttttaataacagaggacttgacttagataaagagaagtcttattccctcaggtaggaagttgtttccacctgctatagacacattagttaataatcaagggacaggtgtgttcactgacctacctgttattttgttttacaactataatgactagttctgtttatgcatgcacacacagctgcaccctcgcgtgttgcttttccctcatgtttccaggcagaccacgcagtgactatttaatgctttgccttgctatgcgctgttgcttatacatttctggaagacattttcccatcctctgcagtttaccttgtacttttattttctccttgttgaattacaaatagattaacacgctcaataggttttccttgaatccagctgaatgcttcaacctcccacatgtgctttttttagttttgtaacatgacagggaatgaggtgaatgagctgaggatgtggcctttgtcttgggctgaagcagttctcaacccccagatggcttgtccctactcccccaggcaagagcccatacctcaagattataaagagaggttttaaatagaagattgttctatctaaacatgtgcctaactgacatctattttgttattatgtgaaacacatccatatataatgtatatgtatccataatgtatgtacatatatgtatttcccaactctctcatgtctgaatattacatcccttgactatcttctgtggctctccgagtccacttggcatttggttatcagcttatacttaacagcaagtgtcggtctgcaggcccatcacctatttttgtaaataaagttttattggcacatagccacacccatttatttacatattgttcatggttgctgttttgctacaactgtgaagttgagttgtgtcaacagaaatgtatgccccatagagctgaaagtgtttcctgtctggctctttacaggaaaacacaatttctgatccttcttctgtgctaccacttggtgtgtttgcaacttcactgtgctgtctgtgggtatttgtgtgtttgtgtctttttttttttttttttttttttgagatggagtcttgctttgttggccaggctggagtgcagtggcgtgatctcagctcgctgcaacctctgactcccgggttcaagtgattctcctgcctcagcctcctgagtagctggcattacagtcctcctgagaacctgccaccacgcctggttcatttttgttttttttggtagagatgcggtttcaccatgttggccaggctggtctcgaacacctgacctcgagtgatccaccctgtcccccggcttcccaaaagtgctgggattataggtgtgagccatggtacccggccttgtgtcttttctacgtggacagttagatttgtccagttaatcttaccttgggccagtcacttaacttctctcggttttatgtctacatccataacttgggcataataacagcatctcccctgtagagtggcttgaggattcaggggaaggcgagcaaagcacctggcattcacagtgtccagttcacatgacgagctcatttaatggcacccaggcttgatagaaggtatgtgttatgatctgggtggtatctcctgccattttggagcagatgctaagaagcaagtcattcagctgaggtctaggggaatagacagagatccaggccgttactaggagacaagctatgcaatagtcagggttccaacattgcctgcctcttccagcatccgtcacctcctgtttttgttcagcctccttgccactctgcagttagttcaaacacaattctcacttcaaggcatttgtttttgtctttttgaaatggagtcttgctctgtcacccagtctggagtacagtggcacaatctcggctcactgcaacctctgcctcccgggttcaagcagttctcctgtctcagcctcccgagtagctgagcttacaggtacctgccatcatgcccagctaatttttgtaattttagtagagatgaggtttctccatgttgggcaagctgatctcgaacacctgacctcaggtgatttacccgcctcggcctccaaaagtgctgggattacacgtgtgagccactgcgccttaaccactttcaggcatttgaacttgcagttcccactgcctcaccttgtttcctccaagacatccacatggtatactccttcctcaactactttatctcaaatagcggccccatcactgtcttgctccacgccctcatactcatcacatgtatgggtcattgtacttcatatcaatgtgtttatgtgtcagtgtcctgtctcctgtactgaaaggcactccccatgcagttgagaaattcatcttgttatatgcccagcacagtgaatttcacctgcgtgaaataggggagcactaaatattagttgagtaaatgcatgaatggatgaacattccttaaagtgggaatgtctttccatgtttcagaattctcatctgccatctctcttcccatgcatgaagataagcagtagactatccactcctgcacctgttcatatacatatagaaacacgcactgagaccgagcaccacacgcacagacactcacacacacacatgcattcaaacctctccatgcagacacattctctggagcagtctggatgcagcttgtaaaagtgcctcctcattcagcacttggacaacctaagagcctcttcagtaagatcctgatagctttattggagaggtcttgggtagaaaaaaagctgcagcttaatgaaggccttttaacagtcaatctcaattccaaggaaaagcaaatctattaccagcgtccgataatttctgctcagggattcccactcttggaatggatttttttttccagggcctcttttctaattaactctggagcgtagattacaagaggccggccttgtgaatgaagggggcacctcggcggaagtaatcactggaggtgatgtttaattaaagagatgctgttagagggaaaagacctgagcaggctggagtgctaatcctcttgccgtgctagtgtgtccctgcgtgattgtgattgatgagctggtcctgctcacatcttcatctgcagcgtgctcatccctgcaggaggggcttcagctccctccacatacatgcttagcctggtgttgttctggcatggtgaaagggatggctgtgcagtttccctttctcactctgcatttttctccttttctttttctcctttattatagctagatagttggatagatacacatttagatatacaactatgtacagatatatatggacctctatatctatctactgtctgcctgtctatctgctatcattctttcgttgtttgtctatcattctatcactctgtacattcatacattcattatccatatatacattcatccattgtctacctatctactatctacctgtcattctgtctatacatacatcaatccatcatatgtttatccattctgacatcgtctatctatacgttcatccgttacacacctatctactatttacctatcactctatttgtctgtacgtacatcaatctgtccatcatctatccatctatctatacattctcacatcccttatctagctatacattcatctattatccacctatctactatctacctatcactttatttgtatatgtatacatctatctatacatatccatacattaatctatccatccatctatccatctatacattctcacatccattatctatctatacattcatcccctacttatctactgtcattttatcattatgtttgtctatacgttcatcaatccatcagtctgtatacttcacatgtccactatctatgtatacattcatccattatctatgcctctaatctctctattgctctgtcattatatctacctacctatgcatctatctctatctttataaaatcttgctgtgaatctcagcgtgtctgtctccccatgtctgtgtctggctttgtcttcatttttctcattctgtccaaatctctctgtttctctgcctctgtctgtctctgtttcactgtttgtccttttgtttctcctaggtctgccctattaggtaattttagggaacgtgtaactgatacctttttttaaattcaagagtattaatggttgagtaatgtaaaagcaagtttttggttaagcatttactaaatgacaggaactgcctgaggtaccttttggcaagtatttcataattgttcttaaaatagcaaatattaatctcttaatatgtgccaggtcctaatgccaagtactttatgtattaatcccatttaatcttcaaaatagtcttatgttgtagcttcttttgctgttcctattttggagattaaaaaactgaggcttggagagagaattattattattattttttttttgagatagagtcttgctctgtcactctgctgcccaggctggaatgcggtggtaccatcatagctcactgcagcctcgaactcccggactcaagaaatcctccaacgtcagtctcccgagtagctgggattacaggcacacaccactatgcccagaaaattgttttttattttttgtagagaccgttttttttttttatgttgttccggctgatcttcaactcctggcctcaagtgatcctcccaactcagccttccagagcactgggattacaggtgtgagccaccacgcccagctaagttatgcatattatctttaatccacactttcgcacaccaagataacattttatttccaccttttaatgatgcatgtacaatggttttaaaagttaaggtgaattttccttggtcagagtttttaaagaatgtcattctagggatcttacttcagatgtgtctctctccaaaatgctccttttgaatggacagaaaggtagacctgtgtctccccatgtttctctgtgattgctccccctttaaatctgtgtcccagctacatttagtgaacatctttgccatgtggcttctgaatggaggaggctgcagaacttccttcagtcttctgagccataataaattggcagaaatgtctgatttgacgttttcccccccttgttcaaggcagatgcttttctcattactgagaaaagaatgacactttgtctctccaagagctcaggcgttcataatagataagtgtgcagtttctgatcttggagctgctagctctgctagactaggggaggctcagctctatcagggctctatccctggcgagattaggtttgcagaatctctactggagcttgtagctactcactagagtggattggtctatgattctagtttcactgtttatagttcaaaattttccagccagccaggctgtcttcttaattagaggggttgagtctgacatggaaggagtggataatgtacctttactccccattttcatctatcaatggaaaagaattaaaataaattcaactgtgacttgtttaactcccacattaacttgggttagcaaattctactttgtggaaggaaccatgaggaagaaaacagattgtaactatggtctgtgctagttcataagtccaagttcaactctggttgaggtgggggtgttgatagctttcactaaacctcaaattgttcattatcttctagtcttggtgaaacaagctttcccatgtctcaaaaagacccacctaataaatataatcaagtcccatcttacccagaaacagcacctgctgttactctctgattctcattgttttgctctgacattagggtgtctttatcagcctaaggatacatagattcttagacagtttcaatctcttatcttctttaggtggcctaaaatctaacactggagatctcttcatcatagcacccttggaaaactctgaaagctgtcataggtctagaaatccatcaactccagattctaaagagacaaccaaatggctcacacttcttaccgtacctgcacccacaaatctggctcttaaataaagtcatcagccctctaattatactaagatattcaaatcatgagattcgctctgaagccaattcttcaaccacccacttacccatctttgctttccgggcattgccacatccctttttcttggggtttcctccgcaggaacactccttatctgcgactttggttgactgtaaatcttgtactgttgctttgctatttaatgcaacttgtcatcttgtttttggccttgatttgatatcctagtaagggactcttcttgggttttgctttaagattcagtctgctgaagggctgtgactccattgtgagcagaagcagcctgggaaggcaggactagacacaccaaacatcagccagacaggtgatgtgatccctctgattttcagaattcctttgagagatcacttggcccttccctgctgatctttgggctggagtcaaggcaatcttttgaattagttctgtctctctctaaattatttgctttatgtaataggaacatgcctcatttgggctctttattttatctattttatttgaaacagggtcttgctctgtcacccaggctggagtgcaagtacatgattgtggctcacagcagcctcaaactcctgggctcaagcaatcctcctgcttcagccccctgagtagctaggaccgcaggcacatgccaccatgcccagctaattaatatatatatatttaaaaacatgtccttgtatttaacagaattttaaggaagaatttgatttttagtaatttacaacttctctggccaatcttccaaatctggctaattttcattgtaccactccgtgtgttccttttttgtcattctgaatattgatgattatagtctatgttcctaacgcctaggctgataacactctactcagcctactttgttcacatttccagcatcagaatcctgtgttccatgcttgtatgttgtggaacgagctcaattttcagcattaaatttaccatgccaaaaggtggaaaaagactctgcaataaacagactacttagcatgattttgtctgccttctgcatttggaattcccaacataacctaagcaggcataaaattcagttctttaagattcgtttaccaataagaatgttgtaaaaattcaaataaaaggaatgcagattagcagagagaatgctaagcaagttttttgtttctgtccttggtgctgaaaaaaatgggggtcaacttttctaccttagtgaatttaatgatgtggtgattgtatttaaatgactatgtgacaagggatcagatacttccctataatcattctttagtttcctagaactgtagaagcttggtggcataatgagagctgcctgtcacctaccctagaactgtcctgtctcatatgacagccactagccacatgtagctacttaaaacgacactaaataaaattaaaattcagtttcttagtgatatcatttagatattgtcccatctaaatctcatgtcaaattgtaatccccagtgttggacttagggcctggtgggaggtgattggaccatgaaggcagatttttttatgagtggtttagtgccatacccttggtggtagtggcatgatagtgaattgttgtgaaagctgactgtttaaaagcggttggcatcttccccttcactctctcttgccccgactctcaccatgtgacatgcctgcttctgcttcaccttccaccgtgagtaaaagctccctgagacctccccagaagccaaactgatgctggcaccaaccatgagctaattaagcctctcttttttgagacgtcccccaggctggagtgcagtggtgcgatctcagctcactgcaacctccgcctcccaggttcaagcgattctcctgcctcagcctgccgagtagctgggattacaggtgcctgccaccacacccggctaatctttgtagttttagtagagatggggtttcactatgttggtcaggctggtctcaaactcctgaccttaggggattcgcccgcctctgcctcccaaagtgctgggattacaggcgtgaagccactgtgcgcagccttaagccccttttctttgtaaaatacccattctcagggatttcaagaacagactaacacactcagtcagactgtctacctttcaggcgctcaacagccacacgtggctagagtttcctgtgttagacagtacagatatggaatatttctgtcatctcagcaagttttattggacagtcttcccctagaatcattgcaatagactcagtaacgcccacaaatctgtccacatcataatcactggaacctgcgagtgttactgtatatggaaaaaggacctatgcagacagatttaagtaaggagaattatttcttttgaattggagagattattctatagtatccagatgagtccagtgtaatcacaacagtacttacaagggggaacacagaggtgtagagtcagagtcagagaggaagaaaatgtaataacagaatcagaaactggagtaatgcattttgaagttggagaaagagaccacaaggtaaggaattaaggtggtcattagaagctcaaaaatggcaaagaaaccgatgatcctctcagagcctccagagccctggtgacaccttgactttacgtcagttgagaaatcagaactaaaagagaatatgtttgcattgtgtgaagccacaatgtttctggtaatttgttataacaacaatagaacgctgataaaatcatcattatcattgtcatcatcattatcgtcatctcagtaggtgcttggttttagtttgggttcttataattttgcattctcaaatagaaagtcaaaacaatttcttagttatttgaagaaccacactgataagcaatggcaccttttattttttgagattttcttattggcttgtgaatgatttcttctccgagagtggttatggaggcttaaacagtatgtcatgagttagcaatgtctagtgggggagctataatagataaaggtgagaagagataattcacatggccccactttctgatttttttggactgggatgtttgtcaattgcaattctcgttttgagcatggtggtcagatgagattggccttgctgaagcacaggcaagcatcccattaaatgcttttaggtgattcagaaccaaagctcaattcagtattttaaaggcgccctttggggagaccatctctggccttcctaccattggcggctagtgtgttattttccaagcccgctgtgtgatgatgggtgtgatgtgtcacactccttctctgctccctcaacatgctcctttcctcccaggctgggtttgatggattattttttctggaaaattttcctaaccccctgcacactgccatccaagtcacttcgcttaaataacaataacagcaataatagcacagagatgttcagcatagtgataagaaatttactttcatgacctaatttattgtagaaataatcctatgaagggtatgcagtttttatctctcttatgacagagaggagccaacactcaaaaaggtcatgatacttactcaaagccatatacctggtaagaggcaaagccagcatttgaacaacaggccttctgagtctggaagtggctttcattccgaaactcagcagaagtttctccttcccaaatgcttgagctccttaatatcaggaactgtgttacctactttttttttttttttttttgcactataaaatcttcattctttattttagatacaggaggtacatgtgtaggattgttacatgggtatattggaccaaggtaatgagcatagaagccaacaggtagttttttactccattccttcctgccattttagtagtcccccgtgtctgttgttcccttatttatgaccgtgtgtgcttgatgtttagctcccacttataaatgaaaacatgtgatactcgttttctgttcctgcattaattcagttaagataattgcctccagctgcatccatgttgctgcaaagacatgatttcattctgttttatggctgcatagtattccatggtgtagatataccacattttctttatccagtccaccgctgatacacacctaggctaattccatgtctctgctgttgtgaatattacagtgattaacatacttgtgcaggtgtctttctgagataacaatttcttttcctttgggtatttccccagtcatgggattgctggattgaagagtagctctgttttaagttctttgagaaatactcaaacagctttccacagtggctgaactaattttacacacccaccaaaagtgtatcagccatcctttttctctgcagcctcaccagcatctattgttttttgactttttactaataggcattttgactggtgcgagatggtatctcactgtggtttagatgggcacatatttccctgatgatgattataagcattttttcgtatgtttgttgactgtgtttatatcttcttttgagaaatgtctgtttgtgacctttgtccatttttttgcatgtgcagaatttattcaagttttaatataattccatctttaagtctcagaaacctttttacatttattttaagactacacattgggtacagtacacactgcttgggtaacgggtgcaccaaaatctcagaaatccgcactagagaacttattcatgtaagcaaacatcacctgttccccaaaaaccaattgaaataaaaaataaattactttttttcttctccattcaaagatactagactattttttttgaaaatcagcagaatttcattgaagttcctcatttaaatttatgtttgaatcctgtagattcttaataagtacttccatacagagaagaagctaataagaacgttccagagagatcctacagaacgtggtgtggtgggaagatactaggctgggtccacattctgtctctatcagcagtgagtcagtgcacacatcctaccttctgggcatcagtttcctcacctttttattttattttgttttacttttgaagtagggtcttgctctgtctcccaggttggagtacagtggcatgatctcagctcactgcaacctccatctcccagttcaagtgattctcttgcctcagcctcccaagtagctggaattacaggcatgtgccaccacatctgtctaatttttgtatttttagtagggatggggtttcatcatgttgaccaggctggtcttgaactcttgacctcaagtgatccacctgccttggcctcccaaagtgttgggattagaggggtgagccactgtgcctggccaagtttccttatctttcaaatggggatagtgatatctaactcagagcccttatggggatgtaatgaggtaatagatgtcagtcacttagggtgtatacatgagtttaatcatcatcatcatcatcattaataccatttctgtacccccaaagtgtgtgttcaagtacttgtccacattcagtggtcatagcaaggcctcagtttacttgaatgtatttacattccaacaatgtaaaccttaacaaagactttttttttttaaatttgaccactgcagtgttctcatagaaaagactacagaacagaaaaaaaaaaaacagtttgcattgtgtaattgctccaaattgtattttcttttagaaaataaaaaataaatcactagaatcctatttaaatacaagtttaaaaattaattattttgcactagacacagaatggactgaaaaaattaggattagagtcattggtacccatacagatgtgaagaagttgtcctgagagtgagcctctggtttcatctgtgcttctctgtctccacttggctttgtcacgtctcccataaatgaccacagtcattttattgcctctctccatgtccccaccttttcctgtctccagcctaccagccatttagtggccagcgtggtctttctaagacaaacctgaccatgtgaatcccatgcctggaactcttcaatggcctcccgttacttaaaggatcaaatacaaactactttatgtgtcattttctgattctcttcctatgcccacaaccttattttctagccccagttcctgctaaatcttcaccacacctatactccagccatattatcctgttttctgtgttcttttatgccctgatgctgagtgtgtgcttttcctcttccttgaatttgcacctaactcactccatcatctcctcaagattcctctcaactgctacatcctttaagaagcatttgatacctcctgtctctgaattgagagctttcttctttgccccctataataatttatacttataaaatccatgacacttgctttgatcatcgattttttggtatctctctttatccagatcttaatctgcatgagagcaggactattttcttatctctgaatgtattttatattaatgcaaaaacaaatgcttattgtgaacctactggggaccagacacagtggataaaggtacctctagtgcatttctaaacatagtcaaaaactacatttcgaatgaattaatgaatgcaagatatccttccatgtgtcactgagacttttaaaaagaactagtttctttctgatcaaattcaatggataaccttgcagagcaagatctaactcagaatgtctacggatgccttaagcattctgcatactggagcgttttcaagagcccttctctgacctcacacacagcgaatgtctgagctctgtaggctatttgtagagagtttatttcatctttgcagaaagctgcccagtataaatattagtcagttgatttcacacagagtaaaaacaagcttttaaaagcttttacctctcctgtccccaaataggtgctttagacagattctctgagccttgggagctttgttggatttggtaaagtgaaagttatgttctgttccgaagcagccttctgtgaaggctgtcttggggttgatgctgtaattgtgcagaaaggtaaaatgaagaataacaaaggtggcgtgtggggtgggatggagatcaagcttccctgttctggatatatctccataagtccatttcaaaaaatgttcacgtttggtgccaaggtggtcacttggtattgtaaaggagtggtggcttcaaatttaaatagtctaagttcaatcttagctctattaatgaactagctaatggtgtacatgggtctcactcagcctctatgacacctgaaccaatgagtatagctagcattgtccaacagaaatataaccatggtcacaaatatgaatcacatatgtagtgggtttttttttatactttctggtagccatattaaggcaaaacaaaatgcgtgattttaatttcaatattttattcaagcagatatatcccaatatataaccaagcataattttatttacccagtatatccaaagtgttaccattcaacatgtaatcaaactgacactactaaagagatatgttgcattctttctcttgtatgacgtctctgaaatctggcgtgcagttgccatgtacagtacgcgtcatttcagaccagccacatttcaacacccaatgaccacacatggctagtggctaccatgttaggacagcaaggtgaaactacaatgcttaagctgatctagcaagctcttaaagctctctgactaggattacaatatctgcttcacagagagcaaatgagatcgcatgaaaattgtcatgcgccccaactttctcctctgaagtgttagtgtataagcaacagattaagaggataaggtgtcacaacatccttagctgtttacctaattgttgcatttctatcactggacctcaaactccatgaagtagacagtgacatcactcaatactaggtcttccgtgactagcacgtaatagatgtattaatttcccagggctacgaaaacaaagaaccacaaactgggtgacttgaaatagaaatttactggctcacagttctggaggcctgaagtctgagacaaaggtgtggataggactggttccttctgagtgctgggaggacaatctgccccatgctgctctcctatcttctggaagtttactgacaatctttggcatcccttgagttgtagaagcatcacccattcatcttcagatggtatgcatatctgtgtccacactttcccattttataagacacagtcatatggattcagaagcccaccctgctcgctactcaggcatgacctcatcttaactaattacatctgcagtgaccccattcccagattaggttacattctgagatactgggagctgggactttagtattggaatttgaaaataagacaattcaaccaataacagtatgtgttcaataaattcaagtcagatatatgaaaaaataaaaattgagtataaagataatttttggctacattgactggattccaagaatcttccattctgtctaaagaagatagacacgttaaaaatcaaacgagaaaaaacagtaagtgaagaggatgaatgcagccagtgggtagttagactatgcaaaaacaagtgcgccagaatcacaactcaacatatattaaggctttcatttggtggtgttttgaattagaaatatttaatgtcgatcagcctcagtttccttagcattatctacttcgcagttgttgagacaattaactacaatatcctaagttgcacacaattattgggccagacttctacactgtgagtatctgcaaaaaaaagaaaaaaaaaaaacattgttcactgctgtgcttcttccctctgatttaccaataagggaaacatcttccatatttccaaaaacccctggttttccttgagtacaccttgacatcatgcaaaacctcttcttcctcaagtcagccaggccctgctgtactctaagctgcaacccactgggctcagcattcaatcaggcagacgtccttaaaagatcacacattcttagctacggaagaataatatttatgcactgcttaatcatgtgaagaagcacagactctccagtctcaagtggagacattgggtgatgtataggcttagagatcctcatattgggaaagagtcagttactgatcttggctcttcacttgccaagatggaactgtttggtttcaattctgtgaacatacttacaaagtagtaggaacttcaatactgtgtgcttctgcttagttgggttgtactgaatttgtaagtccagtgaggttgtattttccctttgttctgatgagaggtctagccactttgtgtttcaactgttataatgtccatattcagttttcttattcccccataaaagttcatgagatagaaatggaggaaacgtagatatgcatcatgcatctaagcctattgttgtagctagacttgtcgggtcatatggatgaaaatatcttagggaacagtttgatgcattggaaatacctctagggttcatatcactagatatgatttgggcatttcactgagttacctggctctcagcttcttccactaaatagatgtgaatgatacccattctgactttctttcaatattgtatgtaaggcttaaaacgattatgtttaaatgctcccaataacctttacaacctatcccatgatatggtttgtcagtgtccccactcaaatctcatcttgaactctagttcccataatccccatgtctcgtgagagggacccggtgggaggtaattgaatgatggggacagttacctccatgctgttcttgtaatagtgagtgacttctcatgagatctgatgggtttatatgaggctttccccctgctttgctcggcccttgtccttcctgctgccatgtgaagaaggacatatttgcttccccttccaccatgattgtaagtttcctgaggcctctccagccaggctgaactgtgagtcaacctctttcctttataaattacccagcctcagatatgtctttacttgcagtgtgagaacagactaatataacccagctgagatattttgatgatggtgatggagaagagaatgatcatttgtcctatttacctaaagtgactacttgtttcctctgcttatttcttctatttcaagcactagagttacttccattgagaaggtaatgtcaaaatgtagcttaaattatcagctctctctctgttcttacccttcctctttccttccattcataagacaaaggaatgcataagacagctttatcttggcatgtatcattgttgcatttactctttgatttaatcaaatcgtgtttgatcattcactctgtgcttgccattccaatagtgctggggatatgctgtcctataagacagacataggtctctgcttttgagagctttacaatccagtagcctccaggtcttcagcccagctctatattttataggtcctatgtctctgtgaaaatgtcctcattgctttgttctactttgttttctttgattctgccactcagactatcagatattctgtcctaacatttagcattacaattggcctttctacatattgttttgtcagtctgtatcctaccacctggctgcttcctgctcttcaagaacatcaggttagacatcagttcttctggaaaaccttacctgataaatcattttgtttcttaaatttatcttctctgggcacataccctattgcactgtaaatctctaggctattctatgactcctgccagcctgtagctatagaggtacctgggctatgtctaccttattcaccactgtagcccccaaacatagcacagtccctgacatccaacagatactcaatacctaactcctgaaacaattgcgtgagtatcatgctcttgcccatttggacagttcattgcccttgctttctggcaatctctcctaatttcatttcttccaagtccgactatcattcattttatgacagccttttttttttcagctggcaaactatgagaggctaaaacttatgcaacacacaatgaaagacaaggtcatattttatcgtctttgcctgttgcagtaaccagattagacatctttctacaagtgaggcgaatgcaagccaaccgatatctatcatgtcaaacacctgattactatgtgcggaagaaaaagagggaaccattaaagatacatggacaagcacctgcccttaaggagcttacaacattgtgggaggtctctggtttcatgtaagaaaatcgaataattaaaaatacaggcagatgcttggctttgtgcattctttataaacaatgtaggggtggcaggtggttgctaagttttcaccatatcatgcctccacaaagccattgggttgtttagactatgtttacgtacccagctttgaaaaggggctgaagaagaaatagaagatatgttgattcatggtagtgaggcataaacttttttgtttgtttgtttgttttgtttttttaattatactttaagttttagggtacatgtgcacattgtgcaggttagttacatacgtatacatgtggtgaggcataaacttttatgatgggtagaaaactttataatgtgttataagaagaaatgattctgaattggctgggagtactggctcatgcctgtaatcccagaactttgaaaggccaagatgggcagatcatctgaggtcagggtttgagaccagcctggccaacatggtgaaactccctgtctactaaaaatacaaaaattagccaagtgtggtggcaggtgcctgtaatcctagctactcgggagcctgaggcaggagagtcgcttgaatctgggacactgaggttgcagtgagctgaggtcacaccactgcactccagcctgggtgacagagcaagactctgtctcaaaaaaaataaataaattattctaaatttatccatgtccaagattatggcgtccactccttgcactactttttatctagaatgtttatttttctcttcactagaacattctgtcatctgtaacctaatcccattggggagagtatttgattatcctttcgttagtgtgacttaatgctgccaattttccaaatctagcaagagatccttggtgacattcttagtgggataccgtagtcagcaacgttcacggcagagttgctgtctctctaagcgatttggttttctttgtatgtataaggacttcctctcttacaaagaaagttgtgtcacattcgatcgatcaatttcctcctttagaagcaggcagagaatactctggacagctatgatggaataagtcacacagcgatattatctcaaattatatctgtagggtaactgcaagtcaggtatttaaggggacagaatccatccttctccccttgtggatttggttaaatgtagtagtattagcaatggcacaagtcatctaaatttatcttgaatgtgaatttgacactgatgttactctggtggtagtagcaagaacttttccccctttagaaaaagtgggctggtgaaaggagatggattatgaaagtctgttcaggattgaggcttcccgcatacccaggaggtggagaatccctattgaattaaaattcaaaatgcatctgtctgttctttcccttacaaaaattcacttttgccaatgtttatttgcatggtttgattttctgcttgtccatatgcccttctgtccatacaagtatatctgtgacagtgatgggcagccccatctgtcactcaggaatggatggcagtggtgatggttggttggtattgatagccaagtacttactacagctgagctttctggtcttgactgtgtattatagttatgcaagaggttatcacggggaaaaatggatgaacggtgcccaagatcaccttctacattttttgaaactttctgtataattatatctctatgattatttgaaaataaaaaattaacaataatggcagtcataggctaggctctgggttcagaattgggttggtacaaatttcttcatggaaccatcatgacctgagataattttcttagcgtctcagagcctattatttatgaaatgaagataaagtcggtgcccgtatcatcgggctgtgggttgcattgatggaagttctatttatagaacatttagggcagtggcaagcatgtggtttaagcccttctaattgtattattgttattatcaagaatgttataagtaacactatcatcattaacgtgattaatctacctgggttctggatcttagggtggcaggaacatggtcttgtgcctttttgacaacctctaattttgcctaggatactaaaagactttgtcagaatgtctcaaaaatattttatggtgaattgttccaccataactctcacaaatatcacctcttatctcagcccacaaaaaaaggtcaattatagataaaggaaaggacctcattgttgccgaaagacttagatatgaggtctggatttgcacttattcacttcaagactttatgtttccttatctgtgaagtgggtgtgctgaaaatgagtttattactctagctcctgtggagatgaagtgagattatatatatatatatatatatatatatatatatatatatatatatttatatatatatatatttatatatatatatatttatatatatatatatttatatatatatatatagtgactaacattgtctgatacttagaaggtgctggaagaataccagctgttctggctgttagtttgtattaataacaggcaataatacggcatttgaagcaatttcgcaaacagacaggtgaagccctacgcagcatgcctttccagcgcgaaatgcttcagtgcaatgttaggatattctaatggggaaacttttttcagtaatgcagggcaacggtggatggttttgaccttgctctcagtgccccgaggtgctgagtgagtcagaacatgtctcagtactactaaaaatgaagagactagcttgggattcattttttattcaacaaaacattttgaatgcttttgtacatgtgtgtgtgtgctcgcatgtgtgtgcacctcagacactctttgagatgattgaggcaacagtgatggaccaaaaaaaaaaaaaaaaggaaaccagacaaggttcctatactcatagagttcacagtccagttggagatggacaccaaaatgtgtatataatgtcatactttgacagaggttttcagtggcaagacagggtcctctgagaccctggaaaagtgagaaactccatcttcctaagtgcttgatgccgttggttgggaacttcacttgttctggatgtcgctcattttttaagggctaagcacatatttccctttggaattatcacctcagaagtggccatatccaggtctctgacttgtacagagtaccataaatattttattgtcagtgacttttaaagagttgagaaaaacagcctctccattgccttctgtaactccaaatggaaaatcaggatggaacattttgcaaacatgacacctcctcactgcaagtcgaccgcccactcggttggcttgtgtttctgaggctggtgtttgtcagccatggcaagatggcttccatcctctctctgtgcttccctactgagccggagaagtgaaatgagacaagtagctttgctggaatctgtaacatggattctgtcatctttgttgtttgttggattttatgaattatggcttcagcacaactttagagttctttgttcaagagataattttctggccaggtgcagtggctcatgcctgtaatccgagcactttgggaggctgaggtgagtggatcacaaggtcaggaggttgagaccatcctgtctaacatggtgaaacaccatctctgctaaaaatacaaaaagatagccgggcatggtgacgggtacctgtagtcccagctacttgggaggctgaggcaggagaactgcttgaacccaggaggcggagtttgcagtgagcagagatcgccccactgcactccagcctgggtgacagagcaagactctgtctcaaaaaaaaaaaaaaaaaaaaaaaaaaaaaaaaatttctgtaagctggcatagttaccagaacaaaagtttatatgtttatctaaatgaggtcagatctgaattcatctccaagtatttaagaatatacaatgtaggattctgacagatttgggtacctggcactaacaagttgtgtgagcatgagcaagtaatcccacctagcttgaaaaagaagataaaaatatgcggtgtgttggattcttgttaaatgaggtaatgtaggcaaagctactttattgaattttgtatgcttggtgcttagaacaataatcagttcataattggtgtgcaagaaaagatttcttttcctcgttaccagacatcgtcatcaccatcaccattattaccatcaccttcatcatcatcatcatcatcatcatcaccaccaccaccatctttgcttttatcttcttatggattcagtaacaagaattcttcaataagactcataataagattgtgttaaaattcgggttctttcccttactaatgtacgagatccatgtgttggaaagtgttttccatttgtttagcacctcagttttcttatctgccaaaggtaccataatgaggtatgtgatctgccaaaggtaccataatgagtttagtattcactgaagtaggttagagtccaacacacatcccttcttcctgggttctccagaggaagaacttcactggactggaaggaggatcagttttatccccacagtgggacatatgtgcatacaggactttctagattataaaatacattccagtagatttttccctctaaagcatcgtaagagtctcactgtgaagaataatatatattactatttatattttatgaataaggaaactgggtcacataaaggttgaatgacttgccaatagtttcaccattatgctcttgatgcctcaatatttgactttgatttcatagtcacagcattaaaaggttagatagtaacactagaaattacctggcctatcatagtgtttttccatttatttatttttaccccaattcataaaagattttacactctgaacccattcctccacataaagttttcatgaaacaatataaactcttaactattttattcttctctcatgtgtgtagattatttcatttaaagaatgttggtatgatgatcccctacatgggtcttacagcctaagagatcagactgacagaataaaaaacacagaacatttttctccaggattgtgtatcagaactatctggggcaacttttgacagtgcccatccctggatcccaccctcagagattctgaggcagtaggtctggtgtgaaggccttggaacgtgattttttttttctttctttcttttttttttttttttgagacggagtcttgctgtgtcacccaggctggagtgcagtggcgcgatcttggctcgctgcaagctccgcctcccgggttcacgccattcttctgcctcaacctcccaagtagctgggactacaggcgcccaccaccacgcctggctaattgttggtaattttagtagagacgcggtttcaccgtgttagccaggacggtctcgatgtcctgacgtcgtgatccgcccgcctcggtcttccaaagtgctgggattacaggcatgagccacggcgcccggccggaatctgttatttttaaaagaatacataaggagctcatgctccactgactaaggacccatgttctgttgcatctatctgattgtttccagctgaaactctttaactctttgtctatttaagtttttttttcttttctttttgagatggagtctcaccctatcacccaggctggagtgcagtgatgcaatcttggatcactgcacactccacctcccgggttcaagcgattctcgtgcctcagcctccaaagtagctgggattacaggcacctgccacaatgcctggataatttttgtatttttcgtagagatggagttttagcaggttggcctcaaagtcctgacctcaagcgatccgcacgcctcggccttcctaagtgctgggattacaagcgtgagccaccgcgcccggccagttgttttgttgttgtttgtttttgagtattttctgcgttattccctaggacattaatgctttcaccagggaattgtccgtcttggtcttgtctctctttccaaggttgaaggacagaagttggcctctcagttgaggacaagagcttatggtttgtgcgaatggctgctgtcctcgcatactgagctggagtcttgtgagacagggcctcttgtcctctgtgtttatgtggttagagaggggagctgacacatccttttaaagaaactgaaagggctgcttgttttaactctcactctgtgatgcattgcagagatccccaaggtatgattggaaatggaaacgtaaggacgggcacaaatactatgtatccagattttctttccaaccttgtagagctgggaattaaaaagaaaaacctcgcccaggggccacctgaactagaacctgcaaaacagacaagcagaaaggttgaattcttccaggcggtctcttccaccctcacctcctcctctgttatacaatttaattacaactttattcacttcagaaaccccatccattccttccagtaggggaagatctctctttccatagcaaggagccttggtgataagcagctatctgtaggaacggtgcatgggactctcaaaacctctcccttgacaagcaagaaagacatgagcaaataataactgaaattattttgacatttcactctggttgttgtagttttcataataaaggaagaacaaagtacttgcagctttaaataaagaggctgcctttggcattgatgtgggatttcactggggaattttttgtatgagttcttgtttttgctcactgggagagaaaagaaaacgataagccatgaaaagacaaaagtccaaggaaaggagaaagcaagacccctgtactttttcttgatagcatttgtcacccctggaatattgcggtcatcttagtatttattttttgtttcttgaagtctgctgctgcacttgactgtaaggtctatagggacaaagatggttttggattttgcttaccgttgcattaaatgtgaatgaatgaattcgtttacataatgtgtactaggagccaagccctgtgtgtgtgtgtgtgtgtgtgtgtgtgtgtgtgtgtgtgtctgtgtctgtgtctgtgtgtggtttttggtgatgtgatttttaattagatccttacaataatatggtgaagctactcatcattggtcccattaaacagaagcaaaaactagtgcttggagtatcacaataacttgtctaagattacacagccagtctgcaaaagagctggatttcaaaatcttccaagtcatcatcagttatggtatttttaagatcgatttgcagttaaccacacagctttattacaaattcatgctctcttgatgtactcacagtatttttcaaaatttacctattgctatctctctatctctttaaacttttttcatccatcctctgtctcttcccttttatccctgaatgtttgccctcccctcttaagaaaaaataagatagtagcaagctccctgctggattttataactttgcataccatatatttagtttagtaatgaaaaattccagctccaggcgatgcatagaatcgcatttctaatgttttttaaacagctattaatgtggtcgagcagtgggttttttttttttttcccttcctcctctatataatcatctgctcagtggtgcgctgtgaaactgagagtaggagccagaggaggagcaagctgtgattgatgggccaggccttcctggcagaaaaagtgccatctgggttggttttgggagcagtcagatgttgagggggaggtcagccaggcggcctcagccccccaccttcctcaacaccccgatcatccacacattgcacagcgcgcacaccctcgctcgtaattgaggcgtgcttggggcagatgctttgtggtgtgggacaagaacagctgctaagtttatggaggagaaaggaagcaggatggtgcagcaggtatttttgtttttttttccatttaatctttcactcaaaattgcgatttgaatgaagctgaaagcttttcttgtgttaagtccgtgctgtcggtgacacgtagcttgctgcttgaatcatgcccggggaaaggagaggagttttggtgaagagagtgtgtgtgtgtatgtgtgtctgtgtgtgtgtgtgtgtgtgtgtgggcgcgcgcgcacgcgcgcacgcgcgctttctgcttgatgtgtggaactgagctgatcttagaaccagcaggttaatggtgtccttttgcatttttcttctttgtttgaatgcccctagggcatgatgcagtttagctcaattcacttctgcacaagagggtttctctgaatatgcgcgatttcttgccagagaagtggtgtagaccatgctcctaaactaaagtaaaacaaactgtcagcaagactgaaaactgcaagcaaccatcaagaatggatagttttcctccagtgagtccatgctggtggggggtcccactgcaggagccgctgctttcctgggctgtgtgggcatatgtgatcagctggcttattaggttttgacaattcctgtgcatgtcttcattataagggttgagttaaggccagaggaggttctccacagcaggaaataaactggggacaagtaaattccagatgcagaaagggagggtgtgctcaagaagtttgactataaaggtggggaaatacaggtgtgtgagtgtgcacacacacatacccacacaggaaaatgcttgcctattttaaagtccacctggacggctacgaaagctggtactttgccttctcagtgaaagtcaggtagttacatggaaaagaatagacccatttcctgttcggccacttaaagattctttttcagttgaaatacggtttaccttcaattttgagccaaaaggttttgcaaaccctgactggctaccactcttgtttctcttgttagtttctcaaaactactttattaaaccactcagggcaacgaatgggagaagggcaatgtcttggggaaaaaacaacgacaacaacaaaactctctcatcttattttctctctgactctgtctcctgagtccacttcagagagaaaattcagggttcaggatatttcagggaccaaagaaattctctgagcatcagaagagtggccctcttattgcatgcatacaagagtcaacacactatgctaatagtcagattacagtgtttgtcttaaaatagcaatgatagccaggctatttcatgcttcagtaaaatatttaaattgaaatgacttttttttttgcttttatgaatcagacttggttgcattttaataatccttttgctcttggtaactggagtgaaagctacacgttggggtgtcttaagtaatgacaggtttccatcatcctgctgtcgttgagttgctctcgttgactgagaggtttggtgactgaggacaaggaagtttcttctctgtttatcctaataaatgttgtttatttcaagcttctagtcagttgtgcagcagcaatagtgggtcttaaagcgtgagatcttggccttctttcatcctccttttgtgtattgagcaacaactcaagaaagtccaggcactgaaattaaacgttaagtttgcaaaagctcctgaagcatttgcttgatgatgtggggaacacttgtgaggcagatcatcctgctcatcaactaggaacacccacaagcaccctgactctgcagatatcagaagctctctctgatcattccacttatttagggaaaggtgggggtttggcattggagtagaagaaagaaggcagcttctgcaaatgagggaatgtctagccagaatgctccaaataattttgcctgtcactgtcccctacatgaagttggcttcagcttccaacccaggagcctgttcgcgtgcctaggatttgctgtgacctggagtggaaaaggtgcccttaatgtcagtgtatttttccagaaaatacatttcagccaagctaagaatccaggaatgtcactagggaggaaacaaagacatctctggagccatttgaaggtgaaaaataattccataggaagtacaatggtcttaattaaatattagctgtaattagcctaaagtgcaaatgttgggaatattaattagggtctctctggaacggctgtcagtgttaataagtaactgtagggggtcccaccaacatctgtttgagaactccaggtacaggatgaaatctggagtcccatgttcctggatgctaactgcaggctccttggctaccatggactcagtccctagagcatggtgctctgtgtttgccagaattgcacaactcatggtagaggtgggtggcttgctttggcaccagtggtgcccccagctggcccttgcctttcctcggatagcctcaaggcatttcaaagtcaggcgtcaggcttgaggtagtgcagaagtttcccaggctgctgccccactcctttcgaatggtcacccacccaacctggccattggaattgctggcatatttgaatcaaataccctagtccctggcttcctcacagggagtaacacaccaacagctaaacacaggtccatggtgtgtgtgatagagagggaactgcttatttaaaaatgggaagtggacaggcgcggtggctcatgtctgtaatcccagcactttgggaggacaaggcagatggatcacttgaggccagcagttcgggaccagcctggccaacagtaaaacgccgtctctactaaaaatacaaaaaattagccagtcatcatggcgggtgcctgtaatcctagctactcaggaggctgaggcaggagaatcacttgaacctcggaggcggaggttgcagtgagccgagagcctaccattgcactccagcttgggtaacaggagcaaaactctgtgtcaaaaaaataaaaataaaaataatgaatgaatgaatgaatgaatgaagtgaactccccaccaggtgattctcttgctagatgagaaatgccttggtttaactcttggcttccctaacaactacctgtgactgtggcctcgaataattatttcccagctttggtctgcagcatctttgatgacaaggtaaattgagattagagatgcattgcatgaaaagtagggattctggaccttggcactattaacatttggggcgggacagtcttttgtggttcaaggtagtcgtatactctgtaagatgtttagcagcattcctggcctccacccactagatggcagtagcacatcctccctcatttgtgacaaaactgtctccagtcattgcctaatgtcctgtggggagcaatcacacctctgtaagaactaccggtatgaggcgcccagcacagtgcctgccacctattaggttttcttctgaggaccagtgaggagaaggggctgcttttcatggaagtctgaggccatcatgaaccttctgctcataagcccacttatgcagatttaaagcctgtgtgcctgtgagtttacaggtcaaagatctgcggatggaaagtaaattccccaaaagattctgacccactgtttttgcaccattttcaatattgccagtctccaagtctagctatcacccctctttggtttggagagtatacaggccctttctctctctttctacttcactgcctgctttatttcctgcccaaactacttatgcaataatggcttcttaactggtgatcccatatctaatgacattctgccacagctattagaaaacattttccacaaaggaccagatgatagatcattcagtcttggtgggctgggcagtctctgtcacagctatccaactctgcctttgtagtacaaaagcggctacagacagtaaacaaatgagcatgggtgtgttccaataaaactttatttacaaaaacaaaatttgggccaggtttgcctcatgagtcgtttgctaggtcctctcttcatccccctaccctatctcctgctgccagactaggctttacagagcccagaggtcatttttccagcacatattcacttggcaaacatttataaatgtccactttgcagctagtatgctgttggaccatggagatgggacagggaatgtggcacagtgtcctgttttcagggagctcacagacaaataatcaggctgtggcagtgcttggtgctgtgtgagctgtggccaccagctgcagtggagcagaggggatgggcaactgaccaggtttcagcatcaaggaaagcctgctggaggagggactcttgatgcggactgaaggaagagtaaggactagttgggcaagggggtaggtgaggctttccaagctgaggggcagtaaatgtgaagacttgatggggttgagaggatggagctcttctcccttaactgaccataagcttctggaaggcatgacccttctctcttcaatacagagatagctcgaagtctacaaggagccttagctcttttgcaagaactagtaggaatgggccacttttcctgagcttgctctgcactgatgaaaagccccagggttatatatgttcctggtgaaagtatattctgctggaggtggaggagggaaacctttgtcttcatatgatcattgtctgtaccactgcttatgtggttattctgtgcttccctgtaagagtttacacaagtctacctttcacttcagagatgggccaggtagaaggttggggaggcagaaacagatctttgagcagaagctgcctctggcacagtgaatttctcatcagatgattcccaagatcccaacatttctggggcttttcatcacccatagagaagtggcatcgctatgaaatttctgtacagaaggatatgttccttgaacagcccagaaaaagaaaagatgctagtttagttataaaacagcagaagtttttttttttttttaattagtcaagacccttttggttgtaagtaacagaaaaagtagcttaaaaaatgagacaaagggtacaaagtgtcagttttgcaagacagatacattctggagatttaagtacagcatggaaacaagagttaaaaatactgtattatatactggaagtgtgctaagaggatagatcttaaattaaatctctccacacacacatacacacacacacacacacacacacaaatggagatcatgtagaagtgatggatatgctaattacctggaatgtggtcacttcacaatgtatacatatgtcaaaacatcaagttatacaccttacatgtataatttttatgttaatggtatcttagtaaagctgttaaaatatgggacatttactgacttgtgtaactacaacaaacagggatggtgctgactgcgggtaaagctggattcaacacttcaaatgacgtcactgggactcagtagaaacctctctgttcctcagtttcttctcttcattttcctctaggttggcctcacgtgtagggaggtccccttcaagtggcagttcgttgttgttgttgttgttgttgttgttgagacggaatcttgctctgtggcccaggctggagtgcagtggtgcactctcagctcactgcaacttccacctcccacattcaagtggttctcctgcctcagtctccggagtagctaagattacaggcatgtgccaccatgcccggctaatttttgtatttttagtagaggcagggtttcaccatgttgcccagtctggtctcgaactcctgacctcaagtgatccacccaccttggcctcccaaagtgctggaattacaggcatgaggcaacatgcccaccctaagtgtcagttcttggcagctccaggcttatgatgtttttacagctgcccatcaccgtggaaagagaacttcttccccaaaactacagcaaaatcccagggtgactgggactcagtggtgtgactagggcttaacgcactaacggactcactagatagatgtgcatgaacgcaaatccatgggactatctcagtgggaccatctgattggccaggctgatgtcctatggctcatctcgtagcgactgggagctgggttcaactgtatctgcaccatacaggctgaaagtgggactgtcccccaaaaggaaactggggctttgttgaagaaacaggagtggagacagaccagcagtatcactgcatgtcttctttggcttcccaaggatggacaaggttaactgctcatggatagcaactcagcctcaacataggcacaccctccatggccccagtgctatgggaaaatgttagaaagagaaagaaatgctcgtgcccttttgtttccagtggcacagacatttggcgaaatttgtctggaggagggaagagcctgatgggaatgatttacttgtaaaatgtttaaacttatcctaagcttagttctcttccaagtgtcatctttaacattctaattaaggtcccttctaaacaaatgcaccagctccgtgtgctgctctgagaacaaactttttttttttcctctcttctttctgtcatcatgtttttgctgcactcaaattgctttagagaaagaggatttcggatgttggtggcaagtactgaagagataaggagaaattctgatatttttgccctagtatcattatatgagggccaaagtcacatctaattgaccacagacaataggagaggcagctatttggtgtgcctaattgctaagtttttttcctcgctctgtctttctgactgtgtgatcccatctcctgagaccatggaaagtttagacctttgggttacaatttcttatgccgtgtgtgtgtgtgtgtgtgtgtgtgtgtgtgtgtgtgtgtgtgtgtgtgttgtggtagaactgtggaggaggaggtaaagagagagagctgtttcctgaaatggaagcatttgtattcaggtttttgttgtgtgtgtttttaaaattcttctgagttggctgtaattgtcacactgcctgttttgcctagatctgaagaatgaattgttatataatactctgtgctcataaaaaaataaggcagggagggagaggcattgactaatgagactgagagttaaatccaatatttttcagaaatgcttaaaatggggatgtcagagaggacagtctttgtccaaattaggccctgaatttgtatcagctgcttcattttggcactggggacatcatacacgcatacacacacacagacacacacacacacacacacacaacataacacacaaccacacagacactgggaccattaaaaggatactccctattcccattatgtgagccaagtcacataaaactttgattaaattcaaatgcttacataaattgtctctcctctcaagaacacacacgttcaatttagtctctcttggcactttaagtatcaaatcaaggttctgctgtcactgcagacaactaaatgctcacagcttccaaaatgggaatgaaataaaaaggatctgccaaaaaaaaaaaaaaatcaatctagtaaagccacagaccctcatgtctttgaatattaggctgggtggcttggaaaaagcgactttatctttatctttccaagcctcggtttctgcatctgtaaaatggggagaagtgatggttactgtttccttatagggtctggtgaagatgacctgagattggtccatctcaggctggtggcaccatggtgacccctagaaagtacgcggggcacgatcgtcctgggatctgggaggaaggtttctgcatggtggctcctcatgacgttctctccctctctgcacctttttgatttttcagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacagtaagtggacgtgtttgctacgggtgggaggttatggggaggcgcccccagccctggtaatggcagcgggggtgcacccccatctacccagggactctgggaaacagatcagtccctaagcccaccctcatcataccagcttcctgaagtttacctcatttccatgcattcattcttagcgttcatttaaatcaacggattattaattaatttcatttatttgtaaaggggcacatttatcaattttctattcctatagttttgcctttctagaatgtcatcccaatgaaatctcatttttttggaaaaaaaaaatttgatgtaagataatttttcttcaagtcttacggaggctgggtgtggtggctcatgcctgtgatcccagcactttgggaggccgagatgggagagtcgtttgaagacaggagttcgagaatagcctgggcaacaaagtgagacctcatctctacaagaaatttaaaatttagctgagtgtcatggtgcatgcctgtagtcccagctacttgggagactgaggtgggaggatggcttggggccaggagtttgaggctgcagtgagctaagattgctccactgaactccagcctaggtcacagagtgaaactctgtctctaaataaacaaaaataaagtctttgtggaattataatttacataccttaaaattagtatatttttaggtgtacagttcactgatttttagcatatttacggagttgtgcgatgattgccggatgcatctaatttcggaacatttccatcagcctaaatacaaatcttgtgcccctttgcagccactcctcattcatacctcagagctctgaacctcgcttctttaccttagcctaatacatttgagattcatccaggttgcggtgtttgtccctggtttcttcatttttattgctggaccaaagggcaggggctagaaagaggcagggtgagagaattttgatgaataagggaactgtcctgtatcttaatggtgacggttacatgactttatacgccataaagagtaaattttattgcgtacaaatgatgaaatggattagaaacaggcatgtaaacagaaacattttatcatcactgtaaatgaaaactggtgttttgatcattaatcaaatataactctaaatgaaaatatttatcataaaattaaataatgttcatttgtgtgccacctaaagtaatcatgcataccacaaaacctgtatggaacatgcatttgggaacctttttctgcagaattctttagaagcttgggaaccccaatcctgtcgtctggaacattttttgagtgtaaggcaattctgcctcttcgtcctgtcccaagacctcaggaaagcaagtatttgtgaaggagtttatggctttgaagcatgatacatttcctgtgataaaagaaaacactgactaactttgctacttgccacctcattcatttggaggctagttttgacgttttgtttttgtttttgtttttgtttttttgagatggggtctcactctgttgcccaggctggagtgcggtggcgcgatctcggctcactgcaagctccacctcccaggttcacgccattctcctgcctcagtctcccgagtagctgggactacaggcacccgccaccatgtccggctaattttttgtatttttggtagagacgggatttcactgtgttatccaggatgatctcaatctcctgacctcgcgatctgcctgtctcggcctcccaaagtgctgggattacaggcgtgagccaccgcgcccggcctagttttgaagattttttaaaaaaatggtatacattctgaaatttttagttgccttcctccctttttaatttattgtggtaaaatacatataacataaaacttaaccattttaatcctgtacacatttcaatagcattcagtgtattcacaatgtagtgcaaaaccaccaccattatctagtttgagaatgttcctagcaccccaaaaggaaaccccatacccactaagcagacactccccattctccctctccccggcccctggcaaccaccaatctgccttggagatagctttttgtgtctggcttctttctcttaacacgatgttgtctaggttcattcatgtggagtaccccactgtatggatagaccgtgtttatttattcattagtccattgatggatatttgggttgtctccacattctggttcttctgaacactcctgctgccgacttttttgtatttagttgctgtgccttaggcatgggccttttaaatgagtttgctggttcagcaggtgtttgttgcttttgcgctgactaccaggtagtagtgatggggatgttgtttactgtttgttggctattttgtgacaattaatagtagtaatgcctggataggttattttcagattttgaaaaaagatccaatcagacattatttattaagctaactgctgtggaaattttacgtattcatttatttattcacaaatatttattaagcttctattagggccaggattcatactagctgccatggttgaacaaaacaaaatgatctttacctcttgtaacttagtatgagaggcagaaactgagcatgtggcaaatagcatgtgtgatagatgtcttaaggaaaatatgggtaccgtaggaaaattaaaaaagaacagaggtgctacctgcaaacgtgtagtctgagagcatttcttcaaggagatgatgcttaaggtggtaagacaaagcagcccaggcagagggaataccacagtcagaggtcttaaagttggaaagatctgggctcactcaaagtcctaagaagaggccagtatgttttgggcatgatgaaggggatttggaggtgatgtggcaaaagatgaaccgggaggaattagcagggatttgacatcctacagacctggtgggtccaataaggagttgaaattccacgttataagcaatgggaaaccattaaaaagagtttaagccagaagagttatgaaatgagacataaaaagaaagggttagtgatgcctagcttaaaggaaatttaatctagttggggagctgagatgctccacatctttgccctgcaaaaagaacactttagagatcaacacaattgaatttaaatagcgtgttgggtgtccacagtgccccaggcactgcagcaagataatctgatgtgcagacaagctctctttccttggagagccttaggagaatataggatttgttttctgttaattatgataacgtgccaaattctagcatatagattttcacaggttttatctatcataatgacagtaggagaaaacattttcaaaatcatagtcagagggttatacctttcagagacttctggttacaggaaagagaaaactcagtaggaagcatgttggcccatacaataaaaagtccaggcggagggtggacacagcctggtttttggaacgtgtccatcagcttctaatgggaaaccatcctgagttggcttcctcgtcctcacctcagctctctggctctgtcctgcaagttcaggctccagtcaccacctgtgaaaagctcttggattcatcccatataagccctctcgtgggaatcaatctccattcctggcttgtgtggtgttatcttcattcagtggctgaggctggtactgagtgtcccagccctggggtcactgaggagcttcatatccaaatacatggaatgaagaccatttcatcagagttcatgatgagatgccttcagaataaatcattaaagaaacgaagtagacagaatcttgtccgagctaaaggtagcatggtgaaccttttgtacaaagaagcttgaattggtgttaatcaagagtagggagtgaagagaaagacaaggacagaacattggagagctcacggggtggggtttgaaggaagaggaactattgagtaagacatcaatgggatgttcagattgggcattcaaccagttgaatgttgggctatacagcctggagggtataaactgagaagacattattgaagtgacagtttggatgtctttaaagacctagaagacaatagttttgctagagtagtggagagagatgcagaagggacaagagttgaggaataactgtgatatgttggagtgggtgggcattgcccgttataaatatttggagtgatgaggagaaagaagagattgcatctgagaagcaaagaagtcagagaaagcagttggtaggatagttgatttagattcaactaatttatgccaacaaggtccctacgtggggcacaaaagacaggaagcaagagatagggaataatggtgcaggaaagaaagtgatgaagtgttttataggcgataagaaggaataggatcaagagtattcagaaatagtaggtagtctaggaaaaaagaaaccactttttaacagctttgttgacatacaataaactgtatatatttaaagtatacactttgatacatttttacaaatgtacctgcatgcacaaccattactgctatccagataatgaatctgtccattatctcaaagtcttttcttgctcttttttgatcctcccctcctcctccttgcctcatccccagggaaccagtgggtctgcttcttttgctatagcttaatttgcagtttctagaattttatatcagtaacctcaaacattatgtgctctctttgtctggcttcttttactcagtatcattatttttagattcatccatattgttgcatgtggttgtagctccttccttttcattgctgagtactgtttctgcatggatatgccacagtttatttctccatttacctacacatgggcatttgggttgtttttcattttgggtaatggagaaataaatctgctgacatttggaagtacttcaattttgaaacagaagagaaggaagggtgaatgtgtgaggatgcagagaaattttcaagtcaagagataatgtgaggagttccatctacattgccttcattttttccatgaatggaggcagcatcatcaaaggaaggattcctgaacttgggcaaacatgtcagaaatctgccttagataattcctagagtatttgaatggcaatggatgcccgaatttggagaatgtaaatgtatggtggaccggttagctgtctactctgtcttctccagcaatgtttggatggtacacactcttagaggtaggattttaaaggaaagacagccattaggggctgaagcaggtgggctttggggctgatcctgaaggaagttttaagacttatattctgaactggtattgggtaagtgcgggaatcataaaggggctgtctcgttttttgttacaaacaattacatctgtatactcatctctctttggccaaaaaggagatgtgacttttcagttatcctttcctgatctacaccagcagaacgtggtctatgacaagtttacttcaaattgtctctgcctcctcctacatttatggggtgtaccttgtcttcactccaggttctgaatttcctgtggaacgaatttaacctcaaagtgggtcagaactatggttctccccaccctatatccatgaccctgtatttgcacaaaaagttactattgtgagatacctaggtcattccccataggatagtgctgtacctggaatagctctaactcttctttgacatatgtatccacgatgcttaatatcattctaaggacatcgtagaggccattatttctttgagaaactaagtacttttgggtaagagaaaccagccatccatctggtggcctccaagaacatctaatatatgcacatgatttaacacaaagtgcagaatctgtaaaagggaaggaggatgcacccagagctcccaaccagagctcagtaaaatgcagacagaaaagacttaccaggtcatccttttagttccccacaggctgagatgagtccctgcaggcctttttttctgctgaatttctatttcatgtaggcctccaaacatatcacggatcacattgctgacagagccaatactgtattatgttagatactgttcctgacaaggtattttactcttgacatattatcattagagatttgcaagtggtgaattctccatgtatctccaacagcaacttaacttctatttttaacgcttctgcagtctgttgaaacggctcccaccactttcccactagctctaggccctgattggagaaggaatgtgggtgccccagctaggttcctgagctggaggctctactgacagggaaaagaactatttagagagccaggttcttctttggcctcagccgcttcccactgaagtgttaactgcgcctccaaatttccttaatacttttaggaagataaggtattggttggtgatggtgtcctgttcttaaccctttccatgccagttctgattttgaagctgatggaatcactaaggtataggaaaaacttgttcagggcattccttttgactaactagctattattattatcatcatcaaagcaattcaggcttggggtttaaaaagccagacattggaaaaggatataaaatgaaaactaacatgtcctaatacccacaacccaaattcttagtctctgtgccagaaatgagttactaataccttatatttccttccagaagtgttttatgcaaatgcaagcatatgcctgcttgtcctctatctctatctttatctccctctatctctatcatctgtctctaattcaatctttatatcttataagtactcactatttccattctcaaaattacagaattgaaatctaaacacctactttggcacctgctttatatctcagagattattctgtatcatatttaggggttcagtcattattttgtgtgtgtgtgtgtgtgcatttttatgtacagaagtatcctaatgatggaatttaggttgtctctgggtttaatcttgcactgttgatatttaccatcaggctacagtacagagctaggtacaaagattgctctccatctctgtttgcctctgggtgtgaatggctaaaaggtacatggacttaagatgtggacattgatcaattaccctacagagagcttgcaccgatttgcaccctcatggacagaacctaagaaggcctgacacccacacccttgcccaacccaatgtgctagccaactcttggctcatgtccctgcggactctgtgtgtttgggtgtggctttccccctctctgacaaaagaaagtacttttagaattgttgggtgtcctggagaagaaaaattgaggtgtgctgccattgcttgaggcctcctgtggtccaaagatcatgctaggccctcttttggtcgccatcttgttttgttacatcaaccttttgaatgctgttagaatcccaccaataaagggagaaagaggttgaagatgttttgagttgggaatggtgcagttgaggtcgtcacccacatcttgtctgcctgatgttaaagtccaggctgtttccccagtctccagctgtcttctaaaataggggtacccaactcccaggccacagatcagtactggtctgtagcctgttgggaactgagctgcacagcaaaaggtgagtggtggatgagtgagcattaccactttagctctgcctcctgtcagatcaacaatggcattagattctcagagaagcgtgaaccctattgtgaactgtacatgcgagggatctagattgtgtgctccttatgagaatctaatgcttgattatctgaggtgcaaccatttcatcctgaaaccatcctccctgccccactgtgtccatggaaaaattgtcttccacaaaactggtaccaaaaattttggggactgctgccctagaggatctcttgaccaatggcttagaattctcatgaagattggtttcttcgtggctgccctctagcttagacaaacaggtcagttaaggcctggcctctggacttgacaagatttgaccctccattctgcttacaagcggaaggagctcaagctgaccattgaacctctctgctcttattttttctataactcccttcctcagctgtgacccttctccagatctcctcccttttttcttctaaacaactatcagacgatggattacagaacaacagagttcttttcctttgaggagggtttacgcctcatgtacttacattgaaagtttggcaaaataattgaaggttgccgtctaaaaatagggtgaatagttacatcgaaatgagaatcaggaaaaagtctcaaaaatcataacttttgctcattgactgtcagactatattttaagcactttccatgcacaatctcaactaatcttggccctccccaccacgtatgaagtgttatcgtcccatgttacagaagcagaatctaaggcaaatcacttactgaaggtcactgtggctgagaagcaggagtcagagctcaaaaacaggcatgtcagaccaaaattcttaagggctggaagcccagaaggcatcccccaggcatgcccagccacactggcctcttttctaaataggttgctgttgcagaaaggaattactcatttcaccctggggagggccccagcagacccaagcctgtgcaacattacagacttcgagtgtgctcttgtttgagacctgcgccttgagcaaactccaataacatgtttcggtggcttcaaaattgtcttttcggatgacagtgtgactgagctgttttgtcaataccagttctattttcctaaaattcacatttaatttgaagacatgggtactgtctcttgtttccttaggagcctgagcactatgcttctcactcccatgtattctctgcaatacatggcccttggctttcaggataaactaaagacctttattacccaatactgtgcctgttttattattttaaagaccctggtcatcaaaaactgtctagtcctggagagccaaaatgaatgatttatcccaacttaggataacttggccaggaacaggatatctctgagcatcaaagacccatgtgtttgacgttcttttttggactggggtttcagcctcggattttggcagaattggaggttgttatgacaggtgaaaaaaaatggcgttggttaaatatctttagatattatcgggagaagcagagtagaatctaggtacagagcttgacattttcattcccattctgtctgacccagagtgggaccataggcacgttacataacttctctgagcctgttcttttttatatgtgaggcttagagttgttgtgaaatcctaatacagtaatgtctatgaaggtcttagcacaatgacaaacacatagtaaacattctaccagatcgaccatcctaattatgaaataattacagtacccataatgagaaatcagagcggtctccttggttccgagttcttcattaaaaatgttttatccaggagaatacattcatcataagaattgtgaaatttcccgtttcaagtgccaaactaaaactccaattccgagatttattttaaaggtaattttgtatttaatgatttatagacaaatggttttcaatcactcatgttttagtacaaactatcagtacaagctgttcttggtctaagtctaggtcgtgggcaaacaaagtgagattcattagagaaggaaatgactgaagttttgtttttaagacccaaggacatcttgcttttgctaaatgaggaatgctcaggcatattctaagggtttgatttaatgtttccttagggggcttcactggcttatttccattgcaaatattagagccatctgacaagtttcatcgtgactttgtcctcatttggtgctttgtgcttattcacacctgtatttattgtcatcagtttacccactcaggatgactaagcagtctctatctttatttttggttaggtccttcaaacacccaaatccatcctttctgtagctcatagagactgctagacaaaggactgatgtaagtgtttgaaggacctaattccctctgcatagctgattgccccattaagcaattttattttatttatttatttatgtgagagaggggtctcactccatcacccaggctggagtgctatggcaccatcttagttcactgcagcctgaaactcctggggctccagtgatcctcctgcctcaatagcagggtactgagctcagtagctcagtactgcctcctgagtagctgggactacaggtgttttccagtgaacttagaaataggcattaatctattttgtgggcagtatttgggtcatgcattagtcaacagtcattttatgcccttaattcatggtcatatagtctttaggtgcatagtaagttcctatgaattccatgcaatttttgaattcaaggctggaaaaagaagttggctattctctgttgacagaagtttcaggaatggctcagccagaaccttgcaatgctagagctgggagagccaaagagttcatctacgctatcttctcgttgcacatatttaaaaagatcacataagttatgggttggaaacggaaggccaggcacagtggctcacatctgtaatcccagcactttgggaggccaaagcagatggatcacttgaggccagtgattcaagaccagcctggtcaacatggtgaaaccctgtctcgacacaaaaagtacaaaaattagccaggcgtggtggcgggcacttgtcatccccactgctcgggaggctgaggcagaagaattgcttgaacctgggaggcggagcttacagtgagctgagatcatgccaccacactccaccctgagtgacagaatcagactctgtctcaaaaacaacaacaacaagaagaaaaagaaaactcaaatactttcacatccaggcaagtaacatccatgcttagagagattaacttatgttggagacattggcaaaataaatttttagttttctccattaaggtaggcattacaaaattacaagcgtgatggtatgcaaccctttggtggggaccctgtagtaatttagcaaacaaatttcctgtccacaggatgtggtccctatccatccatccaatcattgctattttggattgttaaaccactattataatttcattgacatatttccactgcaaatgtttagatttctttcttcttaagaatagcagcaatttttatttttctgggttctcctgttcactactattttattcatttttgttatctgtccagcctctgaagatactgaatttacaacttctgacttaatcttggaaactcaagaggtgaatttaggctgggcatggtagctcacgcatgtaatcccagcactttgggaggctgagacgggcagatcacttgaggtcaggagttcgagaccagcctagtcaacctagtgaaaccccgtctctcctaaaaatacaaaaattagccaggcatggtggcgggcacctgtaatcccagctacttgggaggcggaggcaggagaatcacttgaatgcaggaggcggaggttgcagtgagctgagatcatgccactgcactctagcctggaaaacagagtcagactccatctcaaaaaaaaaaaaaaaagtgaatttaggaacctgaaccctttaagggagactgtatttcaggttcataaaagagacagcttggatgcttcagtgtgacagtgcagagattcatagaatgttagagcttgagatgactatcttatcttcctgcttcatttacgaatgatgctcaggttcagagacagaaagtgacctgcctgagtcacacagtgagtatcacagcagaacccaatgtaaggatgtcctaagagaaaactcccactgtaccatgcccttcctctgtccatctcctggattctacagccatttttaaaatacacatacccggggttatctctgcattgaaatagacaaagtcccaatgacactgcctttagaagcacgctgagctgtacactgtaagtctctgtttctctttgctatcctattttggttcctagccagaggtttcagccacaagtgggccttattctcacaaagacttccagacttcttaaaaaaaaaaaaaaagtcttcattttatctagttctctcctgctgctcctggtggttgtatcaatgggtctgtgtgaattcagcaatgtcatgcgttcctgccagctccagtcccaatcattacttctgggtcaggacactaaccagggggtctgggtttcttcctttgtatccccgaagaatgtggagcctgccaaattgtcaaattatagcatttgatgtagagctaggtccaagtgactgtacaatctctgcaggagttcagaagctggcttctgcccctggtagaaacataaccagactctcaagagacagtaagccagacagtctggagatccagggagatgctcatgggttctctggcttctgggccatggggagaaagtcatcaccacccagaaaataagccttcaccctgacagcagcagcagaatgtacctgggcttgaggacctgacttgcatgccatctcagtgtccttaggacagaagttccacgggcaagttctttcagcagtaaaccaaggttttcagcctgtaccactcaaaacaaaccagaccatcaggaccagttaatgtgaaggcttaaatgttgcagatttgttttgaaagtgaaaaggcaattttcttgtaaaaataaaaaaaaatatgtagagttgcaaatcatacaatccaaacaatatgggctgccctgatcttttaaaagggagaaatgtaaatgcccattctgattgtcagatgaggaacatcaaatagaaacttcttgggctgaaaggaagttacaaaagaggaagcagcgatcatttatggataacgtatggtaatgatcactagcatttagtgagctcatactgggtacccagtggaaatggtactaccagctttctgtggacaatcagattgaatttttacagcatccagaagaggcagggactataattaaccccttatggcctagatgagaaaaccagaacatagagaaatcaaggatgttgcccaaggtcacaaggctgataagggcagagatgggattcaaaggcagccacggtccactgtcttacccagtccatgctggggtcttccatgagccatgcactatgttgtgtatttcattgacataactcatcaagaaataggtgtgatcataccacgattacggatgagggaactgaggcacaggtatgaagcaaatgtaaacataggcctggcagattccaaaacccattttgtgtgattaccccgttagtagtttattttacctaaatgacattccctgctaactatttcaattatgataatatcattacaggcaaatatcttaacaatcctgcaagtctgtagagctctcaactccctcaatttatacaactaaacccacacacatccttcccatccctaacccatccccttccccagtggcatccagtggccccatagagtgaaagaggccttcataccatttggcaagctcacaagaggaagcctggatttcccagagaaacttgctacaaggaaattgctataattataacccaaattgtatttgacttctgcatttttgctttatattgttacactataatttaaatagattgttctctggccttttttagggggagaaactagctaccttttttttttttttcactaagaaaagcaacggtaggtgtagcattccaatgacaggaggtgggtttcgtcccccctcttccctctaattggcttgcaagtgggagttgggttagcagttatgccgggagttgcctggggttccaggcggtgacattcatctggtggctccacaaaaggggaagagacaacagtgggtggcgccagcttcggggagatgagccccagagagtttctgtgactccagaaggcagatgttggggacgaggggagatagggtatattaatcattggatttgggaatttttcctcttttgagacattgaagctcttgacagagaagaccagaggggacctaggaaaagggaggacgtgagttggatgcgcaccctggaatacagggcgttggccatctttctccttgcctagtctagctgtggatggggcccagagccccttagcagctcttccttttctctcttctctccagccttctccaggcttttaacatcagcagaagtagcaaggctaggagttggcaaactgtagctcgtgggccgattcctgcctgcgatgtttttgtcaataaagttttattggaacacagtcacactaactggttcacatattgcctatggctgcttttgcatgatgacagcaactttgagtaattgtgacagagctcgatggcccacagagccaaaattatgcttattgtttgaccctcaacagaaaaagtttggcaacccccgatctaggccaaagtgtacatattgttggcctgctggctgcattcaggcatcgggccattttattggactcacattaattaattgcctgcattgtaaaatggaagttttcacaaaataagctggctttgattaaaaaatggaaaaatctaacaaaacatggcagctaatgttggggatgtgtcatccgtcccctctgactatttgtcatagtcgccagcactgcctgtagggttttaccaagtgtacccttttacctgcatggactggtcctcataggcacttgagtatgatactctttcaggtcgtctgggttgtttttaataaaagatttggtatttcttactggactgatgaattacattttaaaaattctttccatcaaactggacttccctgtggaactccagaaagaaaatgaaaaatgtgtttgtgtaatgccagaatttagtgactgccagagttgttatatcagaaatacaacattttcttccaccttgaaacacccatacacatacacacagccctgcattttttaaaaaaaaaatcctttaaaattgagacctatgtcactgcagatgcttcttgacttatgatggggctatgtcccaataaatccatcacaagttgaaaatgcatttaatacacttcccctactgaacatcatcacttagcctagcacaacttaaagatacacagaacacttgtatgagcctacagatgggcaaaatcatctaacacaaagcctcttttatactgaagtgtcaaatatctcatgcactttattatgtactgtactgaaaggaaaaacagaatggttgtatgggcactcaaagcatgatttctactgaatgtgtattgtttccacatcattaagttgaaatatcgtaagttaggaatcatctgtactgaccttgatttaaacaaaagcaggattagtaaatactacattcttcttcagtcaaagaatgagtttctcagttgttattattaatagagcaagtaataatggtgttgggcaatatattaatgatttaagtcaattaattctaaaaccaatggtgggcgatgttacctcattttaaagataaggaaaagagactctaaacggttgtgtaaattgttccaaatagtggcaccaggaagtgatagacatggaactcagatccagccctgattcatgtcaaaggtcccaacgttttttttcttttttttttttttttggacatgcagtttcactcttgttgcccaggctggagtgcagtggctcgatctcggctcactgcagcctccacctcccaggttcaggcgattctcctgcctcagcctcctgaatagctgggattacaggcacccatcaccacacccagttaatttttttttttgtatttttagtagagatggggtttcaccatgttagccaggctggtctcgaactcctggcctcaggtgatccgcccgtctcagcctaccaaagtgctgggattacaggcatgaaccacagtgcacggccaccacagcaactctttaaacactgaggacacacaatagagccaatgattaactaaaataggcaactgatgcctttctctgaagcttacgtgtagaatacggtaagccccaggataacttcccctgtagctagaataactgatcccaggaagagcccctggaagcccgattcgatccactgaaagtcagttttgggtaaagtcgttagtgcgtcttctgttgttctcagcaaatcttcagacaattttttcaccaggctcagcagagggagaactaagtctaatgtatttagccgggggaatgacaggtttccttttcacagtaagggttcctaggataggagactatccactcgtagcagaagaaaatcctaatgagcaggatccaggttttagggggcccttaattctaacacacagttcaccctgggctgctcaaacgtcttgacttgccccgctatgtgtgtgtgtggctttaggaagccctgcgattttccttctttagctcgaatgtcaagcgctgcaggctttctgagaattcagtgtcctgacactggggctgagcccttggtaatgacactgtagacacgaggtaattacagctctgttaactcccaagtcaggctaagtggacctctgattattattctgagtataataggagcataactaacattgaagggaaattgtacttctctcttttattaaccgcttttatattcccttgtgcatggctatgatgctatgaaatctccttaaatgtgatattcctcaatataatacaataataatgcacacaccgtaatgtattggattactttgcaaacagcccttatgaaattgcatttcccatcatttccctgggccagctcagggctgctgggcttacgggccctttctgtagctgggagcctggaatctgccttcacggtcacttagggtttcatggatgtgagcaattggtccacaccatttttattcacagcgaggatgttggccaaccaagtttccagacatctcgctggacattgcgactcagagatgcaaacagtgtttgatacctcagcatagtttgaaaataaactgggctagatggtgtcaggaaggaagctagatacagggaagggaggccttccatgctggaattaaattgtgaagtcttttccactgactttgctggagagtctatcagatctttgttcctttgtaaactctttcctgacaccacctcaaaactagagttggttcttcctttgtatgttttatatgttttgaaaatccacccttagtttggcatcccaaaatacttactgaactcctactatgtatcacacatacattaatctactaaatacacatgaacaattttacaaccacttaaaatttaatatttggcataaagctataaactttttgagggtaccactgtgccttattcatcacttttattctcagtgttaggcaaagtgcctggaacaaagtagatactcaataattgtgtattgttcatttattcctgaatatttcttgggttcttactatttgagaggcgcagaactgggccttggagatacaagagtgaataagacagacatagcttctccttcaaggaatgtacagtctaccgtaacacagaatacacacacacgtcactcacacagttgaatgcagccagccatctgtatccaccaggttcgacatcccatggaaataagaaaacactgtttcttccatctgcaattggttgaatctgtggatgtggatctcgtggaaaggagagctgactgtaattacatttgcaaaaacttctgtgaaggaaaggtagagggtgatgtgcaaacaagcaacagggagacataaatcaaagcggagatgcattcaagacttccttaaagaagtgacttttaacatgaaaattagaggctgggcgcggtggctcatgcctgtattcccagtactttgggaggccaaggtgggtggatctcttgaggcaaggagttcaagaccagcctggccaaaatggtaaaaccctgtgtctactaaaaatacaaaaattagccaggtgtggtgctgcacacctgtaatctcagctactcaggaggctgagacaagagaatcgcttgaactcaggaggcggaggttgcagtgagccaagatggcaccactgcactccagcctgggcaacacagtgagacttcgtctcaaaaaaataataataattaataaataaaagaaagacatgcagagaaaggtgggtggatgtcctgggtaggacagacagcagatgtggaaacaagatgcaggggcgtgtggaagccagctcttaatggcctgtgattgtcgattgtatatgtctctttccaacaggacagggatgccatggtagtagcttgttacctccagggtgagagtatttacactatgggcattggcaatgctacagatgagggcttttctgtctgcttttctggagagctggttgttgatcagttaccagcactccagtgacagaaaggaagttggcatattcctgtgacaggatgaatatcagtgtagctgtgtggacgggcagggggatggtggcccaagttgaggataaacaggtgagcaagaaacactcatacagagccctgctggcctcatctgggggctttgtaccatgggaggccattgaaggattttaagcagaaagaatcccatcattaggtttgattttgggaatgatctgaccaccatgtggacagtggattggagaaaagcaataatggtgttgggaagtggcagaaaggactgccagtaagctcttgccatgggctggatgagagatgttgataggaactagaatggtctggaacatgggttggagtcaatatcaaatgaccaaataatctgccagagctctctgtaatatacagtattcacacctgtggacttttgtgacaatttgggacggtatagtcccttgtaatttaattctgagagtgaccattgaggatgtgatgatgctctctttacagtgaggaaactgaggcgtggtcagttgatgtgactcagtgtgttccctgaggtcatagctgaacaagtctgacttagtaatatgtctgactctagacctacacttataaccacaacttcacactctttttgctgccaccttcttctaaggggctggaagaatggagatgccactgagctgggggtgaagacatcgtaaaaagatctacctggttctatgagatgcatccatcctgaccttgccaagggaagtaggaatcaggaaatggtggcttctaacgtgatttcatccaggcccttatgcttgggtccatctcaggaatagtgtttggaattaacgcaggagccagagactaagcaaaccccgcctccaccccagtgcagatttcagttgaatgcagactagagcctttgaaaattatgcattggaaaacaattctggataaattaatttccatcatacataatgcatgaggggaaatccgtggtatttttaaacaatggaaatgagagaatctgccttttgggcattgatcccaattaaatttatttcagcaaacatttatcaacacctactgtgtgccaggttcttactggaaaacagagatgagtcagacattgtctgtgcccggaaagagtgagaaatcaatggaggtacccgcagagtgatcagctctgggttagaccttgagactgggagacaaagagttgtgagtattgccctggagggacatacatcctagtagaggagaacgaggacctgccagaagatctgagagtgagagtttgttgaggaaggctatctcgtgcctgggcttcacttgaatggttttctttcatgagtccttccgccatcaataagatccttatttaaagcctcctattgtccagcaatggtatgtgctgtccatctgccccattagcccatagctgctactattatgctacttttcctatggtgtccactgttattactgccacaactacctcaacttactgttgaggaaaatgtaattctcctcaacttctattactattatagtgttgctgttattttatttaatgatagatcatacattcgaaattatttgttgagtgcttactgtgtaactggcaccgaagattgaggaacagataaaaaatagctatggtttcttcgtttagaatgttatcttgtaggagagagagatggaaacaaataaacaatgtaactaaataattacaaattgtaatgtttgcttcagttatgcattgctgcctaacaaactaccccaaacaaacattttatttacttacaattctatgcttcaggtatttgggtgaagtttagctgtagagatcagcttggtacatataccacttggaactggggagtaagttccaaggtttcccacagatgtctggaacttggtgattgtctgtacaacacatctcctcccccgcacccccacccccaccccgccactcaatctctccacaagactagcttgagcttcctcacagcatggagttctatggtcaatgagactttcatatgggcatcatcttggcatgtacacacttcagtggtggctgaattcgaaaaaggtgtgtctcaagaaatgagagtagaagctgcatatctgataaagctcagccttggcatttgctatgtgctatgtctgcctcagtctgttgattaaaataaggtcatctcagattcaaggagaggggaaaagactccacctttgactaggagatatgacaaagaatgtgaaaccgtcttgagtccaccatgatactttttgaagaaaacacatattaggttgaaaaagagaagattaaggagggagggacatgagatcagggaagccttctctgaggaagggtcggttaagctgtgttctgaaggatgggagagtccagcaagagaagacagtgggagcagcattccaggaagagtgaagagtatgtgcaaagccaggtgtccctcatctctctctattcccagtgcagcttcctcaccactccccaaccaaataggagtctcttcttgtaggtggaacacgggataatataaagagcgtatttttgcacatctgagaagcccaggtgacatattgtccatgatctgaagcaacagataatgtgtttcctcatgtatttcccaatgggatcacccaaagtaacatgcttaaatggatgagttgtaatcttctacatagaggtgatgccaccaggcattggtgatccagataaatgaaatgcaggaataaggataccgagactgtttctggccacaaaggaccaggcagagtagtctattgcttggcgaccaagtgcatgatagcactgggcttcctgcttctgccctccccagtgaacttcagatgaggcttgggagatgaaagacgagagaggagtcattatcagaatggtaagaatatagcatccagatagatgagaagagacaaaaagataactccgtccccatactggcttatttctcctttatggagaaggcagccccttggaggtaggcatttcctgggttcaaatcccaacgttgccctttattcactgcatgactttgggaaagctattgaacctcactaagccctaaagcatagaaggtgccctataaattgtagctgccactacttctattattatcatgtatgtcattattgctactgctttgcagaaagacatgtgcctcattggtggtgggattcttctaacccccgtctcctcctttcaaaggctcactctgctactttagagttatcttttatagtgtactcccaagcttgcgatgttgcttccctgcctgtaccattttgttttctccagatctcgctgtttccctcgctggaaactccttggtctctgactgtagcaatatgtttaataactcaaggtacctgaaaataatgcaatatggcaccatgtcggcaatgtggctgagagagtggctcctgtacagattgcctgacttcacatccaggctccctcaggtgttacccatgcaagacttggcaagtaacacaactactctgtgttatttatcatcagttatacaattaggataattaaagtgtttgtcacagagggtagttatgaagacaacacatgtcaatgattgcagagttcttagcctggtgccaggtttatacaacacatctgatgatcactgactgctctgtctctgctgtctctatggttgttgtcatggacataaaagatgtccgtaaacctgctcatgatagtcatgacctcttcaggcttaaccgttagtacttctggttgtctcttcttgaatgagaaataaggagatcaataattaaacacctatgagattcttcaccgaagggagttcatgttgtcatcccagcactcatgctaggcttgtaggaatgtttctgttttgcagatttaagaaacctaaggctcagagaagtcttatcactttccttaaaccctaaactcctcatgtggccaaggctggattcatcccaacaccatttaccactaaaacctgtgtcttctagggaccttagtttgatgaccctggttaattcagtgcattgaaggtttagctctctcagaggttcaagtgagagacacattagatacctccctgcccaagacccagaatgtttccttttagaagcacccctaaccacacacctggaaatccaaggcttgtgcagtttatagacgctgcttttcgcccctgactgctgtatgtaccttgagcagcaagataattcactctaattactcagaatacatatttaaggacaagcacaaagaactcttagtgaggcttaaaaataagccattcagcaaaattgcacaaggtgcattccctcagaaggaagagtttattgcttctaaaagtgagtgtctaccctttgttggctgcaaatgtgaggcaaaggaccagctccacgtgaagcagcattttcctctttcagatttacctccagaaggagctccactgataggagattgctcctttctgctatgacatcttctgcgtcaaaggatctcattagtgtttgtttttatcaggtttttttttttcccgacttttatctcactcagagtgaattcagtgttcactgtcatttacaggataggaaatatatgtccgtttgcattgaaaatcctgcttattccatctagactgtcccagataccactgtattcatgtaggtttggtgttttgtctttcatctatttctgaaatcaaaattttgttaaaaatgtttcgggaaagctcaaaagaattggcccattggaatggagtgaatgcaggctttctccatgcaagcagccatgctttcctagtcattaaccacctgggccttgggcctgtcatgttttttgagtctctgtttcttcctctggcaaatgattttgatgggtgtcatgaggatgaagtgggatgatgtgaaggacttggggtgcttaagaaatctcccaggccattcacaagccacatgcctgcaaagaagtcttgggtgagcagatgccaagtttcccagcaaagagatttctaaggtgcagtgcttcagcttgacattagagagatggccttggccggcagctgaggttttccttctcttttgacctgagctgggaagaagtgtgggtactggcagctttcgtgggggtacctctaaaatagagcagcagttccctgttaggaatggcagatgagattgtgatgaatgcaacaagggctggagcacagaacattctgaacggactattactccctcaaccctatgggctacctgggccagagagatatacacagagaagactggtcaaaggggaaagaaaataattccttttaaatatctaggcaagcagccaacctcctctgatacagggacctgtgacaaagacagacttggagcatgtaacttgtgtttgaaagcatacgccagacccgtaacttcctcttgactttccaccccacctcttctggattacccgggtctgcaggtgaaattccagttgatttacccaaacgggtgcaagtgcagaggaaggagaacatggggaaagaggcaaaataaattttaaaaacagagagatagaaagaaagagaagacatgaagggcgaaggaaggggaaagagaaacagaaaaaggagatagaaatagagggatggggccgggtgcagtggctcacacctgtaatcccagcactttgggaggccaaggcgggtggatcacttgaagccaggagtttgagactagcctggccaacatggtgaaaccctgtctctactaaaaatgaaaaaaaaaaaaaaaaaaaaagccaggcatggtggcacgcacctgtaatcccagctactcgggtggctgaggcatgagaatcaattgaacctgggaggcaagactgtctgaggaaaaaaaaaatagaggaacagaggggagagagaaggagagggagaaagagggaaagggaaggatctagctaggcacacataattgttgtcttcctaaaaacaccaccaccaccccacacatacaaacaagaaaggcaagtgacattacaactataggtactgacatttgaggctgtgtggccctgtccaccgctctaggttgcatctcagtgaatgttccaggttctgaacaatcctataggtgggggaaagaggttaggtggaccaagcatggtactgtggcagcacctccttctcctactgtttctgcaccccgccatgcatttaaatcactcagggttggtgtttaacagacacaactcctgagctactgaatcaaagccttagggaatggccaatgggaatatggttttaacaagtattttaggcaagtcttacaaatctggcctgacacatgacttcacataaaggtttgagaactgagagtctcaccactcacatagaatgaagggtgtcagattctgggagatatttgagatctgatagaaattacaagacttttttacaggcctggtaatgatcatggagatgccagcagctatcactgccaaggactgggtgggttctaggcacctgtcccttgtaacacctgaattggaaaactcctggataaaggtgactttcccattttcagaggagacaatggaatctcagagaagttgaaatgtgtgtgtacccctgtggtgacacaactgattgaatccagtcttaggcatattaaaattgagaaccattgcttaaggatttcttaacagctgtattttattgagagtctgcaccatgctgggcagtatctgtgtgtgtgtgtgtgtgtgtgtgtgtgtgtgtgtgtgtgtgtgtgtgtgtgtttattttttatatatttatttttttcaaatggactctgttgtcaggctggagtgcagtggcacgatcttggctcactgcaacctctacctccttggttcaagtgattctcctgcctcactctcccgagtagctgggattataggcacgcaccaccacgcccagctaatttttgtatttttagtagagacagagtttcaccatgttggccaggatggtctcgatctcctaacttcatgacccacctgccttggtttcccaaagtgctgggattataggcgtaagccaccactcccagccatgtctgtgtattctaaggtgtttatttccatttgtcttcccaatgactttataaagtgagagagaatcctcattctatggagagggggaataagaccaggaaagcctgaattgaaaccaacgcttactcctaaagactgggctttgagttgctacattatatttcacacctctgtcctttggaggtgaaagttacttgatggtgatgtctttagggaaattatgacaaaggagaagtgaacgttggagtcaggtcattgtgtgtctgattacttactggctatgtcacctggtttataaaatgggcttgatttaatgtactgagtgaattagtgtccccccaaatttatgtccacttggaaccttaggaggagatctcatttgaaagtagagcctttgtagatataattaaattagatgaggttatactggattagggtgggccctgaattcaatgagtgttgtccttgtaagaaaaccatgtcaagacgcacaaaggtaagaagtccaaggggcatcaaagacagattggactaataccagggacaccaaggattgccaggagctaccaggatctaggaaagaagcaaggacggactctccttgagagccttcagatggagcatggtttaggcaacaccttgattttgaacttctggcctctggaactgtgagagattacctttcttttattttagtcacctagctggtcataatatgttatggcagtcctaggaaagtaatagcacatgagatattttttcttgtttgttgttgttgtttttgtttttgttttttcctttatagcacttattgtaactagtaattttctttgtttgcttaccaattctggacatactggaatgtcagcaccatactgcattttgttcatcatccccgtatctgtgatgcttcactccaatagcagctcagttacgatgtgtgaacggaatgtatgaatgaatgaatgagtgaacagagctgttgtgaggactaagccgagcagtacagtgaaattgcatcaaacagtgtctactaagagcaagcatgcagaataaaagctatcatgattatcattcgaggcaggaattatctttttttcctagggtccctctgccttgctgagcatcaaggtgaacttgagtagttactagttacgtggactgggagaacacggttaaagtaaaggttgtttttgtggagattgacaggcaagagcccctgcctttcctttcctgaaacagcagttttcctttgagacacgaagcccaccactgagagaggcagggtgcgggtcatgggggtggaggtggcggcattgtttgcaatcctcttggccccttgctcacagccaggcctctgcctttatattcttcggggggctttgatctcacctccctgtccaacagatgcacattagtcagtaattctaggagacatcaaaaccccagccctggcaccccccgaccttccctgcagccttcacaagccgctagctgtgttaataggcgccagacaggactgtgctatttcttagagcttaggtagaatgctactgcggctgttttactgaaccccagctcagtctccacttctttccacctctgacccagtacgtttagaattagagccaaatgctctgagtgaagagttgcccgacacggtgacttgatttacctaaggctgctatattctttccgaatgttctttccagacagaggtggagggcaaggaactgggtcccaggagctagaaaacgtggtcttgggtctcagctctgccattctgacactgaataaccatcatcaagtcacagacatcctcagagcctctgtctctgcatcgggggagcagaaccaggaatgctggtcctgcctacctgacagaactgttttgagagtcacgtgcaaaatcagatgtgagcatgccttagaaattggaaagtgtcgtaaaactagaagcacttattactattattctgtgactctgagcttataaaaaaaaaaaaaaaagaaaaagaaaatcaggccaggcacagtggctcatgtcagtaatcccagcactttgggggacagaggcaggtggatcacctgaggtcaggagttcgagaccagcctggccaacatggtgaaaccctgtctctactaaaaatataaaaatcagccaggcatggtggcacgggccagtaatcccaggtacttaggagcctgaggtgggagaatcgtttgaacccggagggtggaggttgcagtgagctgagatcacaccactgcactctagcctgggcaaaagggtaaaactccacctcaaaaaataaaataaaataaaataaaataaaataaaataaaataaaataaaataataaaataaaattggttacttaccttgtgtcagctgttgcagatcaagaaactaatacaacgcaatcccttatggtgtgcttaaacccatattcaatatagaaaatatagtatatccagataaataataataagcatagttatttcatcacctcgttgaccacctggttgtttatcttttgagaggctttgcaatgtttgacaaaaaattagaaaatagataaaaatgcaaagatgatacctgctatactgttttgtggatttctctttaacttaaaataccatacatacaattccgagtcattattcaatgactattcagattttaactttttgttttctctgatggcttctttgtgtctcattgcctgggatcatttggattggacatagtttatttagccaatcccttgtagttggacacttaaattttttcccatttttcactgtgacaaatatcaccttgatgaatttctttctgcaaatctctgcacactaccgtgattgtttctgtaggataaattcccacaagtagaacttctgggtcaaagagtaaaaatgcacattttttaaggcttttgatagtcagataaaactaaaacaaaatcaccctctagaaagatcataccaatttaaactcccaccaagactgcacggcagtgtcctgtctcctgcactcacaccagtatcaagcattatctcagagtgatttaaaatgcctgaagaaaggagtgataatggtttctaaacagcactggctaacgcacagccctgcatattggctttcagcttgataaatactttcttataaggccataaatattggtggtaccaaaggttaacgtagtgtgcaatgctgtaaaatccagcaggcaacctgctagctcataatgatgcattagcacctttcgatatgaagtgtgatgacttacaaagtctgtttgtaagtggccactaactcaacaagtgtataattgtgtcagttggcaccacagtttctgcaaacataatttattaagtgagcaccttgccttctgttatatgccaaaaatgagaagaaaagacaagagaaggggaaagaagaaaatgatcatctgactggggcatttagtcccttctgcaagctagggttacttaaaagaccaacatactttattgaagaaaaaacaaagcaaataatcctttccatattttaatagtcagttgaccacactgctggcagtgttagaatcaggattgaggcaggcatgacaaatagctgcaccattaaaaggcatgtgcatttgcaaattagacttttaaatattttattttcgtgtttttaagtttgcaactcaggcaccttgctcctaccattttatttttgcaggtggaaacagttgtatagttctttgctattgttctgggatgggctagcatgaaggtgaaacctgttttgtgattaatgaacatggaggttgtgtgtatttaacagcagaagagtaatctatcctgataggagacaaaacagaatggataccaccagccgtgttcccgtttggctttgctccttggtaatggaggaaatccaggtattaaggatagactttagtaggcccatctcagcatttgcccgtgtgtagtgcctgttttggattgctgtaaagaggacactctgtaaacagaaaataagctagacaggcacattttgagctacttattctgttcattttcagtgactgttcaccctgtgcaatattttgaaacaaaccgaggagttattcacgtcatattctttcttactcgtttttcatattttatttttacttttgagacagagagtcccatctgtcacccaggctggagtacagtggtgtgatcttggctcactgcaatctctgactcctgggttcacgtgcctcctgaatagctggaactacaggtgcctgccactatgtccggctaatttttgtagttttagtagagacagggtttcaccatattggctaggctggtcttgaactcccaacctcaggtgatccaccggctgcgccacccaaagtgctgggattacaggtatgagccactgcgcctggcctcgtattagttgttctttaaacatttacatttgacactgagcactgggaatacagaggtgaatggcacctactccatccctcaaggaactcatcctagtctagagctgtgaaccaatgcaaggggcaaatgcacacacatgcggttgcacggatgagcaggatgctctggggcaggagcgggggggcagtcaaacaagtccaaagcttctcgcctccagccagtttcggctgctgttcacccatatctcccatcgcctgggagcaaagacagctttgctcagagttttcttctccacttgaggccgccatgtttgcctctgtctggagttgtcagcctggctactgactggtagaaatcagagaggaaattccaggcatgatggcatgttcctgcctattagttagggacccacttcattatgaatgacatagtcactatgaagacctgacctctctggcttctggaagaatgttgaacatgcagaccaaggaaaagccaccatcccagagctcacattccagggatccgaagaaacacatcagagtaatggctagcccagatggtgataggagagaaacagagaagagggtggacaggaaggactttctgaagaggcgacatttaagccgatgactaagtatgaggaggatccagtctggtaaacagtggaaggcagaggttccagagagaagagctggcatatgccaaggccttgaggtgggaaacaccctcgaaatatttacagagtggaagtagctcccaatgcctatgacttcactagcccccaatttggaacaaccattatggctgctgaatgctgtaggactgtgaataagcaaagaagtgtttgaaatgaggttataaaggtaggtagggccatgcaaaccaggtgaggagtttaggtgtaattctaggtgcaagaggaagccactagaaagttttgaagcatgaagagtacctgtattacggttctctaaagggacagaactaataggatagatgtatatataagggggagtttataaaggagaattgactcacgtgattacaataggtcgtctgcaagctgaagagcaaggaagccagtccgagtcctagagcctcaaaagtagggaagctgacagtgaaaccttcagtctgtggttgaaggtccaagagtccaaaagctgaagaacctggagtctgttgttcaagggcaggaagcatgcagcatgggagaaagatgtaagccggaagactgggccagtttagtctttccaccttcttctgcctgcctttattctggccacgctgaccactgattagatttgtgtccactcagattgtacgtgggtctgcctttcccagtccactgactcaatgataatcttcttcggaaacaccctcacggacacacgcaggagcagtactttgcctccttcagtccaatcacgttgacaatattaaccatcatcatatccttctctttttctttttcttttatttttttagagacagggttttactctgtcacttaggcaggagtgcagtggtgtgatcatagctcactgcagccttgtcctcctgggctcaagcgattgtcccacctcagcctccctagtagctgggaacacaggcacacaacaccatgcctggctaattttttaattttttatagagatggaggtctttctatgttgcccaggctggtctcaaacttctggcctcaggcaattctccctcctcggcctcccgaagcactggaatgccactatgcccagcctacccttctcctgagtgagttcctccagagtcttttttttttttggctgggctgggaaatacccttgagttccggagaagggaagtggtttctggaatcctctgcccgtgaaggttaatttggcaatatgcatatctgctctggggctatagaggcagctgtgacgatgcccagagggggacctttatgatctgagagcccgtggaatgtttgtagcagcagagccgtgttgtcccattgaatgtctcttccatttttaatgaggagcctgggggcactgtatcaataaaacgaccaaattattaaattatcactctacagggcatcttatattagtcctaattaaatgatgcttttcatattaacaaacagtgctcaaaaaggattctcatttttaattcggacctcattgaaataggaagccttagaaatttctagaataggtactatgcctctggacgaatatgcaccatgtctctggactcactggagggcacctacagtgagttttcagacactgccctgaattttaaaaatcctcagtatccacaatgactacctgtcttcacccagactcagaaatgctaatgggggtcaggtgcagtgactcactcccataatccgaacgctttgagaggccgaggcaggcggatcacttgaggtcaggagtttcagaccagcctggccaacatggtgaaaccccagttctactaaaaatacaaaaattagccgggcatggtggcgggtacctgtaatcccagctactcaggaggctgaggcgggaaaatcacttgaacccaggaggcggaggttgcagtgagctgagattgtgccatcacactccagcctgggcaacaagagcgagactcaaaaaaaaaaaaaaaaagaaaaaaaaagaatatttacaggacttctgctttcgccacgatagagtaacagggactggtgtgcaccgctgccttaaagaacttttaaaaaggtcagtctcagaaattgccactaaagaattttttccatgcaaccaaccaccacttgtcccccagaaacaactaaagtttagaaaaaagtcaccatacaagcaacagtgatttcagacgttagacagcatgaggcatccacagaggggaagcagatgagatgtaccctccaggggccccagctcactgccttgagagggtctctaagccataggacaaggggtgggggcccaaataaggaatatttggggcgcacttgctgggtgaaagccatgagacactggagagacagtagtgatccagtcagccaatagctctgtgctactgagctgacattgttttgagggaaatggtcaataagtgagcaaataaatgggggtggtttcagaatgtgagaaatgttacaaagaactaaaaagggtaatgcagtggaatactgtgacctggaggagcaggtaggagttactctagctggttcagtggcatgcaggaagctgctggaataggctgccaagggccaattatgagcattactagccaaatctgtgttccatgagatcccactggtagcttgaaataggccatgatgtcaatatttacaccacagacattggcggtgtttttcttttttctttttccaacatactacggatggtatggccaagataggtttcataaagaagtgcacatttctgtatgacattaggataaagaacagcccatcatttatgtgacaaaccctaggaggaatattccagcagaagaaatagcatgtgcaaaggccgtgtgtccacatcctccatttcttcattctctatgatgttcagggcaggtatttttacccctccccacaattgtataaggagattttcattgtcacgtgtgtcagtcattttatctcattctctccaccacccgtttttaattcccatgttggtacagtagagaatatctttatccagttatccttccttcatccttagattttgtttcctgatttctctttccttgtacttcttttttcatagaattttacaacttgttttcaggtatgcttctttatttccatgtctatgagagctttgatcagcagctatagtttcttatgtaatccatagactccatcaatttcttttatagtgagaggcgacaggatactcattttacatctagaggcaaagtacttcagcactggaaggtgaaaagacttcagaagaccttttctggaagccttttctttagcagcagggtgtcttcagagaagttgcagagttgagtctaatggaacggcctgaatgaccactgggtcaatgttaattgataatgatgctttctaaggcgagatctgaactgaacctcaactcaattcttaatatgtgcggcagaagcaaaaacaagaaatccatagttcatgaccctataagatttatgtctaaagcatttccgacacccattctttgttgtgaacgactaatttgccactcttgtttttctttctttttttgcaatggagtgttactctgttgctcaggccgaagtgcaatggcgtgatctcagctcactgcaacctctgcctcccaggctcaagagattctcctgcctcagactctcgagtagctgggattacagtttcctgccacaacccccggctaatttttgtgtttttagtagagatggggtttcaccatattggccaggctggtctcaaactgccgacctcaggtgatctgcccgcctcggactcccaaagcactgggattacaggtgtgagccactgagaccggcctaatttgacactcttaagcataccttctctttcctctcagtaagcaagtcagatatttcaggagaaacaaggtatgtgctccttccttctttcattccttccctccttccttttttccccttcctttttaaaaaattttccagtttccacattttaaaattttatttctttctctttttagagacagggtctttctctgtctcccagactggagtgcagtggtgcaatcatagctcacttcagcctcaacctcctgggctcaaattatcttcccaggtcagcctctagagtagctggggctacaggtgcccaccaccacaccccctaatttttaaaattttctgtagagatgggatctcccagtgttgctcaggctggtctcaaactcctggccccaagtgatcctctagcattggtcttccaaagcactgggattacaggcatgaggtgccacacccagcccagtatctacaattttaaaagtggtatacatagcctaagatcttccataacaattaaaaatgagtgtcagacatgcaggactatcaggcactactgaacattgctgaatactcacaagagaagggggatacatatggcaaaatttcaaactcaaatgaagatctgcaagtggccagtgcacttgaaaggtgcacaactcatttcagaaggcactgctcagcattaccaagatgcagctgtgtcctaacccccagctacaagggagtgtttactgtaggttagagttagctgactcagtccatatgttagggtaatcacaacccaattttgatgaactcataaaccaaggaggctgttgctggagctaagaagagacaagatttttagtagatagtgacatttaacctcagctaagtctaggctgtcagcctggcaggtctttttgaagagctaagttctgcttaaaagccattagtgtatgtcaggctctatacattaggattaaagaatgtaagaaggccaggcccagtggctcacacttgtaacccaagcactttgggaggctgcagtgaggggatcgcttgagcccaggaggtcgaggctgcagcgaactatgatcggaacactgcactccagcctgggtgaaagagcaagatcctgtctcaaaaaagaagacaatgacccagatcctattctctcagagcccaaagcttagttgggctgatgggaaaactaacagtttcaatttaatgtgtgtattctaggatcgagctaggggaacaaagagtagcaggcaaaggaatgcacagaaatatttagtcatagcaggaaccgttcttcaactatcttccaaggactgtgctaaatactttccatgcattattttatccttacagcaatcctgtgttttatatacttttaggtaaaagtccattttagtcattagcaacctgagcacagagaggtcagttaacatactcaaggttgcactgcatgtggtaaagagctgaacagagaaaaccaaattcccaagttcagcctgagtcgtgtagactaagtgttagttggagtaaacagacttagcttctctagatctgcttcctatcagaaatgtggagatgttcaaagtcagctgcttacctttagaattgccatgaagtgaacaccagtgaattcagattagttgagcactttgagcctctaacctttttttttttaatttttttatttttaagcaccctacacctataacttaactattcccaatttggaaaaaaattttatgagtgctgtgcactctttttttcttcttcttctacaaagccaagtgcacgacatcaaacctgtaatcttggccacattatcaccatgttctaaccaagcaagcttattagttcagacaattaagaaaatagaagttgaaaatacttagctattagggagaacggagtaacataaatccaaggtgttgggacaattagcattcgtagtaataaaagccaagtagaacactaaggaaatgaatattatgtttattatttagcatttaggtagtattgcatatttataaaatacctggtaattgtttttggtcatttctttcagaataaatcggataaagggtatttgctattgttgtgagtagggtaagggggggtttttagtagaagcccattaaattacaatgcatctccccaccctcttaccctcaactcagatttaagtacagaaagaaaacattcagaaatcttgctgaaacagaaatcatttcacttttctcctttgttaaaagccttctgatgactcccccatttctgttgcagcaaaaggcaaaatcctgtaaatgcaacttgatgtcctagaatggattctggaacagaaaaaggacataagtagaaaggctgtggaaatttcagtaaaatccatggtttagttaatagacaccagtgttaccttcctcgttctgataaatgcacgtagttgggtaagatgttagtgttagaggaagcggggaaaaggatataagaggaccctgtgtactatctttgcaacttttttgtaaatctaaagttattcaaaaagttaaaaaagattttttgtttaaagctaaagttcttagagcagactacaaagacctgcgtgacctgtttctgtgccctcgtcaggtctctgacgtcatctccttttctcttccccttgaacgttctgtaccagcctcacgcttcatcactttctcaccgcaggacctttgcactggctgtgtctgggactgggctattattgcctgagctctccctgtggcccactcttctttgtcaaattgtgattcaaatgtcaccttcataaaagccatccattgaaaatgtcaagcctacctccacggtcccttcctcctgctcagtatttatctcatggtgcctatgcttccaacatgctctgcaatgctctgattgattaggttatgcttcatcttcctcctgctctcctaaaacttacgttccttgagaggagggattttttcctgttttctccacgatgcatttccaacacctggaattgcatacttagtgcttaatggatattagttgaacctaaatattaaattttatactacaagaaagtaaccctaactctgaatgctttgataaccaaggcattgtggtaaacactctaaattttctagatcttgtggcatcttcatgatagcttaaaatttgagtatcatgaccaccatttataaggccctgagaagtcttaagttttgcacaacatgacgcagctcttcggtcaaatctgagagcccagattcgaacttgcatctcccaacactacagctagttctgtttcttgtacaccagattgtctgctagatttgcatgcttcccctccatttcattaaaccacggcacatgaagaaatagcattactcatcaagtcagtagttgtttgagtaactcagatccctttcttagatgatggtacccaagataaatgtatggaacatattatttcccatgatggccacaggtaactctggaatattataaggtttatttgtataagcaactcagtatgaaacttttaccttgaatttccccttcatgggcctatctttgttttcattttcaacattctcttttggatacagagtttcattcacctaagaaagcttcatgacattagtggaaaggcactggttcagttctaagaccttagttctaggacccactctcctatctgctagctatatggaccccttcttaggctttaatttcctcatctataaaatgggcataattttaccaccaacttcatagaggtatcatggggataaatggtataacccatgtgcaatggtatgcactgctgttattgtttgaaaataattctttgttgaatcagatataaaggttgttattgttgttttctgaaaccgacttagtttaaaattactaagtcattttaatatctatcaaccatttccatagtttctaaggatttctcccaaatgcctctgttaacaacaacgacatcctcctcctcatcatatggatatcatgaaacaccaattatatcaattattgaacagttatttggagtcaggcttgatacagtctttgtaatgttgttttattttttgctgtgagtccacagagcgagtattataaacccattttacagatgagggaactgaggtaccatggaggtgaagtaatttgcctactgtcacgtgctactcatggggccgggtctcgaacccaggtgtttcttcctatagctgagggcttcatcagtacttagcacagctttattgccaaagagaattgtaaagcaactggaaaaatgaccaaaatacaatacctccaatgactatttttaaaaaaacaaaaaacagccgggtgtggtggctttcacctgtaatcccagcactttgggaggccaacgtgggcggatcacttgagatcaagaattccagaccagcctgaccaacatgttgaaaccccgactttactaaaaatataaaaattagccaggcatggtggtgggtgcctgtaatcccacctactcgagaggctgaggcaggagagtcacttgaacctgggaggcagaggtttcagtgagccaagactgtaccactgcactccagcctgggagacaaagttagactctgtctcaaaaaaaaaaaaaaaaaaaaaaagaaaaagaaaaaaaaaaagcattttcttaaactgtggcccagaaagcacttttatattagaattacctgatgcgcttgttacaaacacatattgctggctgtaatcagtgaagtgctagtaaatgcttaacaactagcttggtgggggaaggagcgggagagggctccagagactgatctgaagcatttgccaatttccatggtgcaaatactcccatcatggccattgcaagataccaatgcctcgtcactgaacacagagttaggaaaaaatatgcagaagtggaccatcacgcagtatttccaccatccagatactctaaacaaacaaacaaaaaacctcaagagcacagataatattcaagtatggtaaaataatttaatattcaaaactcattatttcttattaatttttaatatactttattgaggccaggcatggtagctcacgcctgtaattccagcactttggggggccgaggtggtagatcactggaacccaggagttcaagatcaccctgggaaacatggcaaaactccatatccactaaaaatacaaaaattagctgggtatgttggtgcacacctgtagtcctaggtactcgagaggctgaggtgggaggatcacttgagcctgggaggtcgcggctgcagtgagccatgattgtgccattgcactctagcctttgtgacaaagtgaggctctgtctcaaaataagacatacatatatatatacacgcgcacacactcacacacatatatatttatgctatatatgtataattatactgtatgtatatatcaatatgaatatatacatgtatagtacataaatacatgtgtacacatattttcgtatatgtatatacatatacaacatatattaatatgtatatacatatactttcttactatatatgctttaattatgggcttatgtcatttcattttttattaaaggttgtgtttaacaacagagtcacagaattcctgacaagttagcaactggctttcagaaatcagtatcaacaaacttcaacagtccaccagctaccccaggctgacaaaatcagcaccgaaaaggctggagccctggaatgtgcatttctaaagagcatccaactgcttctggtgcacactcaaagtattgagccaatgccataagcctttctgagagcacttgtgaaataagtatatgaaaatactatataatgtggtaagcatctgaaaaatgtagatgggattcatattcctagcaaatgctagtgggcatttatgctaaatgaaccccactgttactcttttgaagatttttttccctacttttaaaatggcataaaattattttatagttttattttattttacccatcaatgaagagtgcctggtctctgttaaaggagaaggtagtaatcctatttcccttgcagccagcataggagaaaggttcagaggcctttcctgaaaggtttaggcaaagataacaaaatgtcagagaaagctgcagggcagggctgaatggaaaagtaggtttgtaatctcaaattcaatataaaagatcgaaagtatcaaatagtcagtggtgagcctctccatcagaatgttatatctgccatgaaattctgctttatgattgtattacgttatatacattatacatctctttctctcagtctctctctttctcacctagtctctctttctccctctcttcctttatatattctcatagaaactagggcacatctgagatccataaggaagtcttgcttgactccagtcagagaaaccattggaaacatcacctgcctccaaccccaaccccatctgccttaaaaatataaaagtctttctttttaggtggaggttttgattcagggaaaacacaggccttgcaaattaagagcagcccaagaattgtgtgcaaaccctgatacacgagacacccaatccaaggcttgcactctgtcctctaaacagtgattgtgctttccaaggtggatatggagggtaattaagaatgaattttcatgacttgtgtctactgtgtgcccacacagtgccagaagccagagtaagaactttgcgggcctttcgcttttcatctaccctccttagtctttggttcttatccaggcacttaggagtttctcaatcagtattctttgaatgaatgaattcacaaatccccattttaaggctgtgggaagaaaggcctttagggatgaagtaacatgtccaaggtcaaatagttgtctttggtcaactgttggtcaaatgctacacaattacaggattgcctccctaaggtatagacagtggctgttaaaagaatggatcctatttgtcacctgtgaaggttattttaaaagatttatcttgagtgcataggagtatgaatgggtcactctgggatggggcccagaaatctgggtgttccacacccttacccaggtgacttagagacattcagcaggctgtacctggagaaagaccagtgcgattcatgtaaatctctctacatctccaaccagaggcaaacctgtcaacttttctggctgcaaaatctgcaccttgctaaaggctgtcaagaaccccctatggggggtggacttcttggcttacccaccctccctacatctctgatccttgcatttttagacgtgacaggtgcctgcaaggccaccaaatttcatgtcttcagtttattcagctgcaaaaaatttcatttcagaaacatgacacaatgagaaactgacaaaaggtgggcttgaattcaagtctcctaaatgaaagtacccccagtgactaaaagtcttgttgctgctccggatttcacattgtcatcctgcggtgggaacatatcttgcatttttatgtagagtatcaaaaaaaaaaaaaagcaaaaattgttttttggaacagccaaagcgtgtcctggagcataatctaatttgtttctctatggcccaagaaaagagggggcgagtgtcatccttcctttttcataaattgagattcagaaagggcgagtgactttctcagtcacacagcatcatgtctaccacccaagtctcacccgcttctcattggagccacaaatgacataattagatgagagatgatcccaagactagcggatgtttccctttcttcattttaagagtttggacttttttaggggacctaaacatttgctcctgagctctgctaatgtgtgactgctgagtttttctggatgaataagacttttttcaagaaatttcacatattcccgtctggccgaattatgtatccaaatgtttttccatcagagaactcatccgttgtcctgtgactgtgtggtttattcatttctcctccacaaagctaggagctccctactggttcaggttatgtcttcttcatccttcagtccccatatgtagcaaatgttctttatacaagcagatcttaaaatggtagctgagttgaacagtgtagacacagagtatttgtccctctaagaaccaacatgggaatccatggagctcagaccaaatccagcccactgtctctgcttttacaaataaagttttatcaaaacacagccacattcatggttcatttgtttacatattaccccatggatgcttttatgtacagcatggcttatgatgcccaactattcactctatggccctttaaagaaaaagcatgctatccccatctagatgaagagacaagtagaaaggagatgcaggcatttctattttcagagtatatttcttagcatttccatttccgaacatatatttactctccttcccacctgccaatgcaggagaaattagcctactgagaaactccgaaatatcctgactagtgtcaatttgcagaaattgtgcagtttatgtgacaggattctttcactgtcaaatttttgttcagagacatatcggtgttcacaaagaatgatatctccatgtctcagcatatcctggaaaaaccccagtagtcctagaacaaaactcttggagtgcttgtctctttgtttgaagcatttatattaatacaaagaaagaagtaattagccaggaaaacccagggatgttcagggagatcagtgccatcttaaattcatcacccattttctgcaactgaattgtgctttcagcagttttcttaggtctgggaaattagcataacgtatagaattgccatttggttcatttaaatcttgcataatatattaggggggaaatctttgagctaagtggaatttaggatttagtaccaaatacgaacttttgtgttaaattgatgtataggttggccttgatttctgagtgggacaggtaattaaagaaaaccaggaggttaagaggagatgaggaaaaaaaaaatactgcaggaggaaaaggttggaggcgtcagccagaaagggaggctgctggaagattgctaagctagagaacaatgcagctcatttttatgagaccattaacacagaagacagtggcaacaatcttgggagtatttgacatgttcccaaaattagttgggtgcgggatgtcatggcacagagctgtgtacctgctttttatctggggatttataaaagtggagccttgctggtgtcgtccaaaacagcaggatgggaaagagctgttggtgagaatgcattagggtacctgccgcctgttccctgtagttcctctggctcttgaaagagcctgaagttacagaagagggcaggagttctaagggtgtccaggaggccaaatgctgaaggagaggaccctcatctgaaaggagagttggaagcaatgaccattggcaacagccttgaagacacgagaccctgggcaactatggagaatgacagaggatggctgatcagtgccccaagtaacctaggaatgtggactccacagccccaccacatccatggaagccaccagtggcacctgagccccagcagaatgagatgggaggcaaaaagaggcacttctcatcaccaggatgcatttgatttcattagctgccttctgcctcctaggttccttctcttcagcccccagtcttgaaagaagcttcttccccagtgggggaaggaggaggaaggtcccagaggttgcacctcatcccactgatcctacaaactgctggagagtttggagccaacaggcaagaaacactctatgcccactgtaggtatactggaccacagatgtgtagcaagaggaagagagttttaatctcattgattttggaagctttaaagtggactggcctgagttttaacaaccaagtgccccgagagctgttgcatcttctttagatgccattaagggacttgacccaggggattgcaatgccagggctctaagccactgtgccacactgcctcccatgtagggactaaacatcccaaagaagctctgaggccctctgaacctcaatttctttgccgtaagatgggcacaatattagaatcctcttgtctgagtcatcagacaatgtgaagagattaatagaatgctaatcactcaaccaggatttattaaatggcaatgaagtattaatcagccactcttctcgatgctggttattataataatcatggtccatcctaagcacttacaggtgttgactcatttggggtagatgccaatagtattcctattttctagataaaggtaatgagacagagaggttaagtaacctgctgcagttcacacagataggaagcagtgaagctggaattcaaatctagataattgtgtttcgaagtctataaatgtgtcttgttgttattgctattgttatatatatacatgtttttttcttttcttgcttcaaacaaagtcttacactgttgcccaggctggagtgcaatggcacgatctctgctcactgcaacctctgcctcccgggttcaggcaattctcctgcctcagcctccatagcagctgggactacaggcacacaccaccacacttggctaattttttgtacttttagtagagacgggggtttcactatgttggccagactggtctccaactcctgacctcgtgatccacccacctcggcctcccaaagtgctgggattacagggctgagccaccgcacccactctattatatattttaactacctatcctggaaccaaaagccaaatctttgcaacaagaagaggagaagaaagagtgctttttgtagtcttgtcattccactttctgataagcagacaccaacctccaaccctgcccactgtaccaccggggcctgatgtatagtaggtgctcagtaaatatattttgaatgattggataactgagcacctgatttcaagcccccaggacaaacaatgcttctttaagtgcaggtgtttgtaggcgctgcctcagtaacacagctgtggactgaattgtgtcccctactccaggtcatatgttgaagctgtaaccaccaaagggatggtgtttggaaatggggactttggaaggtaattaggttaatttaaggccacgagagtagagcccgatgagacagtatccatacaggaggcagagatatcagagcttccctccctcttccatctgagaacacagaaaaaaggcactcaagccgggcgtggtggctcacccctgtaatcccagcactttgggacgcagaggtgggtagatcgcgaggtcaggagttcaagaccagagtggccaacatgttgaaacctcctctctactaaaaatacaaaaattagctgggcgtggtggcaccagacacctgtaatctcaagtactcaggaggctgaggcaggggaattgcttgatcctgggaggcggagcttgcactcagccgagattgcacctctgcactccagcctggctgacagagcaagactccatctcaaaaaaaaaaaaaaaaaaaaaaaaaaaaggcactcatctgcaagccaggaagagggcccttcccaggagctgagttggctggcactttgatcctgcactaccagcctccagaactgtaagaaataaatgtctgttgtttaaaccacccagcctgtggtattttgttataacagcctgagaagactaatacagacacctagacaaggctgtctcctttactgatgtgttaaacacctggccccttgtacattcatcctatttttttcccaaggaataaaaatagcaaaggaattcggagtcagcccttctctgtcctccagcccttctcctttcagaggaatttcatcactggagcagagcattgaattcattcgagttgcagggaaatgtgatgtatttcttaaatctgtgtcacctggccgtggaatcagcccagccaggctcgaaatgaggcattaactacatccaaagctgtgtgattaacttatttgtttgccgacggagctcaaatgaaaaagcaggaagctgggaggatctgcacgagccccgttttgaagtaggattgtgagaagacccgaagtgtgggttttagttcacattccctgggcttaccattattattacttttaatggaaaataacttttcacaatcttgcttcgttttaaatggagaatgtgcaatattgtctaatttagggtgtggagttgatctggtatgcatgatttttcttcccccgcccgccaccatccttggattctttgtacacattcaatatagttacatttttgcttagaacatatatattttcccccgaacttttctcgattgcttttttatcaggtttacaaatcaaatcaaataggtatattgcagagctctgcgatattattttctgagcttacagtacaatgtattgaattatgccagcccatgctctgccctgctattctctgcagactgagagagggggaccgtggaccctgtaaattcactcggcgcccagcattactggctaaatcaagaccgctcttcagtctgcaagaagagacagagcaagtgttcgttacacaaatcaatttggtccaaagtacttcgcagtgggtactcaaccatcgctcacataatattgtcaacttaatcaaataatgcctcgaagacactcagaagcttttctctctgagaaataacttgattggtggaggatggagcagcagctggctcttcaaagtacactttttatttatcactgtgaagagttttgtgcatggaggggaggaagcctgtaggaaaggaaagaggctgaatagtcagtaggctgactgtggggagaatcatgcagcattcatgtcgtgtcttgggtgctgggtttctacaccgtgatggtgaatttggggatgctcgtggatgaagcagcagctgggcccaaatcattagtttcctggaatgattcaggaaagacttgccgagcgcctactatgtgtcatggtaaggggcttttgatatagtgcatctgatacagtgtttatccacgggacgctcatattctaggaagcatttgatatggtgtttagtcatggggtgctcatattctcgtaagcatttgatagagtgtttatccataggatgcttattctaataagaaaacctgtcagtgagggcttaacagaggtcaacccaggactctagtagttcaaaccacacagctgaagcagcctgcttttgattgctttttaattggttggatgagctagggcctcattcacccacctcactgctctgtttccagcccagacctagaacataggcagttagggtttctgtgaatctttactcctgtctatatgtactttgcagctgctctacgtgcctgctcttagactttccagagcattttcaccttgaccttgaaaggccattcaggagcgaaaagagtttaggatacggaattagatatcctaagttcaaaccttccatctcctggctgtgtgacttcggacagatcgcctaacctctctgagcctcagttttcctagttgttatggcgactcggtaaaataaggcatggaaaacaccagtgagatgcttagctcatggtgggacctcagcacagttttcttttccatcctgtatcccagaccatttagccagtttcacattttgcttataaactacgagtggcattcagcatcagtgatagccggaatcctttgtcttaactcaggataggggagaagcaaaagccttcctcagtgatccttttccacatccaagggtgtctatgtatcctccagggagcttgtgaactttctgaaatcgtatgcaaaatttaggtgtatgtgtattttccccccaaaaggtggtccacagttttcataaaaccttcagtgtatccatgaacaaagaaatcgattaagaaacatgtatttacagagtaaagggaaataccacccaaaaataatggtatcaacaaaagtcacagctgacagctactgctaatggaactgactgcctgagcgacccactctataattaaagctggatatatatatatctccctatatatgtatatccatatatatctccctatatatgtatatccatatatatccctatatatatatccatatatatatccctatataaatatccatatatatatccctatataaatatccatatatatatccctatatatatatccatatatccctatatatatatatccctatatatatatccctatatatccttatatatggccctatatatatatatatatatctccctatatatggccctatatatatatccctatatatggccctatatatatatccctatgtatggccctatatatatatatccctatatatatatccctatgtatggccctatatatatatatccctatgtatggccctatatatatatccctatgtatggccctatatgtatatccctatgtatggccctatatatatatccctatgtatggccctatatgtatatccctatatatggccctatatatatatatccctatatatggccctatatatatatccctttatatggccctatatatatatatatatccctatatatggccctatatatatatatccctatatatggccctatatagatatatatccctatatataatccctatatatatatatccctatatataatccctatatatatccatataaccctatatatatccctctctatatatatccatatgtatacctatatatatccccatatatatacctatatatatccccatatatatacctatatatatccatatatatacctctctatatatgcatatgtatacctatgtatatatatatatccatatatatgtatggatacctaaaattaaagctggatattttttacagtattgcccaagaaaaaacattaaaatgccaaatttatttcatttaaaaatagatgtatttgaaacttagttgactcaataatattcctcatttcaaaggattctattgctactggaaaggggtcctgatccagacaccaagaaagggttctaggatctcacacaaaaagaattcgaggtgaatccatcaagtgaagtaaaaataagtttattagagaagtaaagaaacaaaagaatggctactccataggtagagcagccctgagggctgctggttgcctgtttttatgattatttcttgattatgtattaaacaaggggtggattattcatgagttttctgggaaagggttgggcaattcccagaacttagggttcctccctcttttagaccacatagggtaacctcctgacattgccatggcatttggaaactgttgtggtactggtgggagtgtctcttagcaggctaatgcattgtgattagtgtataatgaacagtgaggatgaccagaggtcactttcgttgccatcttggtttcggtgggatttggctggcttctttacctgttttatcagcaatgtgtttattacctgtatcttgtgctgacctcttatctcatcctgtgacttagattgccttaactggctgggcgcggtggctcatgcctgtaatcccagcactgtgggaggccgaggcaggtggatcatgaggtcaggagatcgagaccatcctggctaacatggtgaaaccccgactctactaaaaatacaaaaaaaattagccgggcatggtggcgggcacttgtagtgccagctacttgggaggctgaggcaggagaatggcgtgaacccgggaggcggagcttacagtgagctgagatcacgccactgcactccagcctgggtgatagagactctgtctcaaaaaaaaaaaaaaaaaaaaaaaagaatcacttaaaactgtctgggaatgcagcccagtaggtctcagcctcattttatccagcccctattcaagatggagttgctttcattctcctgcctctgacaattacggtcattgtcctagggaagactttctttctctactttcctcccttttaaacccattatccgttatcgctttttcttcccccagcacaccatggctctaaaacaggaccgtcccattgacagtgatgaaaatgttctatacctgtgctttctgatgagcgtgcaatagttttcttttgctgtcagatgaccatacacctagtaacttccacaacacaagtatattaggttacagttctggagatcagaagtgtagcatgggaatcaccaggtttacaaggattgtagctggcaggatgatatttctataggctcataatttgatctttccccatgcctttcctggcccctgaaggccactgtcattcttgggctcatggcccctttccccatcttcaaaatcagtaatggtgggttgagtttttctcacggggtgttcactctgacattgggggttctcttccatgccactggcctctgtttcacttctcaggaccctggtgattatacagggcccacacaggtaatccaggataatctattttatggtcatgtgattagcaaccttaattctccattgccatgtaaagtatcctattcaagattccaggtattagaaccttaacatctttaaggggtcattatgttgttttccacagaaagccaccaaccacaggtgtctgttgagcacctgaaatacagctagtgaggccaggtgtggtggctcatgcctgtaatcccaacattttggagaccaaggcagaaggatatcttgagcctaggaagttgggattgcagtgagccttgatcattccagtcttgggaatgggagtgagcgcctctgtctccaaaaaaaacaaaacaaaacaatacagctagtgaacttgatttaacttcaatttgaatgtaagtactgatacttgattgttattagtttgtttgggggatccttcacatgtcattttttcaaaggctaaatataaatcaagtatttccaatgacaattcagtttccatatggagatgtgtaaaatacaagatttcaaagacatcctccaaaaagaaaagaatataaaatatcttttacatgatagcatgttgaaataatatccttaataaattgggttaaaatgaacgttcttaaaattttactttttttttttttttaaaaagtgacttctaagaattctaaaatgacgtatatcacttacattttattttacaagacaggcttctctaaagtccttcaccagcatccttgagctatatctaatgctgtgtgatgagtgcatgtatttttcatttccatcaaatagaatttgctacagttcttattttatttctaattatcccctctcccctactgagcacagaacttcaacatctctaatttctgtctgtattctgatttctactgacaacttcatggtggtatcatctaccacattttactcaaccgaaactggatgagtaaggactgccaccagtaccctggacccacagacaaccctgagatagaagtcatttatctacgcttgcagctaggctcagaaggatgtacatagctggactagtgatgaaactagagttttattgcagagctacctagccataaatattccttccctgaatgtacattagctcaaccattgtggaaaacagtgtggtgattcctcaaatacctggaaccagaaataccattttacctggcaatccaatttctgggtatataccaaaggaatataaatcattctgttacagacacacatacacatgtatgttcactgcagcactattcacaatagcaaagacatggaatcaactcaaatgcccatcaatgatagattaaagaaaatgtggtacatatacaccgtgaaatactatgtagccatgaaagggaagaagattatgttctttgcaaggacagtggatggagctggaagctttatactcagcaaactgatgcaggaacagaaaaccgaacactgcatgttctcactcataagtgggagcaggacagtgagaacacatggacacagggaggggaacaacacacactgggggaaggggcgaagggagagcatcaggataaatagctaatgcatgcggggcttattacttaggtgatgggtgcagcaaatcaccatggcacacgtttacttatgtaacaaacctgcacatgtactccagaacttaaggaagaaaaaaaaatccttccctgtgcttctgtacccacttacctggtcatcactagaagatgccacgcaggtggcctcagtcttgtctccctagggtcagacagaggaaaccccaggagggggacagaatccaaaaggcatgtatctctacacgactatgcattttctctccaacagtcatccctggattggtcgatatcaaaatccaatttcaccaggattagtctcgggttgctcagagctattcattgaattaggaacgattatagcagagggagccccgtggttctttattaaggtctttgtggaagcactaagtgatcttcaggagattaaagtgccagtggtgttttcttaacatttataacctgcgccgatacctggggagtttgtgtattaagaaaaattctgccgcacagatcccgcctcctaataaggccttcacactgggcccgggtagaagctggcattgtggtcctaatgagcttatcagggaagctctgccaagtgccgcctggaaacccacctcttggggttaatggacttcccatctgtgtagggtcctgcagcctttcctgtttgatggggaggctgcgtctcagagttgtgcatggcctgagaaataaaacaaaagctaggcccggcgccgtggctcaggcctgtaatcccagcactttgggaggccaaggcaggtggatcacctgaggtcaggagtttgagaccagcctggccaacatgatgaaaccctgtctctattcaatctaaaaattagctgggcttggtggcacatgcctgtagtcccagctactggggaggctgaggcaggaga[145 bp omitted]tctttatacaagggacttaaccattcacaaagacttggatgtaatttcactctaaagcatccaggacaagtatacatttatcattttatgtatatgcaaatggagatccagagacatgaagtgagcagacttgcaggtcgctcatggtaaggcttagtcatttacgctgcagatatttactgagaacttaccacggactccaggtcagcagtttcaagtggtacagttttgcctcccaggagacatttgaatcccaggagatattttttgttccaactcacgggtaggcgactggcatgtggtgggtggaggccagtgatgctgttgaacattctgcagtgcacaggatgatccacccatcaaaaataataataggctgggcgcggtggctcacgcctgtaatcccagcactttgggaggctgaggcgggcggatcacgaggtcaggagatcgagaccatcctggctaacgcggtgaaaccctgtctctactaaaaatacaaaaaattagctgggcgtagtggctggcgcctgtagtcacagctactcgggaggctgaggcaggagaatggcgtgaacccaggaggcagagcttgcagtgagccaagatggagccactgcactccagcctgggcaacagagtgagagtctctctcaaatgaataaataaataaataaataaaatgaaccagccccaaatgtcaatggtactgacattgaggaaccgtactatagtggtagagggtttcagtgaacagaaaagccacagtctctgctctcctcgagttacatcctggtagaaaagataggcaatatacaaaatcacagaataaaataataaaaaggcaagaagagatgtatgctgtgaagaaatcagtggtcaaggggagagagagtgctggtgcagagttgctgtagatcatagggccagtgaaggtttctccaatgggtgacacctgggcagagattgtatcggcaagagggcaagctacaggtggtgtcccagggaaagagtcttccaggcaaagggcagaatgaatgcaaagaccaaagatggggtcaggaaaagcaaagaggccaacaagcgacaatgggagacaggcagcaggcaaagtgggaggcagtcacagccgagaacactgaaccttatagacctagagagccaatgacgatccaggttggagaccactgagaagggggtgtccctggccactttcccgtccacctctaacatccttactttactgactgccctcaatttcctccattctctgaattttctgcatggctatgtcctaccttctgatctcccaaatatggtaatgtccattcaggtaggtctcactttagagccaaacataacttttatggccaggcacagtggctcaagcctgtaatcccagcactttgggaggccaaggcaggccgatcacttgaggttaggagtttgaggccagcctggccaacattgtgaaaccctgtctctagtaaaaatacaaaaatgagccaggcacagtggcacacacctataaatcccagctactcgggaggttgaggcaggaaaattgcttgaacccgggaggcagaggttgcagtgaggtaagattgtgccactagactccagcctgggcaacagaacaagactctgtctcaaaaaaaaaaagaggtcaaataaatcaggagttctctcagagattacttcccactaagctttgatgtgctacagctttaggaactataactatgaattccgtagccactgcccttcaggaatgtgcattctagatggtttgtcctattagcaagtttcctagctttttcacattttcttttccttaggaattacacactatgcttttgtcataacgttcagcaagcttctcagggatgctataatgacttctcaagttgaatgaggcacactagtaggtactgggaacatacaggcagcatgtctgtccttgagtgttgatggcctttcaagaggctgatgaaaggctttccagccaggcgtcattgcatccagggccatgatcgaaggccactggggagagtgggctggagagaggaagacttaagtgttctctttggagagtctcattgaagtgacacctgtatcagggttctctagagggaaagaactaataaaatagatgtttatgtaaaggggaatttattaaggagtattgactcacacgatcacaaggtgaagtcccacaataggccctctgtaagctgaggagcaaggaagtcaggctgggtcccaaaacctcaaaagtagggaagccaacagtacagccttcagtctgtggtcgaaggtccaagagtccaaaagctgaagaacttggagtcccatgttcgagggcaggaagcatccagcatgggggagagttgtaggctggaagactcagccagtctagtctttgcatgttcctttgcctacttttatcctaggcgtgttggcaggtgatcagatggggcccacccagattgagggtgggttggccagtccactgacttgaatgtttatctcctttggcagcacactaacagacacacccaggaccaatactttgcatccttcaatccaatcaagttgacactcagtgttaaccgtcacaactcctattgacagatgacagcctgacaggaacattcattcctccttctcctagacctgctttgaggccactcatcttgagaacttcgtgctgcctgaagtggtggaggacgcattgcctcctggataacagctgcttgtttgtactgcatacacctttgctttatatgtttggtggagagatgtagtagagggaatggtgacctccaaaaaatatgtccttgtcttccataaatgtgatcttatttggggggggctgtgggggaggaggtctttgcagatgtaactaaggatca[143 bp omitted]ctcctgcctcaccctcccaagtagctgggattacaggtgcgcgctaccccacctggctaatttttgcacttttagtagagacggggtttcaccatgttggtcaggctggtcttgaactccttacctcatgatctgccccgctcagcctcccaaagtgctgggattataggtgtaagccaccgcacccgaccctagtatcgttttaagaagaaaaaggaagagggaaattggagtttcacccccgcagagggaagtagggactgtggacattgaagcagaggatggaaggatgcagacccaagccaaggaacacctgcagccaacaaaagctaaatgaggcaaggcatgattcctccctagagcctctagaggaagtgtggccctcctggcaccttgattttagatttctgtcctctacaactacaggagaatgaagtccagtggctttaagccgccagctttatggtcctctttcaggaaacgaatatagagacataaaacgctggctggttctaaatatgttttccccggaaggtcccagaaaaaagagaaagaaaagagatcacactcagtggagggctttgtgatgatctctaaccccaacatgcgttaggctctgaggtagctgctctgtcatctcctgctgcatttcatccttcccactatcctgtgagcttagtaccattagtgtcctttttgtttttgttttagaggcagagtcttgctccattgcccaggctggagtgcagtggcatgatcttccctcactgcagccttgatctcctgggctccagccatctcccacctcggtctcccaagtagctgggatggcaggcacatggccatgatcagctattttttttttttttaatttatttagtggagacagggtctcactatgttgcaggctggtgtcaaatgatcctcccaccttagcctgccaaagtgctgggattacaggcatgagccactgcacctagccccattaccccattaatgtcctttgatggaaaagtaaagtgaaggtcagagaagaaaagtgacctgcctaagattagcaaataacagggatggtctgtgtgattccaaaaccctggttcattgtgctgcatcccaccatataaaaggcatgcaggctgaaagagatttcctttttctgttgttttattcactcctcaacctctacttcctaacactcttctttttccctttccatacacccacaatgacctgaaacacttttggcttacttttttattttgcatgctttaaggattctttttaatacacaggtatttctccataacagtttatacgcatttgtatataagcatacactacaaaatgattaattgagcgttgtatgtttttatcaaaggaaacaatgcaaagatttctccaaagtgctgtttgactagagatgattaattttaattttcacatgagcggtataatgctattaatcatttaatatgtttaatcataatctctgtaattcctaattaggttcattaaactgaaacatccagcagttatacacaaatccaaatctatgtttccttctcaggataagaaggagctcattttgtttttgcattgaaacgggaacttctaacaggatggaagagaatggactggaagcttagggtttcagctacagcatctgtaaactccgagtctgggtgtagagtactaaaaccccttaacttctgaaaagtgacagttgcaggattcgagctcatttctgtgtcatggacgtggcaccaaacctcgtattctcagcggagaaaacgcaaattctgctctgtttgggtttcagtgttacagtgttgctcttcgactatcacatgaaggcggcgacattgattgtacacttcttcatgcatttgtttattcgtgtactaataattcattcggtcagtgagtgagccaactgttaaacagacatttatcatttgtgttacaagctggtcataccacactcctgctgtgacccttaggtggctccttattgctcttaggatgaagctcagactcttgctttgcacagtgtcctttgatctagccccttgactatctttgaaacctgtcctcctgccttcccttcatacatgcctcatctgaccagtggtgctggagtccacacatactctcctgaatccaagacatcatttcacatctctgcacatctgcacatgcactgccctgtcttggaatagcctcagtccttttcacctcttctcttagacatctcccacttaacgtttaacctccagaattggcaagcctggctgaacctccagcagtgtcatatgaccttgatttaaggttactcagccctttgtgattgcctcttatcccaacatttaccagtctctggggatggtggctcacgcctgtagtcccagtgctttgggaggcagaggcagaggcaggaggatcacttgaggccagaggttcaagaccagcctgggcaacttagtgtgacccaggctctgcaaataaaaattagctgggtataatggctcatgcctgtaatcctagctacttggaaggctgatgtggcaagattgagcccaggatttcaaggcttcagtgagccgtgattgtgccatggcattccagcctgagtgacagagcaagacccaactccaagaaaacaacaacaaaagacaatgacaaaatgattctatttatgattgtttttctctattggtgtcatgcactaaagttggaattgcatgtgacaaggagggctgatttatgtgtccaacacaaagcagttgctcagtaaagatgtgtaaacactttaaaaataagcaaatgaaaacctttccttcgtgtttctcaaaggaggtttatttctctttttggtatttaaaaaacttgccatcattctaaacatttcgtcactttccatttattgaatacataccaggaacttggccaagttagcacacattaatcaatcacaaagcctcaaaaggtatgaactcattattctttatttaccagttaagaaaatgaccactgtactgcttcctattcaatccaacagtataggcaaaatgactaaatacattgtctaaatacatgacttgcacttaaaagctgaagtcaactggtaggtcttttgataccagagcatcttggaagaatggtttgccagctaacaagatgtctttatttcaaaatgcgattcagggtgtgttaggaaggaaaatgcaaatgaaaccttccagtacataccagggctgatgagaaacttgctaattatgcccatgttatctgagtgtttgttttgtatttcactttgtaagattgtcttctctcggtcgttattattttacacctggctgcctacattgatagttttgtcccaattatgtacttctagattgcttataaacaggtcaggatgattcctcactcataaatttgataggcttctgtgtaagctttctatcatagtttcaaagttggtatctgatgtggatggcatttactgccagctggaggcaatagttgctaattgcagagaagtatcaaatgctaaatgtctgaaatgttaaaactctagaaccgagagtatggcagtggctataatgatacctaatgtgactgtgacttttcccctcgttcctgccaaatatgtgggtgtcaatgtaacgtcatgttatacagccttatttggaagacaggggaggtgaaacaatcagttatgctgatgatgttacatggtctaggcaaacagagcacaacagcactttctgcagagatggaaacgttctgtatttgcattattcagtatggaagcaataactacatgtggttcttgagcgcttgaaatgcagctaatgcaaacaaagttaaatatcttgttttaattcagttaaatgtaaattgtcacatgtggtcaactgtagtggacagcaaaagtttgtacaattagaacctcaaaagaataagtcaatcagctggttatttgaactccagaatgccaactagtcttttcacattttttacatttaattatgttttatctgcacaattacctgaacaattatgtaggcatatcttcagattctgaacagcgtcggttaagaaatacacactgtcctgcctttaaagattattacccccttcttgatgaggttctcgctccccacctcccaaccccagcagctcccagtccccttcctttgctttttctagcctatagtgcttttctctgtctgccaacactctatctatggatttattgtctgtgttgccctcatgagaatgatgctccctgagggcagggatttttgtctgcttttcccactgcctaatcccagattcataatgagcacccagtggacgctcagaaaacacttgctgaatgaatgcatgcatgcatgcgtcagcattttcttcccttctcagattgcttagttctgatcttttcctgccactcatggcaagcaaaagagcatcggaagagagcactgtggtccactgagaacctcttcggtttcttcttgttcttttagcagacagatgacgcagcaccgacggatggccagccccagacacaaccttctgaaaacacggaaaacaagtctcagcccaagcggctgcatgtctccaatatccccttcaggttccgggatccggacctcagacaaatgtttggtgtaagtatcacctttcttcccagcagtgcccgctctgggggttccagagacctccctgtctcatgtaagtttggggtatttacaatactaaggttagatgtttgtatggggagaaacaatttagagcctagtctgcaggtatattgtggctagaatctctttatggttttagcatgtatttctgtacatatgctcaccatgtatctactttaccaagtggctttcttctaagaagtaacttgtaggccaaatggaacacaaattcctagatgacccactgttgaaggaagcctattgatggtcctaaatccaatggcccaggacatcatactgcagcaaaaatacacatcgagtcctcttggttttgctttcttttacagttgtcaaatgatccagagggtgactcttagtgtatccctgcattgcctagtctttcccaggcactgtgcatttagatttcagatgcatcagcagagaacaactacttctgcataaagctgattttagcaaacaaaacaaaaccaccaccaccgacaccaaatgagctaccagtttctaagtccatgttgattcctgaagtctacgttcttctgaaatcagtgaaaaggattcagaggtacttactgtggtgctatatgccatgaagtgtagccttgcccaggcaccatggtgaaacacagagcaggccacaagtcaccactgacccaggagaaaataatagcattgctttttttataggtcatcttgcccctgattatttttttctcgaagatatcttcactatccactttgggaagacatgagtttgccatttctttgaccagtgttccaccaaaggacaaagctgtgacagggcttggatatcattcatgtttgcagatgtagccaatttgcccatgacatcccagcaatgatagcaggtgcctctggattcaatgaaaagaactacatccttaacatttgacttagagcaatggtgggcttctcagagactcttcctctaagagttaataaatggatgcaaatatcacaaaaggaacaagaagatgcccaacttgaatgcctcattcctagccaagttggtggtgtctccatataaaatgggaggctcttgttcactactcaaaggcactgtgtgttggggattagcttgcaccttttacttcttatacacacgtgatgcttatcaagtatgcatctgacacaaaagcagagcgagcatcctaatattgaagatacccagctttgaatgctgacatttcagaggaaaaggtcagctcttgcacttttatctctctcatttggtaataaccttgagttgagccttccaactcctgcagaacagagataccctcgggcactttcaggtcaaagatgactttgaaaagtgcagagcattcaaagtgagagtcgaggttaagtgtgtgtgaggcagtaagaccaggtgtgaatgatgggcggtaagaggagttatattctctttgccgtgtcaggttaggaagacatcttgctatgcagtctatttttttctcatcaagtgtcactgtgatgttggctttcaatgtgatccccttaatgaccgtcctgacactctttcatggtgtcactcagttatcgtgaaagttactgcaggctacaatgctaagtcatagaggtattcaaaatattcacaggaatcagagaagggatcctgagtctctctagtcttacagaggtagggtagacggcaaggagcaagatcttgccaaaaaattgtactaccggtcatcagaccttgatccaaatctactagtttcagggctcttgtttttaaaaagacaagttctcactctgctacccaggctagagtgcagtggtgtgatcacggctcactgcaaattcttgggctcaagggatcctcccacctcagcctcccaagtagctgggactacaggcacaagccaccatgcttggctaatttttaagtatttttttttaatagagatggggtctcaatttgttgtccaggctgctcacaaattcctggcctcaagcaaccctcccgccttggcctcccaatgtgctgggattacagcataagatgtgagctattgcacccatccagcacccccccccccccttttttttgtgacaaagtcttagtctgtcacccagactgcagtgaagtggcatgatctcggctcattgcaacctttctcctgggttcaagcgattcttgtgcctcagcttcctgactagctgggactacatgcattcaccacttcactttaaagtcaagattttcaagcaactgacaagatgtcaatttggcaagatgatagatacacttaatacctgtcaattaagagaacacaccatgcatttagtgcacaaactcaaccttgttcatcacaaatagcatctgtgtccctttttttaaaagtatgcaagatttatttgtttctgtaaattttgtctataaaagtgccaggaacatacagattcatagacccccttgcaatgactttcaagcctccttagtttacaaccactattctaaagaaatgcagttttatgcactaaaaatctgttctttcctgccaaacaccggtggtcatggagccgttcttgttataggatacatttagtggcaggaatcacattgtgaagcatctgtaaacattctcattggctccctgcactggagcttagggaatttaggagggtttcctcttttgggtcatagttactgcaagaaactacagtttaactccaattcggtacttctcacgttatttggacatgagacatcttctttccttttggtgctctatcctgtctttgtcttcccactttgacaggggtttacagtgaggacaattacagagaaaaacagtcacaaagatctttgtgcttttccccccctttgtctcttgttaaatataggcatgggatttcaaagtcaaaagcaaaacaagacaaaaaagcaacctccttcttcaaactgcctaaaacttggcagtgatcattacaacgtctgtaaccactaataattcgaccataccatctgcaaccgttacatgcctaatggttactgcagatgactcattttatttctaatttgtatcttcagcacatcatgaagattggaatcctgattaccttttccaccttgtgcttcatattctttactttctactcattggaagcatttgttcccatgtttggcattaaatcttctagctcatctttttttttttttttttctcatttgagatggaacattccttgggcaagatatatggctacagtatacaaagcagaagccatcgtcttttaaaaataccggttgaggttcaagggaatggatctgttctgtgcagtggcattgatattaaatggttcattggaagggatgttagttttataggtggctactttttccttgagctttgtcttcacgttaggtatcatgcatgagcatgcattttctttacagataaatgtttgatgatcccaaaagaggaatatatggatttctaacaaattaattgcgatatattgcaccctaaatagaatgtttaacttaatatttaacatttaaacattctgggtttgaagtgagacaagtggattgtgatatatccagacttctgctacaacagatggatggatgttctggatgccttcacggaattgtcagaaacagttgctcaatgactacagttctcaaatttacacaacacccttgttgattccacagccttactttaggggtcaaaatacagaccctcttggccaggcatgatggtggcttatacctgtaatcccagcactttgggaggccgaggtgggagggttgcttgagttcaagaattttagaccagcctgcgcaacatagggagacccagtttctacaacaataaaatcaaaaaaaaccacaccaaaacaaaatataggtcctctgggcaggaaaatggtccactaaacctctctttattgtcacaaaaaaacagatcacatgactttcagcacatgcaaaggaagatttcaagatcactttttagtcacgagacgggcttgcctgtacttatgacgttaatggaaagttccatctaccatgatgttgtgagtgaagtcattatggggagacagggcatggtaccttctacttctgcattctgaacaggaagctgacactaagaaaaactgggatgatgcctttctttggccttcacgcacaatctttgaactaacctttacttttacgttttatgctgtatccattgaacatccctcacagtttttcagagaaatattgtttgatctgagaacatctaaaaatgcttggtaggtatttgccaaagtgtgtgtgcctgtaagcttctagatcttgtttgttttgttttttaagatagagtctcgctctgtcacccaggctggagtgcaatggcacaatcttggttcactgcaacctccacctcccaggttcaagtgattctcctgcctcagcatcccaagtaactgggattacaggctcctaccaccatgactgggtaatttttacatttttagtagagacagggtttcaccaagttggccatcctggtcccaaactccccaccttgtgatctgcccgcctcagcctcccacagtgctgggattacaggcatgagccaccatgcctggcctggatcctgctcttgatacagctattgagaaactttgtgtggatttgaggcgttgttgaatgcagctgaacattgatgttgagcaaacaaatgctagttatgtctgcgaatgagtcgtgtctatttaaattgaaaatgtgccagctgtgtttacatcattagtagcgaacttcccaattaaactgttgatactataaatatagtacacaactgtcttggaaatggggcttacatcagcattcttctttgggcttgtttcaccggctttgagaaccgtcaacctaacagcaactgccacagaagcaaactttgagaccacttcagggcagctgatgtcattgtttcatttagggaatgacacctgccaagattgctgtttgattggttctgtctcaatcagatcttattttaaaggaaatgtttttgggttgactgcctagagaatgttccatagatgacagttgcatcgcggttttggaagaagtccttttcaagcttctctttctgtaaatatatgtgcttctaggctcttatgcctgaaataaatatgatagcgtctgtggagactgaatattcaagggtggttggtatcaaaattactgcttgaggagttcacaaaactggaggtttctttactatgaaattcagctcacgtttgaatggcaaatccttcatttccccaatctgaatgttttcttctatttccagtgatttttctctgcctaaaactagggcactgaaaatgctctgtaaaggaatattctcttgaccaaaagatctaagtccacagattgcaggatgagtaagctgcacgtttgttggcgtttccattgtgcatgcaagcaatgtgacccctttccatgttctcttctgagtattttctctttggtttcttcctatcctttgcttctctgaacagaagtgctggtagttctttgtttcacaacttgaaatatgtgcgtctgtgattcccccggctgtatagtgtatgggtcctgaggaacgggcacatttctatggcacagaatgacaaacttttggttactttgtcccatagtcagaactatttttatttcaagattgggctgtctgtattcaagtggcatatacatttgtttctactgtttctgggagggtggatttctttgtccattccagaggatagctatctgtatgttctaaataatttgtttcttgaatgttagtaggaccctcttgacattcactctctgtgtctctggatactctatgactgaaacacatagtcaggcaaacctcccctgcttcttgtgtggtctttttgtttgttccttttttatcctgccccacccctcaccccagtcgctctgtccgctgccacacagaagcacgcgtaatgctctccactcaagggagagatggaatacaaaacctctgggggtcataaaggatgcaattaaaatccagaatgcagaagtgaatggaatgataggaaagctcaaaacaaaacaaaaaaagaggatggaaatatttatgttgccctgtttaatttttaatcactcaaagagcatttgctctcattctgcatggagataaaattcccattttatttttccctgggccacagtacatgattttacattaccctctctctcagttgctcgtacttatgcaggttaggctactgtactcaagaaatggccacaatacttcatgtgatctcagaaaactgaaaaaattccaaggttgggggaaaggatttcagatgatccgatgcccctagttctagagcccatacttcctgttttgaaacgtgatcaagaattgcttgatgtacatttctcactgggacttccagatttcacaaatttaaaaaatatgtaagacacagtcgttgaatttgaagttcaaataaaccacaagtattaagtataagtatgtcccaaatgttgtgtgtgacatatcctgaaaaatctgaaatttaaatttaaccaagtgtctgcattttatttgtctctatttataatctgagtctctgtttctggacttttcatagagcctattcatgctagttgtctaaaatctatttgtttaacaatgtggagaattatcttgagagaatttcagcccaagcactgatcacaactgctgataccatcatgatgatagtgcctagatagtggagtttgcttctgtgtttgtactttcttgctcatatgatagagctgctcctagattttatgtgagctaggagccaaccccagtcacatcacattctcactggacattgattatcaaaatcacatttcatcaagggtgtttctcccagtgtttagtgggatagaccagaaggatcattgtatgtacatactagccacttttaatctttgctgctcagtgcctgggaaagcagacatgcacacaggaaaaaaagaaaaatagaattaacctcttgattaatattttgtatcaagccttgccggtatattccataataaggagaaaatatgggtggttttattttctcttgtttcaagcacattaaccataaaacataaaatgtgtatccttggtattaaaagagaaaaaaatggacgtgggaaacaattactactgtacatagtaatgtctactgcatttctcttcttgcttataagatatttctatttctttgcagcaatttggtaaaatcttagatgttgaaattatttttaatgagcgaggctcaaaggtaagcaacttaattcactttagaattgtttagtttatttttaaatgtttgttatgaataaggggaaacaactgcactgtcttaatcagctcattgtgaaaatacacttcagtgggaattcctttagagaccaccttccgttttcaaaatggtgggaaagacatcgggttcagtttaaaatgtataaggggataattttaaattgctgttttatatatatatcaagtttccagaggaaaattatacatgcttaaaaaaataatgatgttgctacatttttgtttttcagtgataattatgttctttatattaaaaagtgagttgatagtctcatgagcaggtaaatatgtgattattctgtattaataaagtgcagttattttcctgggttgtaggggagaaaaatctcatatacaccaaccttttgaatgtaattttattctttagtatgtttaccgatccacatttagcaatttgccattgctttgagtttgttttttcaaggaaaccaatttttaaatagattccctagtgctaataaaagtcaggggctctatggagaggtttgggttcaggagaggttctgtttcaaaacagaaatatgggctgggtgcagtggctcacgcctgtaatcccagcactttgaggtgggtggatcacctgaggtcaggagctcaagagcaacctgggcaacatggtggaacctcgtctttactaaaaatacaaaaattagctgggtgtggtggcatgtgcctgtaattccagctactcgggaggctgaggcaggagaatcgcttgcacccaggaggtagtagttgcagtgagctgagattgcaccactgcaccacagcctcggtgaacagagcaagatcctatctcaaaaataagcaaataaacaaaagaaatatgttgggagaagagaaaaacagaaacatttctaaaacctcctctctatcagtggctaaccaagggtggtcccagaccaggaatatcagcatcacctaggaactgattagaaatgcaagttctcaggctccagccctgatctgttgaattcaaaactcccaagttagggctcagcaacctgtgttttagctccactgaggaaaacaacacatgaggcctataagcagacacagggggttaacagggagaatgatggagaacaaagatgtggatcttggtaaccagaaagtgaatgctttcaatagctctgacgggtctcctggctgccagtccccaggctattaggaattttaagttcccttctccttgcatcctcagactatgaatgcaaatgttgagagatagtgatttcagcccattgactctccttacacaggcgatttgaggcaagtcggtatcacggagggtcagtaagcggtgctggttttatttgaagtgtcacaggccacattgccagctcttttggatgtgtataaccatctttcccccataaaacaaacctttgatttttttttctttattccttggacagccttcctccctcctaagtaaatttagtactaattaactaggatgatgttgatcatatcaaggaaagaaaaccccagtattttctcctccatggccagagtgatgttgtaatctgtcagatgagcaaaaacaaaagcaaaacagaatcccttacactttgtgataatactccttcagggaccttgtcatttttccatagctccagatattttacaatcgttctcgaacttaagtctcttcctgcttcttgtaggaaagttattacggggactattgctatacctgcaaagcaaagtgcattgagagaaaaatgtgcccagcctaattctgttcactcgagccttctgtattcttggcgaaattgtagatgacccgaatgttgaccaacttcgttctgaccctaggtctgtctatagcagcactgccttcaaagatgtgttgttgttgttgttttttaatatgtttaatttatattttgttttgtaacttttgccagttacaatgaagaaagctgtttaattccttctgagagctgttttgggacattagaagaatatcatttgccattttgaaagtacaatggtgatactgtttttaagacatcttccgtcattcccatgattagcctgtctctgggggcttcaggaaaaagaccatttaagtttgctgcatccagagcctgactttgtgaagctgcctttttttggtctttattcttttggtttaggaaacatccaaaatagcctctctcggtgggtatgcgccctctgaaagagcttgtcttgcaggtgttggagctgactgtttaggtactgctggaatggcactgagacagtccagttgggactgctaaatgggggcagcagctcacacagggatatttttcatagttgacattatcctttatgggaaagggccttatttagaggagcatttccattttaatggttcagaaacctgaactgttgctatggcctcattttcatcgtttggtgctggacagacagccaggaaatgagtgggcccttacgagccaggaactcaccttcttgcctttcattctctagagcagttcttcaggcaggccactcaatgctgaaggctgtgtgtgctgggtgtgtgtgtgtgtgtgtgtgtgtgtgtgtgtgtgtgtgtatgcggacatataaacccatatgtacttaagggatggacgcagtgtctcatacctaacattctagccctttaggaagctgaggtgggagtattgtatgaagccaggagttcaagaccagcctggacaacagtgagaccccatctccacaaaataataatttaaaattagctgggcatggtgatatacacctgtagtccaagctacttgggaggctgaggcaggaggattgcttgatcccaggaggtcaaggctttactgagctatgattgcaccactgcattccagcttgggtgacagagtgagtccttatctcagaacaagtatctatattactttggaatatagatccagtatctatattccaggtagtatctatattattttggaaatgtatataactcaagtatttaatgtatgggtgaatagcaagaatgcagaaaatccacattttaaagagatgtcagagagaaaatgagaattcgtaagcatttaggggcgaatgatcctgtaatttatttttcctttttacgagatttacccaaccatctcgtttacctctgatatggtctatttaagggctgtatgcagatatagctactccctacgtatatacttaagatatctggccgtgtgcggtggctcactcttgtaatcccagcactttgggaggccgaggcaggcggatcacctgaggtcaggagttcgagaccagcctgaccaacatggagaaaccttgtcttgactaaaaatacaaaattagcagggtgtggtggtgcatgcctgtaatcccagctactcgggaggctgaggcaggagaatcacttgaacccggggggtggagattgcagtgagccgagatcaagacattgcattccagcctgggcaagaagagggaagttctgtctctaagaaaaaaaaaaaaaaaaaaaaagctacactttgatctttgattcagtagatatcagtaagtatttgctgcatttcatgagagccaaccatgagtaagacagaagtacttcctgtcctcctgggctttcctgagtagcaggagagatggactaggaagatgagtgactgcagtagcctgtgctgttctgcggtgatgggagaggccactgagagtccggacaggcaggctgatattgtgagaaggcttctggaaagaaggaacatttaagctgagagtgagagttgcgtaagaatttcccagggaggggaaagagggatgtgtctcaggcaggagaagttgcatgtgcaaagatcactggagtaaaagtgagatgagagggctcatagtcccatcggaaaatgaatcttcagatgctcatcaacagctcccctcttctaaatatgaattctctgcaccagaaactagaggactggatttttcatctaggatgaaaaatcagtaccttcatccatccagggtgctttatttaagtctttaacatataaaatggtgtatttgcatgaatgcaaaaaaggaagatatcacctaaaaatacaaaagatgaaaaaagaacaataactaggatacaagaggatcagaatgtatgatttgcgaaaatattttaaagtaagcaagtcacgttggtctggcaatcctcttaaggtccccgttatctgccctactgattatacctgctcatgacagggcacaggccaccaatctcttttcttcagtagcattaaaggtaaactctgggaaggtgtgtctctgactccccttctctgtaccccttcttgcggtcttgattttttaagcagttacacatcagcatcacacccagccctttgccgagcaagccaagctcagaatgtgcttgttttgttctcctttttaaggcagaggtaaaaatattcatcatctttttaaaaactgcaaattgctgcttccctgagttagaattccgaccatgaggcgggtcagaaaaaacaaccttagcacccgctctcaaggttgcctggcacctgtgcatcgtggcaaaggttccctgctcatagagaggaccaggtgaggtctttctggttacattgcaaccctcaggtgagaattttgataacctgataacccagggaggccatgccacttcttgtctgggtgggaggtagaattgcccaacggaacaggtaggaaagtctgtctggcattttgaggaccgtctggagcacattctttctgcaccgaactttgtcaaatctcaactctaaatgaggaataccaagtagctgacaagcaaagagagaaagaagtttcgcagaaaaacaatgagaataataaaaaagaatgtattctctttgcttaaaaagtgagaacttgagaatagatgaggctatttcctttttagttcatgccccttccttgggattcaaaatgtatttctctttccacctttgtctttcctaaacatacttaatgctgatttcggggcagtaggtttgccttgggttcagacatgaagcatgagagcaaggttctggagtataatgttggacaggagggtgagtgttcagtctcacctggctgtgttcttcccagtgctgtggtaataatgactgctagttccaaagggcagaaatgataccacctggccctccagctataccagtggggctatggattttcttttcttgccgggagagaatataaatccaaagccctcgtttctctgattctttttggaatatgtggcatggctatggttgctaggaagttaggcccatcagggaggaagagaacgttgccaagaagcctgggacatgtgcttttggctgtacctctacatgtaagctccaagtaactgagtcaaaatctatagccaaaaatctatagatatcagcaatataaaattctatttattacaaaggatgaaaacctctttttcagatagggtgtcacccaggctggagtacaggggtacaatcacagctcactgtagcctcaacctcctgggctcaagcaatgaatgctcccacctcagcctcccaagtagcagagacaataggtacaggctgtcacacctggctttttttttttttttggtagaggtgaggttttgccatgttactcagcctggtctcaaactcctgggctcaagtgatcctcctgccttggcctcccaaactgcttgcattacaggtgtgagccaccatgcctggcccaaaaccttcttttgatggtttcgatcacacgtagtgaaatgagaggtcatggaaatcaaatcactgggccacacattttaagcaaacacatttctggactccagtctgggattctaatccagtggatacaaagcaaggctcaggaatcttaatgtttaatgtcctcccaagttccttctgatatgcggctaagtttgagatatactggccaagagttagaactgtcaaatagagcaaaatccccctaaattctctcttttttccctttgaagaacaatcatttccaaactatacagttggcgagtgtatttgcatacccaatatgggcatactttgtgcacaagactaagcaagacccttctgttatggagcaaataatcttaaatgaatcagataattcaggcttatcctaatcacagagcctcactatgggaaagattatggaaggtaatttggttcaatcccctaaagtaaagaaacgttatttttctcgatacagttcacccttgaacaacacaggtttgaactgtgcaggtccacttacatgtgaattttttttttttccaaccaaaggcagtattcccaggatgtgtggcctgtatatatagagggctgattttcttctatactcacattccacggggtgactgtgggacttggaaatgcaaggatttgggtatcaggggtggggatgtcttggaactaatctgtagtggattctgaggtacagctgtctatagaatcccgacaaataatcatctaccctcacttgaatacatccacatcccctgtcttctgtggctgatgagcctattccgactgttgaaaagttccgttagccagcccattgcacaatactttttttgttgttttattatactttaagttctagggtacaggtgcacactgtgcaggtttgttacataggtatacgtgtgccatattggtttgctgcacccatcaactagtcatttacattaggtatttctcctaacgctatccctcccccagccccccaccccgtgacaggccctggtgtgtgatgttccccgccctgtggtcaatacctctttagccttaaatttggaggtgattatagagaactaatgtaggactgggagttatcaccagttggttataactaccatgtatttgtaattattgtgcatttctttagtaaaactaagtattatactgtcccaactcaacttggagccaacaaggattatttgatgctaagaggagccccaacatattgcatgatttcacccagtttacagtgaaaaatctgaaagagctgggtaaatttatgtggaaattgttcgaaaggttggtgtatatttctgaacaagatgtacaaatatttttaggggctttaaaaataatgtgtcgtattttctgtacttaggaacaatgtcagtgaagacaaaatacggattttgacaatatagtttagtggggttgatttttgaggctgaaatattaaaagccaatgtacctgtggtaaattaaaaggtatatatgttatctatcagtaaaagaggaagtggccagaatattattacaaattacattctattaacaaagtttctttgctacctgttgatatgaaaaataaatattgacctaatgccagaactttacaatatgggtacacctttccctttctggttaacaaagtaggatggaaggttgtcaaattcaaaagcgtgtatgcaatttgaagagtggggaaagtatgagcacaaacattgaattgtttgtattattaatcaactgaagtttatttctgttcatttcatgtgacttttttgtttattagaccaaagagtttaagatttattataaaaaaggtctttccttttttaggcttttaagttttatttttgagaagtaaaggctgtagaactgacaaatttgaataaccctaaaactgcatgaagaagagatgttcttaaaaccacacggcatgactctgtaggcaatgttagaggattttggcattcattgttgaatttcgtgcacacgttttattttattttatttttaatttgcatgtcaaaaaagtggttcccttttcttttcctcattatttcattttattctctgtgaagacactgtaaatttattttgatctcattttcttttcgttagatttattttcttctgtagtgacatttagaaaggtatttttggtatccttctttgaatacttcaggggttacagctaactggtgacagaaaaaaatatcttgttcacatttgtcgcttaattattgcacatctcagtactcttataatttctctaatttgcatgttacagaactgaagccaggacaagaaatagaaattaaagcgagagaacattaccaagtggtcgttgactgaaataataatctgcatgttgttttcccttctccctcctgcatgcagggatttggtttcgtaactttcgaaaatagtgccgatgcggacagggcgagggagaaattacacggcaccgtggtagagggccgtaaaatcgaggtgcatgttcaaaatattttccttttcatcttttttataaatgtctgcttcacgctcattcgttgttccagatgcatcattggcgtcttgtatgtgaccctattccccctcattgtttatatatatatatatatttttatatataaaaaggaaaactggccttacttttttttttaattttactttattatgttactcttataccgctgaaaggtggatggcaaacgtgagacaaaagaaaggttaatcggaaagtgtttttttgttgttattttccatgttttataatcaatgggtgcagtaggttccaaagaatagacagtattgcaaaccaaacaaaatacagaacagtttctttttctttttctttccacttcagggttgaagagggatccacagtggttggcaaattaaaccaaattgggaaagcaaaaaagattgtttttttgtttgtttttttttgtttgtttgtttgttttttgtggaaaaaaaaacaaaaaaaaaaacgagaggtttttactaaacctctcgtttttttttttttaagaagccagtttgaatttctgtattcttttgataacaaagtgaataaccaaacaggatttcctgttcaatatctggcccctgttcactgaaagcataaataccaaaatactgacattcagagtctgctatttgtcccactgggatctcccgcaacatagccacagggtcatatttgttaattttttttttaataccagttacaaatgctttagtctttggagtaagatgttgcatattttgcctttcattttccccttcgacgataacgcttaggcccctcaccaaactctcagtaaccatggtaactgtatacaaacccatgctggcgatggtggtgaatggtaagtggtgaagtccatctgccgtttcacgtatttagtgctgatatatctatatacatatatatatataccacgtgaatttttttgacttgtcgtattaagttttcttgatgctctatttttttggatattggtacgcctgtaattgagtgtacgttctaagctagcctgggaggcactgactggattgagttatgaccggtgcacatcttactcagattgttaaccccatattgtgttaaacaatgcaccctctcttttatccttttgttagctgtgacgttaaagcttgaatgattttgttaattcttgcgatgtaaaaggctcttgttccaagtgttgaatgctagatgttgctttcctgatggttctttcctcctaaagtgttgcacacggctaagacttgtttgtccctttttttgacatttatgttcccttgtaccttgtctcttctctcttctccactgcatgctccttcatatgaattttattttatgtttaaaaaatatttcttgtttctgtgttaccatggagtacacgcatgcttttaaatcttcaattatgcagaatcttttaatttgcttttactgtccctttattaaacactcttaatgatatgacattgctttattgaaatgatttgtaagttaaacggttatgaagtaaatgtaattttaaaaatgtatgattttgttatgcacctactgccttttataaattaaaatgcattttactttttagttttcttttttaataagtaatcacggtcataatgcatgcaactaattgaattgggagctggccctagaatatgtgcttacttgagttttctatgtacataggtaaataatgccacagcacgtgtaatgacaaataaaaagaccgtcaacccttatacaaatggtaagtagagattggccttttacaagaaattctctctacttctgactctttaagtaatttaaccagagattctattacaacaagctgtgtttgcctgggcattgacactgtgtttttactactgacctgctacagtgaaccacctacatcaataagatcattttcacaacaaaggcaaatggagtgttcaggttaagtgtgcctgcccttcttcccttctttctagaataactctgtttgggattgagatgcactaattatttggaaattagtttgctaatttcattggttattacagtaagttgaggggagaattggaggtttagtttgtttgcttttcaataccatctgctcgttgattactaatcattcctggacgtgcagtcacgtaatttattctgtctttgagtcttctccagagagattagtcatttgaagtggtttagagtatacctcatgtctgaattccacagggttagcagaatgtgtgagtgggttatttgttcttctctgggctgctcagtgttattttgggctagttgagaatgttgctttgtattacagaccccatcaggacaatgcaatttctgtttttatcaataaaacttctgaaaactcctcctaaaaagcattcacatatgagttattaaaaatgtttgaacattttgattctttaattcctctcaaaataagtatctcttaagatatatggggaagaaacctgccactgtgttaatcacatacttaattgtaccaaaaattaaagcaatgcagtaagttaaagtatatacacatggtagaatattatacccattaaaatgagcaggataaggatcataaagggtctcataattaaaaaattgacataaatgtttgtcgcataactttagataaatgatgataatatgccagaatgctaatggttgtgctgaattgtgagactggcaaacattttttctttgattcaggttcataaaaataatataactttattacatcaaaaggagatatatggaattttatacttctaaaattttaattgcacatggagatacggattttttaaagtaaaaaaaaaattaaaagaaacgttaaagacaagtctaaaatatattttaaataaccccattgccaccctggtttcctacctcccccctcacaggaagccgctattacagattgttgtctatagttttattttgcgtattcatgcctatatatgtagtaggtgttcatttatagtattcatagtgttgtatacatttttatgtgaatgatataaggatacacctggcatttttaattgggttttttaataaatctatatagagttcctttaatttaatatatacagattagactaattcatttcagtggttatgtaatattacacaaaacagataaataggttcagtcagaactaaatactgattgtttatcacaataaaagaaaacaatgatctagcaatgtattatcatttggtagttttgattttcctgtttcttttgccagtgactaccaatttgacagtcagtttgctcttaattttaaaaggggcatcattcaacagggacataccgtctatataatagggctctaagttgaaagaccagaagaattacctattctgctatttttctcagctttgtcaaccaagacatgcccttaaatggtatagactattttcacaccagactttaaatgcccagtgctgaactgaagcaaacctctgatttatatgtcatacagcctttccagttgggtaaaagtaatgactctgaaacttgccagatttcatatatggtgacatcaacctgacggttgggcatagtctttaattatgaagttgcactggtgcccaggcacatgtgtgcttgtctacatatgactagctgctcatgtgtgctgagtgagaaactggagcgagaaaagccaaatatttcataagccatgtgcatgtatatttattttaaaagagttattgatcaattttatgaccagggactgaaaactagacctgtaggattttttaacacaattcaaagcccatttataaataactagcctttctggaatatgaggtatgcattatgtgaggcattttaagtgcactggacacaaatgaagtcctataaagaggacatcattatccctattttagaggtgcaacattgaggctagagaagatgaagaaattaataaagacttttttttttttcttttttttttttgagacagggtctcactttttcacccaggctggagggcagtggcatgctattggctcattgcaccctctgcctcccaggctcaagcaatcctccctggtagctgggactacagccacatgccacaatgcctggctagtttttttttttattttttgtagagacggagtttcaccaagttgcccaggctggtctcgaactcctgagctcaagtgatgtgcctgtcttggcctccaaaaatgctaagattacaggcatgagccaccacttctggcctagccttttctttttgttatgaagtaacaaaatcttgtgaccatgcctgtgtgtatcaggcatcgctttccctttgtcttcttgtagaaatgcactcaagtggcaaccaactacaataacaaaaaaattattaaatgtgcaacctcgtgttcctgccagattttggcatgcacatcccatgtcccattccaggtagccatgcactcagtttccaggaataagtcagtcatatgggtctgtcatccacgtacctgcaaaagggaactcagagaattgttcctgtcacacatactgtgtatggcacctaaggggttgatggatagacacagtagaatttatttaaaacacaaatgtcaattctaattatataaagactttggcttctgtagtggagattatggagaactttggtgttcaaagaaaagtagttctccaagctatcccaagtttcaactcaggagtatcaccactacagataaattcccttaagtggcaatacaatataactgaaaaaatatagggccctttcatatccttaataagcaagacgatagagttatggcaaaagagggtaagtcgggaccaataaagtcacattgaaatgagaaaattaagccatcggtgaggttcactcattagctacataattcattctcacaaagcatagaaattgtacttcagcaaaattataaattactggagctatcaaagtttcaggtcatctccaggtgatgaaatatagttatcaatgccagcatcaccttcatgcattacttcaatcatgtatccagaaaaacttttagcagctgcaaagtttccagtgataaataagactgaattctaaatgtgatgagatacctgtccattatagagggttacagttaataacatggagggtgtagatactattctcaggatatttaaacaatgacataatgaaaagctgtagaatgagccgtaggcttctggacattctattaaaaagttccacaaagaggggattggactatttctctattgctatttctctgaaggacacctacccacacggaggagttggggtttgctgtgttctttggggatcaaatgttggatctgcaatacaagattgagagctgaattcacaaggatttcctggatgctggggaagcatgggtgctagacatggctttttcattttcttagagatgttaggaaggatgaaaatggggcaaacatattcagcgctccagagagaggcatactttgttgcccggatcagttcttccattcactggctcttgaattgtaggaagttgtttaaactctccatgtgccagctctctagtgggaactgtacaaatgatgggaactacatcacagttctttgtgataattatgagagaaagtgctcaacacaatgctaggtatgcaaagtggcctaaaagattatttttactactatttatagcgcagtagtatttgattacacatagtttcaatattaagtcatcatattattcctttattgtcatgggtagttgaattccctgagagatactagtttaaggatcaattcttcagatgctaaaaggggctgaacaggtaaaatcagcaaacagacagtctttgaaaaactcagtcttttgggactagctattgttttcttactgaagtaaagcaaaatatttatctacgaggaaaaatcaacaccaccaccaccaccaccacgaattaacaataaaagatctcaaacatttaatctccctatcagtctcacaatggggagcagtggtaaatgtgactaagtggggagttgaatgcagtagcccttgaccacctctaataagtctgtctgtgaggcattctcaacttaaagttaccatttctaccgatgtttcaagagaaatagaaatcctgtattttagacggaatttaaattttggcaataaatacacgccgttaaagaatattcagtgaacccaaacaaaacacctttgtacccagtgcgaacctcacttctttttgtttggtatttgagagttgccacctgtaccatgtcagctgccaggtctctgacatccttagtatatgtctttagaaagcattgacaggcagtttttgtaattcctgtagcgtacataagggtgctctctggaatgcgtttctttgatatgtaacccagcaaagccttaagagaaagcctgtgctgatgttttttgtgtacacattcagacttggccttttaacacccaatgcagtcatagttaacactggaggtcttaaccagcatattttagaaatactgacacttgacctttgacaagctaaatttggggaggggagtgcaaattcagatgtggccccttgagtcctggccacggaggggtctaaactgcttgcgtatctgatacagagccagaccccaagacgtctgttctctggctccattgccttgttgtggggctgggggggccctgggaggctgggaccagtgggccttatcagccattctccttttgttgtaagcctcattgttcagtttaatgtccttgatcaaaatctctgaatttgcaaggcctggggacatacacaaactgcctaagaaattaaaaaggggatcattttgttcatcttcctgacagtgcaggctcttatctccagcagggttatcccaagggtctctttcaggtacgaggaggagtcacagggaatgtgggttcatttgcatgtgatttgcatatatttacataagcccgcatgagctctgtaagtctgagtggaggcgattttcaagggctggattctagaccaaatggacataacagacatttacagaataccttttccaacagctgcagaatacatcatctactcatcaacacacggaacattgtccaggataagccacatgtcaggccaccaaacaagtctcaacaaatttttaaaaaatctaaactatatcaagtattttcttagaccataatagaataaaactagaaatgaatagcaagaggaacttcagaaactgtacaaatacatggaaattcaacagtgtgctcctgaatgtccattgggtcagtgaaggaattttaaaaattcttgacataaattaaaatggaaacacggcatgccaaagtctatgggatacagcaaaagcagtgctaatcaaaaagtgtatagtaataaacgcctacatcaaaaaagtaatttcaactaagcaaccgggacaacagtcatccctaacacgattcttctttatttaatgtagagtctatggaaggaagcaggtccttgaagattggaaggagacataatcagagccaaaaaaaaatttgtctattaggaaaaactatattcctttagtttctttagagaaaaaccaagtaaatatttatggaatgcttactttgccaaacaacattttaggtgctggagattcatgttggacagcagtcttgcctgcttgactgttaattttaatgagggagaatggttataaaagacaagagcaagcaaagaaagaaagaagctaaatccagatagcattaacggcaatgcagaaaataaaactgggaatggaatcatggaatccaagagtaactctaagaggaggtgggaaagtgacattaactggcatgttctgaaaagactccagagccctaaataacatgaagtcgactttgtgaaaagctagagagttctccaagaagaaggagaagtggatacaaagagactttgatatacggtggtcttggggggttttataaagatgaaaatggccagtgtcactgtagctgggagagacggggaaagggaaaaagggaagtggtaccaaagaggtaccaaatagtttggttaatggttagtgtgtgctgattgactaaggtaagacatgtgtgcttatctcaaattgggaagaagctattgaattctgagtatcaggatgacaaagctgatgttttttttaaaaaaattgctttggtcaccatgaccagaatggacagggggaaggaggaggaagaggagacagtgagaattagggcatttctgctgttgaacttgtccaggcagagataggaatgccttggtctgcagtggtggcaatggagaagaagggaaggacttttcaagttttaaccaacaggattttctaatggatcacacatggggtatgagggtaagagaagaatcaaggaagtgttgatgaattttattttgagcaaccaagtagatagatatgccatttgctaaagggagaaggacttgctgagtaacaggtttcatgagtggggggagaagagggagactagaaattgggttttcattcccatcgcagagttcagaaaggtctttggtctccaacagtgggagtggagtagccttgtttagaagggatcaaggatgggaagaaggttgacacctgcactcatgttcccatgatgacccaagcatttcattttgcagcacacagattcccagctggtttcttgtagaggagactttatcaattacctttctcacgattaatacttgcaaacatgagatagcacagatctcctgatgaaggagagtatcatttattttctttatttttttatgaagagattgccatgtgcagacttggcaaactcataacttgcagaaagatggggaaataaacagcagattatagggggatagacagattatagatacgtttatagatagatcagtagatagatggataggtgggtaggcagatgagataaacatgatttctaggtagcctcaaatgcctctgagagatctggaattttttgctttgttcttagaaaatgagagatcattggcaaatttataatctttaagagctacaccaaaattcactgataagtataccttcagtgaaaaggaaaaggaagtcttatatgcaaaagaaagtatttaaggtagtaaggatattcaagaaacaagacctgagatgcacagtatgggaaagacaccatctccactaccaataagaggtaggagcatcagtagagtatgagatgggtaacagtggaaagatgaagagtgatcacttaataattattcatttaatatgaccccatatagagtttacaaattctaggtttctgtgaaaaactagaaagaaagaacattaaatatgtctgcagctttattttcaactagttttttgtactttttcttagactccaagttgaaatgtagatattaattcccatatcctcaggaattagacttttttttaaaaaaaggaagcagtggaatttcagttgatcaaattgaagtcatttccatactcataaaacacattctgaaatgtctgaactaatatttatttttacgtcactatagaaattcttataaggcaagatgtgattaatacaagagaagagggtgtcagtatgaaatttcagaaaccgctagggcagtaggtctcagaatttcatgtttctttctgtcactctaaaaagggggcccaggaattaaatatgcctcccaggtaatagaagtataacactttgagaatctctattctgagatcatcccgggggctgtaaaccacctagcttcttcaggttggaactgaaagttcttagaaaacattcttatcaagttttagaaagttctggatttcgatagacatactggcctgtctgttgagttagtgagcctctgttttccttagtggatgttaagaacacctctgggctattcttagttcgggcagaaaatcacacctctctcttctcggcaaacctcagaaagttcttactgtcaaaaataccttccttcacattcaaactttaatcattgccttctctcaaaaacatttattaaaggacctttggtatttggccttctgctcaaggactcagagcaaaggactacacaccttaccctcctctgtctttcaaggttttttttacttcttgagacagagtctcactctgtcacctaggctggagtacagtggcaccatcttggctcactgcaacctctgactcccagcttcaagcgattctcatgcctcagcctgattagttgttactactttgtatttttagtagagtcaaggtttcgccatgctggacaggctgctctctggaaactcccaacctcaagtaacctgcctgccttggcctctcaaagtggtaggattacaggcatgagccacggtgcccgacctgcatggattttttttttttttttttttcccgagagagtctcacactgtcacctgggctggagtgcaatggcgtgatctcagctcactgcaacctctgcctcccaggttcaggtgattctcctgcctcggactcccaagtagctgggattacaggtgcccactatgatgcctggctaattttttgtatttttagtagagatggggtttcactatgttggccaggctggtctcaaactcctgacctcgtgatctccctgccttggcctcccaaagtgttgggactacaggcatgagccacttcacccagcccgcacggatgcttttatgaagacttagccagcaggagcaggaaacaataacaaaaccctaaaacgtgatcagtctctggaaattgttcccctaaataatgcccagcatatatgtaatgtgctttccaatttgagaatattcttgtatgctctttttttgtgagtaaagatttctaaagggtcaggattcattttacaaaaaactctccatccagaacatttggaaaattacaggattccattaatcatatatacagattatttgaaagttaccttagatatcatacattgattaagaattttttacagttcctgaatgcatcaaaatgtaggccacagtaaatctctaggggataaaatatcattttctttggtttttatgaagcactttggaattctctagtatctcgaggttataatttggaatgacaattgttagaatatattgctgccaagaattttgtttatgcaagctttctaatttttgtgaacttaatgcagaggggtgtgatggattatctagcagtgatatataaaataagaaaaaattaaaattattatagtagttctaaaaaatattgatggagtagaaaattaattaccatgtcattttcaaagggttcacttgtggctggtcagtagtttccattccattaacttgcactggcagaaaatcaaagaagggcataaatatattttcttatgtgtggtttttaagtatttttatgcatgcccaaacgacacctcctttacattttaaaatacaaaatgagatactttaacccatttgatttgtgattcatttgcaattatataagatgttgaatcaaatgtgataataatgtttttgtgtatttgttttaaggctggaaattgaatccagttgtgggtgcagtctacagtcccgaattctatgcaggtacagagtttctctttgcacgaagtcttctcagtcttttctaaatgtgctttgcctgccaagaatgaatgagttttgtaaaataacctgaagcaagtgaattcctatcctaacaagttctgaatgatttctttgggcaaaatcaagagtgcttaaaacagtttaaaaattacaagggaatcgtctaagtttcatggttgggggatcagcgtggagccactgctccttaggacaattcacattgattttgccctaaaaaaagcattgtgactttgttcaatagtgtattgaacaaatggagagctgctcacacccattgtatttcaatgtgcctgaatgtgtgttttagccatacatttccatttggggttggcattttctttttcctggcaaagcagagagtcgagttggcttaattattccaataatgtgggagtgatttagaattgccaagggaaggcctttttcgataactaaaaagttgtccgtcttcgttcattaatcaaattcccttagcaattccttttctctctactttgccttccagaatatgtctctctcctcaccccttccctgcctaagcaccaattacctctcagctgggaaatccattctcttagaaattttgggagagcataacccagaagcagtagtggctgagatttcatgtctcgatgtcctcggcttggcccgtcactactgcctgtatgtctccttgctcttgaacaaggctgcattgaatacctaggaccttagtaggtttgccacatggctatttaaaagaagtctttctttgatgtggctcttgctttttaataaggagaaataaataatccgttgacctagagccactcccttagtaacctcttgacggtaagtcataccccttgctttgtttcttcctgggctgcctaacttttgtcattttcctaatactgaacactgacccttgtagatgagaaaggaacacagaaaacttagctactctggcacaacaaccagtctgacaaaatttaagttaaaaatctggtaaatctggaaaggctcaacaggataactgattcctggattttacgtaggcgatgtttggagttgttcttcatgtatgagttttaccgggagcctgggttaagtccagggattctaacactgcaaaatagctgtgttcactcttgtgggggaagagacttagccgtcaggctttccatgatcatattgcaaaccctaccacctgagaagacacctctgctgagtaaggaacatggaaaccatgcctacacagctcgggttcaaattctgcctcccctactcaccagcagtgtgactctgggcaagttacttaacctctctgtgcctcagtttcctcatctattaaatggagatgatagtaacaaactcatagtaatttattagaattaaatgggttaatatatgaagagtggtgtgtagccagcaccgtgtaaacatttagtaaacaaaaatgaatatgttaatctctttaccaggaaggcaaagttagctgcatattctgctgaattttgagtatgctatgagacaaagagattctttccttcattgatgagagtactagtccttcagttctcagtgtgttcatttagggggtgttaatttctgggatcgggggcatggcagtttattcaggggacacacagaacatggcatgtattgctgggatgcatctttgtgcaaagctgcaaggaaatcaaatactccaaatggttgaaaagtcagacaacagcttccatgtgtccgcagcaggcactgcccatgaatggagtagttagactaaagaaatgtcagtttctcctatatgcacatatctgagtgcatattttcagcctaaaatagtccagtgaagaacaagaagccttcttgtggggaggaagggtatggatgtgagtgttgtggtggagagggcaaaatgcatttttacatttttctggtcctgtgcgatggagttgccagtcacccttgggtctattaagcaggaaaatacctaatatccccgttacttgtgctttcgtagccacagacatatctgtgggtgttgaggaggacattaagatgagagaaacagttaagactgatttgtaactataagaataaattcatctgcatgacttctagaacattagagcagctattcagattagcccagggcccaggttcagaagttagatcattaagttagaggaaaagaaaatgttataatgtaagttaatatttactggatactttctatgggccagcactgttctaagcactgtacataagtttaatgtatttaatgctcatggcgattttccaaatgaggataccaaaatgcaaaaagttggtattactgctctgagatttcagctggtcaggaggaggccagattttgaaatcaggctttgatcatctcagaaatcgtgttctttacaaccagttgatactggtggggttttgtttgtttgtttgtttgtttgtttgttttgagatggagttttgctctgtctcccaggctggagtgcagtggcgcggtctcagttcactgcaagctctgcctcccgggttcaagtgattctcctgcctcagcctcctgagtagctgggactacaggtatccgccaccatgcccggctaatttttgtatttttagtggagatggggtttcaccctgttagccaggatggtctccatctcctgacctcatgatccgccctcctcggcctcctgaagtgctgggattacaggtgtgagccactgcgcccggccccctttttttttttttttttttttgaggcagttttgctctgttgcccaggctggagtgcagtggcatgatctcgactctctgcaacctccgcctcccgggttcatgcaattcttctgccttagcctctcgagtagatgggattacaggcgtccaccaccatgcccggatcatttttgtatttttttgtagagacagggttttgccgtgttggctaggctggtcttgaacttctgacctcaagtgatgcgcccagcctgtttatttatttttttttttaatattaaaggtcatgattccaatcgactgtctcctatgatcatgctactgctctgtgtgcaaaccagtgaaataaaagaagagaggtaacataatcattctgtatgattccagctgccaccaccaccaccatattcacaagtgttacatgacaaatctgagtatctgtgtttcatgctgccactatccggattatccggaaaatccacatgctttcctcttttcagctgtacgtttgtatgtaggtagacagagctcataatattcagaaatgtggggacatgtagctgtaattttaacactgcagagcaattcctttgaaatatttgaagacctgcaaacactgaaagtctggctggcttaaatctgaagtttcaggcacctgcatctatggaatggacctatgcaaagcgatagatgcagagtgcattcatttccatatccaggtataattattactgtcacgcatctacagatccatgactaagaatttatggggcatttaaaatttccccagctataaaaatagtctgaatttatcttgcaattctgagtgtgcctcaaagctgaaatgaagaccccttgtcattgatttgctttgtatttttagtaggctggctctgtatctgcttaagatagaaagccagacttattagtcatttctctatataaggttgtgtgttaatgacatgttttataatattctcatagtgtaattatttgattttctgaagcttatgcagaattaacaacccagcctcccgttgtctctcagaatgaggcatgaaaagttcacatattttgtaaattaaaatcaatattttcaatctctcctaaaggtaattttcttagtttagtagacttgtccctaacatttattttctcttttaattataaaatggcaagttattgaccaggcgtggtggctcacgcctttaatcccagtactttgagaggccgaggagggtggtctcaggagttggagaccagcctggccaacatggtgaaatcctgtttctactaaaaatacaaaagatctagctgggcatagtggtgtgcccctgtaataccagctacctgggaggctgaggcagaagaatcacttgaacctgggaggcagaggttgcagtgagccaagattgcaccattgcactgcagcctgggtgacaagagcaaaactctgtctcaaaaaaaaaaaaaaaggcaagttattgatttttgtatgtaatgttttgactccccgagtatgtttttattgcaaacttgggtggggtgggggcgaggcaggaagagccattgcacttaatgaggacctttaattactatttgcattgataaattatgacattccttctccctcacacgtgccttccagaggaagcattgagaacgttctaatgtattttggatggtttttcttttctgaattctcatcaagtcatacttataaaaatctttctaaatgcttattccgtgccagtcttcagagcagatacacatacatcagcacatcccatgacatatattaatataaaccttctcccaggagagatgggtagttttctataaagcaaaaacagcattgataatttcttctaaaatctaatcatctccagagtccttgaggcttattcaagacaaatgatttgccgggcgcggtggctcacgcctgtaatcccagcactttgggaggccgaggcaggtggatcacgaggtcaggggattgagaccatcctggctaacacgatgaaaccccgtctctactaaaaatacaaaaaattagccgggcgtggtggtgggcgcctgtagtcccagctacttgggaggcagaggcaggagaatggcatgaacccgggaggcggagcttgcagtgagcccagatcgcgccactgcactccagcctgggtaacagagcgagactccatctcaaaaaaaaaaaaaaaaaaaaaaaaaaaaagacaaatgattgtaagtccccacacacaaatccaggtgagtcatgaagtctttggccaatgtgtatggcccttctttagagtttaagtaaaatcaaggcagtaaggagaagtagactcagaatatctctacccagtagcaggcctcatgttatctagtgtagttaaaaatagtgtttccaagaatgtggaggaataggcctcagaggggattcttacactttctctgtcattgtgagaatttcccttgtcttctaataaaaaaatatatatatatatttttaaaagcagtatcttctagagataatcacgatatccagccaatgaaactgttgatttacggcacctttaatcttcatgaataagtaaagcaaaatcaaaataaataacagaaggttacacaaagttgtcagcacggggctgtcaaatggtaaatttatctgtttctcaattgccagtaaaatacacactgcaaagctcacccacgttgtatatcatatctgccaactcatttctgtgattaaatattccatcagcgggactataaggcagcaaagcttaacaagattcataagatgcaccacttgaacacacataactcacttccgtggatggagagcaccccgcctgcaaagggaaattggaattgagttaaattactccatgagacgtgatcaatagggaaaggcaaagatcttctaacggaaatgcagatctaagatatagttaggtcccagagatgagatacatacaattaaagtaaaaataaggagatgcagagtagatcaacttgaaaaccttgaagaaaacaaaaaccacccctagggatatttattattagtggaatttggggggaataaagagattctgaatggatactcctgaaaagaacaatttgtggttttgagagggaaaagaaaatgacaggaactaaaaatgcgccatgcctgactgcaaagtcacatttgaaaggtggtcaggtcttgaaacaagctcaccctagggttacaggggcgatcagataatatgagcatcagagaacatcacagactgtaaaatagaaatagaagagattcatgtgatcaccaaagtcacctcgactgattatatccatttcagaaagaacctggccacggatcacatgacttgatgctgggctaggtgatgggaaagtggatttggatctcagtatgaagtttaaaaatgaagagggtggttataacactctttgattgcttatctcaaaagggcaactgtatttgacctcggatttacccataccaaaggtattggttttctgtgggctagagtgaaccatgattcatctcagaattgggtcaaaagaaggtctatgaaggctccctcacattttttcctcccacttccaccaccaagagtctattaccgttaagagaatgacttttagtcatacttttagctgtacctcttttcaattcccttcctacaatttggatacaatagcatctgagaaaagttaagattgtctagaacccacctttgatcactgtggtccctgacacaagtttgctctattttattcagattggcattgggctcagggtgatttggctataaaaagtcctaggtataaagcatgccctgtttgggatgaaagagcacagtgtgggtttacaaggtaactgttaccatccaagcccttcaaagcagcaaatattcaggtgcccctcttggctccaacactttctcatacccaccaggaggactagactcgaatcaatggccatagggagcagttcctcatgaaccattgacctttggctctgggatgttttgcatagtttacgcatctgccaaattcaaatgcagtgcacttcagtgaactggaacaggagagtccagatttaagtccccgagcaaaggattttcagcctggaaatgttccacttcaaagagtttatcttgcacatctgtttacctttgcctccccttttagttgtaattcacttcgcttctctcctctcctcccctcttctgtcttatcagattttattccagccctgcccatatttggccttaatttttatctgcgtccttctagatcccacagagggaatgcaactcatctttgatgaagcctgtggggttttttgatcttcagataagatcagtacttgcttatgtgctaaaaactgcatttttgaagtaaattggttctttttcttgtgtgtgggaagtctgtcaagaactgctccccccaaaagcagggggtgtcaaggtagtccttgtacaagaagcttcacatccaggctatgggaagcgaatgaggtttggatatccgactctggaaaaatttcacaggggaagttttaagttaccattgtccacatagtgagaaactcaaaccatcaacaacagcaagccacttgcaggtacttgctctgtgctgaacaccttgtttctcctcaaatccttatgaaaatgctatcccattattttcatgatcaaattatgaagtcaaggtttctgggaaagcttacctcattcgccaaatcacagaactaccatgtgaaaaattctggttattatataaaggtcttttttcctaagtttcaaccccatgttttttcactgctttgctacgcagcatcctcaggaggtgtagatgagggcatgtcctcagtgtcttctattcatgaggtcacagaatataataatgaatgaaggccgggtgcggtggctcacgcctgtaatcccagcactttgggaggccaaggcgggtggatcacgaggtcaggagattgagaccatcctggctaatacggtgaaaccccatctctactaaaaatacaaaaaagtatctgggcgtggtggcgggcacctgtagtcccagctactggggaggctgaggcaggagaatggcgtgaacctgggaggcggagcttgcagtgagctgagatcgtgccactgcactccagcctgggcaatagagcaagactccatctcaaaataataataataataataataatgaatgaaaacacatttgcatttaatattgtctgccacatgccagagttcatgttgagaactttacatatatgtacgtaaattagaagttttcaggagaagtattgttaccttcgatttgcaggtaaattagatccagtgaagttatgatgccagtgggtgctgactctgaaagttaaggagtagggccaaagctgttatctttgtgactccaaagctcattttctacctacaagctgcctcccaccaatgctttagttaacccaagtcctagattagtgattcttaatatggagtgacctttctcttaggggaatttggcaatttctggaaacatttgtttcattgttacatcttgggtggtggtgggggcggggattggggagtgttgttcactgctgacatctagtgggtggaggccaaggacgcttcaaaacaccctgcaatgcacaagacattccttgaccacaaatcgttatctggcccaaaatgtcaatagtgctgggtttgagaaattctgtcctcattgacgctattcgagatgccacatattcacggaataccttaacaactctcatgccccactggttgctaccactaataatgtatgaacagctgcagtcatcaatggcagtcaaagaatttgaagactttcatgtaaatgtttcatctttggagcattgtattgtgattatttactccagaagggaaaagcataaactttgatttgataccacacagctgtgttgggagtccccaagaccactctcaggctccatgattgattagaaggactcagagttcaaaaaggctgttacactcacagttagtttattataacaaaaggatacagatgaaaaattagcaaagaggaaaagtacatgcagtgaagtttagaagaaacctagcaaaagcttccaggtgtcctctcaccgtgcagtcacacagatgtgcttaatttttccagaaatggcatgtgacagcacaggcatagtgttatcagtgaagctcacctgagccttagtgtccagcgtttttgttagtggttactcacataggcaagctgcacctgcatgactgaccaactctcaaacctcagcccatgctatggaggtgtgaggaacaggaattcaccataaatagttaccataaacaattggatcaaacctatatggtgtggtccaaggcctcaggcatacaaaaacaattttgtttttgtttttgggatggagtctctcactctgtcacctaggctggagtgcaggggcgttatcttgtttcactgcaacctctgcctcccaggtagctgggattactggtgcccgccaccacacccagctaacttttgtatttttagtagagatgggctttcatcacgttagccaggctggtcttgaactcctgacctcaagcaaccctcccacctcggtattccaaagtgctgggattacaagtatgagccaccatggctggcgcaaaaatagttttatcaggcagataatattctaaggcctgatattttatctcccaggagctggccaaagtccaatcctaaggacaagctgttgtggaaaatgtgcaaggtttgagatagcccaggcctgctagaatccacccttccctgcacaaccattaaaaaaaaaaaaaagtaaacttgcaatttatagtgacatctgtaatgatggtagtagtgaggatgatgatggcataagaaacatgataccactgggtagcttgactgtaagaaaaccaagccaaatttagttatgaaagagaaaagaatgtacagcttgttagcttaaagcaggggtcttcaaacaacttatcactgtaggcacagatagtgtttttgactttgtaatccctatgatccctgtttcaactactgagttctgccattgccgtgtaaaagtagccatagacaatgtgtaaataaatgggcatgattgttttccagtaaaactaaggacgtggaaatttagattttatacaattttcatgtgtcacaaaatagttgttttttttcaaacatccaaaaacgtgaaagccattcttagtttatggcccgtacaaaaacattgtccctactttgctgagcttggcttgaagagctcagcggtaataaagccaccagtttaagcccttgagagtttttcttttggttttttaaattgcacagctttagcggttatatactacatgaacccatgaccttagctggatggcactcagttgtttgatgttcatcagggaagggccaaagagacagaccgtgtattaacacttaatccttgtttccatgaattcaccttttattgcagaattatagtatcgggcgctagacactgtgctaggtgccgaggtaccaaaacagacccaggctttccctctagaagtcaacagggtagtagaaggatgcaaaacaaactgtcaatgcgggtatagtacacagtgatacctgctagagccaaaagaataacaaggctctctgcatgaggagtcaagggggtggtgtaaattgagtcttaaagggtaagagttcacctggtaagaaagtgggtaaagatcattgcaggagggaatatggaggtggttggtagggtcccaagctgtttctcaacctttatctttagaatccattgagaaaacttaaaaaaaaaatacacatgcttgatcttcacctgatacctactgatgggaatttctgagccaagttgacgttttttccaaaggctaaggtatattgatctgttgagattagagagtaccttctagagaaaggttgcataagaccttaaaattttacataatgaaatctgaattttggaatttatcctttcagtggtaggcagccattgaaagctctattaaaaataacaattataattaaaaataaataaggaagacacctgttggtgagttagtacttgtatctatattcacactgagtaacagtcttataattaagacttgtattattactaatatgtgcgtgaagccctgtggtgctgggagacttaggagcagattatcaactgttcagcaaccctgcagattgggttcttaattactaatctagtgcctaggacaaaggctattgtgaaacttatttcgtggttttctctaaatcttttaagaaagtaaattaccagcgatttcaaacgcaaggtgacatgtttttttttaatgttttaacttgttatcattagattataaactctttagtttgaaagactttttgcttcccactttcattgttcttttcaaaatttattgttcttatttccccaacaaattaagttggtgtataaatagaaataaattcacccaatagtgtttaataccctttctgttaattacatgtagatactcattctctacatataaaacagagctgtcctgttgtcttttgaaaatgtagttttgaagaaccaactgacaaatggcaaaaccctactttgagtaacttcatcagtgacagttaatgcatttctagaacttccatggaattgttataacacattacagtcgacatattggtttatgaaaaattaataaagccagtggaaaatggaattccgcatctgcattagctatttacaccaaaagaatcagccagaattaattatgccgtatgctacgttctaatgagtttttcattaaactgtataccattatggaaactaaacaaggattattcaaagaataatgccaacggctgttattttgttgagagattaaattagttaatgggttatacatttaaatctgatgcaaaggttaatcgatgcacacttattgtattaaacccagtatcattttaaaacacaaacaccccaatatcactgatatttcctctggagaaaaaaaaaactatttgtatgattctagtgtttggttgatgtgcatgtgatattgtaaagattgaaatccaccctattctctttcatttttgaaaatgattttcactagctgaaatattatgtttgtttttagccatagcaggggaaggggcagtgtgtgcgagtatgtgtgtgtatgttgtggcaggcatagacaacttcatccaatcactctttgagagattgaaaggtgacgtgtattttctactctcaccaaaaaagtcaggttaaaattttaagcctaatctgagaaggcttagaaggcaattcaagatgaaggatctcatcctcattccacaaatagagtccctcctaaatagttctgtaatagtacttgaaatatgaaagaagtgacaatagagaagcctgtctagacagctttttaggctcttacagcatcttagaggctcttattcccaagaagataagaagagagtatagaaggccttctaggttctttgcacagacttgtaaattccactgttttcagttgaatgacagtttctaattttttttttcctaatcagagattgcaaactaaaatgtttttaggaacaagctatgacataaataagtgaaatgtgccaaattggaggagctgtgtctcaattatagcaagtagtggcttctcacctttgcctacagtggctctgccggacaggaatcctagcccagacacctatggtctgtcccctgacttcccactagaagctagacatatcttatcacattaaaactcctaagtttaagtgcttgcaattcatttaatactaaaatatttgccattaactattatgtttagcattatgtttagtggccaaacacaatagttcaatagctataaatttgctatttcctttctgaaaaccaaagtaagtcctcagagcatcattgttttagatacccaataataattgctatttccatgattatgattgattcacttactgattactatttgccaaacactttcatgccatagttgtaatcctcacagcaatattcgatcaagtacacatttttatctctatttgacagatgtaaccactgaggctcagagaagtacagagttttacccaaagtcaactcaacttccagtcagcaagatcaggaaacaaaacaaagttaaaagtttcaaagcctacactttttcagtgacactatagaaatctcagacgttcattatttctcctctgcatttgcctcctctatgtcttatttcaatcttgcaagtaggatttttcttatctgtagaagatacattctgcccaaaggcttccttggttggatttaaaaccctatcacagattcttaaacatgatcaggaggttctagctaacatctttagccaggaagagtcaggtgtttcctgccagatggcagcttcggaattcttagatgtggctttgttgtaatgggggtaatggatattgatcattctcatgctgaaggatatgtttttatcaactcaggaccaagtatcaccattgataaacaggtgtagctttgagagagagtgtctgagctttggagtcacacaaaactgacttatagttcagttttattatactttttctctgagctttcatttcctcttgggtttgataagaaaaagacgtgcatgtggagtacatcttgtatagcacctgaaacctagggccaccttaatgggcactgtcaatattagctgtacatgaggttcctatgtaatccctagcaatttactgttgtcagcaccatctgcatcccctggaagcctatgagaaatgcagagtctcaggccccaccccagaccccctagataagaatctgcatttagaagagtcccaggggattcagagcatagtagagtttgagaagcaaggccctagtagtcttatcatctatatattgacacctataactttgaaggacaaacatcttgcaagatagaacttattttcattgtttttgttgtggctgaattgatagacctccacaaatactctatggaataactttttgaatttttttttttcttttttgagatggagtctccatcacccaggctggagtgcagtggtgcaagctcagttcattgcaacctctgcctcgcgggttcaagcaattcttgtgcctcagccgcccaagtagctggggttacaggcatatgccaccacgcctggctaattattgtatttttttgttagagacgggttttgccatgttctccaggctggtcttgaactcctggcctcaagtgatcctcctgccttggctttccaaagtgctgggattacaggcagggtcaccacacctggcctaattgttttattgttttgaaaaacaatccaaaagaaattttgagcaaatatttttaaaagcctgtgtttgaaaaaagtttgttttgaacaaaaatgaaataaaattaattttttggcaagtattgatcaaatgatagcctctgaaatacttagtgccagctcccttgggaagggctaatggtgtactgagagacagttactgttagtatttttgcaagcagtaaagggatcttagaacactgatcagcaaactttgtctgtaaagggccagacagtaaacactttagcctctgcaggccataaggtctctgtgcaattactcagccctgtcattttagcagaaaagcagccatacacaaaaatgaatagatgtagctgtcttccaatgaaactttacttattagatactgaaacttgagtttcatgcaattttcactagtcaaatgttactgtgatttttgtcaaccatttaaaatcgtaaaaagcattcctagctcacagaccatacaaaaataggtgggggctcgggggaggggagcagttggatttggccaaaagtctgtagttggtcagcacttgatttagaagatgattgttagaaccatgggtccaggaatctggttggtatgacttgcagtttcagcatcacgagatctgtgtcacctcaggcaaggaaaaagagttctctatgcttcaatatcctcatctattaaatgggtataaaaatagtgtctgtcctacagggtcattaagagtaaatgatgatctaagttaaagttgagcaggatacccagtgattctcaggtattcagtaaaacactttgggaactcttattgttaggtttatcatattaagttaaatatttcctgtcaatgccactattagcctacattttggctgcaggagattaagtgaacagttggagtgagtcattaaaattttcaaacaataaatagtcaaggaacaaattcttctttgtattattcttgtgacttttccaaaaagtctcaagttatgtcaaaataaaaagcaaaaagaaaacaaacaagaagtggtgtattttttttttgaatattatgaaaaccaaagcttatgaaaataaattggagtgagggattatttacactatagacagatgcgcttcagggcccctttaaatatggaaatcccttggtacaattaaaacatgatttgatttataagaagtaaacatacagagcaacattttttctgcaacatctgtgcccaaatggaaatatccctatacttaaaactctaccataacccttcagagaagctcatctttcaggctggtgtaaaagcattagggattaactgtgaaaatattcttacatggattagctcaatgctagtcttgcgttcaaaaatgcatgactgtaaaagtatccaccgtccattcgggctttgggtaaattttggaaaaatctgtcaattgaaagcagtcacctccattgctaggtaccttatggcaacctctttggcttctaagtccaagagaagtttgaggcttatgggtcactttgtaggggactctcattataaggtaggaaggtgtagtagttggctagtgctgccatagcaaagtatcacagactggatggcttaacaagcagttcccaaccattttggcacccgggttgggttttgtggaaggcagtttttccacgggtcgggtagcagggatggtttcaggatgattccagtgcatttcttgtgtaccttatttctattattattacattgtaatatataatgaattaattatacaacttgccataatgtagaatcagtgggagccctgggcttcttttcttgtaactagacagtcctgtctgggagcgatgggaggcagtgacggatcaggcattagattctcataaggaacacacaaccaagatccctagctcagttcacaataagattcacacttttatgaaaatccaatgcttccacttatctgacaggaggtggagctcaggtggtaacatgaagtaacatgaacaatgaggagcggctgtcaatacacatgaagctttgctcgctcacctgcagctcacctcctgctgtgtggcccagtagggtccgtggcccaggggttggggaaccctggcttaaacaacagaaatttattttctcataattctggatgctggaagtctgagatcatggtgttggcagggttggtttcttctgaggcctctctccttggcttgcagatgaccatcttttctctgtcttcacctgggtttccctgtgtgtcctcatctcctcttcttgtaagatctgtcagattaaggcccacccatatgacctcattttaacttaattacagctttaaagatctctctgcaagtaaagtcacattctgaagtactcagagttatagcatttaaaaatgattctacaacagtggactgaaggaaggactcgatgaaatgagtgacagtgtaggaacccaaatagcttgtttttcatctaaaatttacctctggttggtaaggtttttggtaaaggacttagttgttctgtgccacctttgtaatgccagtaaaggaggactaatggcatcagacgcctactatggagggacaaatgcaaagtaaatattctttggcaaatattgaaaaaagctttttctttatgtagaatcaaaacatttctagcattgattcctattactactaaactttcagttatgatagaattatatagcagaaatagagaattttggccaaagccataatagttatatctaataaaaattgttctcgaataattatacttatcttagtgagcagtgtgactaattatgtaggctaaggtttggtttgatattcagaatcattcttttgttccttttcatgtatacatttgttactgaacctatgagcactaaacgtgataacatgtcatcctctggaaaagcacatggagttcaacagatgtaccccaaagcccagcacagtgcctggcacatagacgagtagatgccaataagtaccagccaaatgaatgataatactcactacatcatagttgcctagctgagcactagaggcagagggactaataagcacttgtgctactcagacattgccctgcagggttctagggttctcctcttagccttcttccctgagtaagctcctttcctcggctgagtgacattaggaaagccagacatcagtggagagttctatttttgtgtgactctgcaccaccacacagtagaggtttgttgaggtgatacggttctgatgactggagaaatgccaaggttgttggttttgcgccgattggattaacaatgtgaacacacgtggagtggttttaaggagcgaaaagtgtaataggcaagaaaggaggaagaaagaaaagaacagcttccccatacagagaccggagagtggggcctggaacagagaaaccttgtgtgtggcagataagtggtagattataggggaggcttgaggaggcggtgtctgatttgcatacagcccaggggattgctttggccaggtgtgtcatttatgcagcctgcaaaaaacctggctctcccaccttagtcctttaatgtgtaaatgcgggtcgccatgatgttctgaacacatggtgttatctggaggtggccattaaactgggcacaggtggtgacaaggagaagacagcaggaatcgccacattgagtgaaccctgttcctaatggcgggtatttgcatatcaaagcttgcccacccagcccttcgagcagtcttttctgttataaaagagatggtttgggggtggtttcttattacaggaaaatttccacctagaacctttacccttactatctgcctaaaataatttcttaataactcctgtattagaggtacagacagtgcatgacatatacagaaacttcctgcatgggggccccagaatactcattccatcttaggtatttcataaagtctagctgttgttctttgtgtcttcaagagcatcctccagatttcctaacccattttaatcttcgagctcttgaagctaattggccactcccagttgccaggcagttgagatgttccgttcacattttttgtttaaattcagaaattatgtaggaaaagttctagttattcaccatgtactgacttggaactgtgcccatttgatactaaaagggaacgggcagacattgccaaacagcctttcttttcttccttcccatcctccattttaattttatttcttggaagtgtagcatggctgcctatcagaaacctttggattctcacttcatttgctccctgcctcttagtctaggttcctggactcatgaggataggaagataaacacatgattcctgatctctttgaattagtagcatcaatgggggaagacactcattaaatagattacacaacacaattttaaaaagaagagaaaggaagctgaactctgccagacaaaggtacatagatagggtttctaggagaagccagagctgagtccagaaaggagttacctagagcaaggaaaagatttcctggaaaaagacaaagcctctgcaaaggcatggaggtgtgaaactgcactgctgttccggtttgagtccagttttcctcacttagggggttggcagcagagtaaacagttttcgacacttcctccttcctgtctgtgatgggaaacatcccttctaggcttgtgcctgccccttcaggggccaggaatgatcccctgcatgccgtatggagactactgctcagcagaaagggttccgatgccccatctgagaccttggcactggcttactcccttcctcactggaggattcaaaatcctgctggagagtggctgtgggacatcttgccaggttgtggggatgccgatgatcccggcactcagagtgggcgaacgtgacaggctttggaacgggctctgattattctgagattgaggtctgtcccatggagccaaatgtctgccaggtgctgatacagtcatcgacagtccaggctgcgcaggtttcttgttagagtgggtgagccaactttataagaaccaggaaagaagagaaaacacgtgaagtagattgaagctatttcaatctgtaaaagttatttacatgtagtgtgtaaatctatttgaacttcaggcatgcaaatttcctgccatgaacaggcggaagaaagattggttgaaaaaaaacactatttttagcaaagagggtagaagtggagacttgtttttaaaaatgtattataattcaatcatatgcattaatccttctgaggatcaggtattttcctaggtgttggggatgaaaagatgagtatgatttggctctaccgcaggtggattttgtagttcagacgaccaatgtctaagtagaaaattgtagtagaggaccacgaaggatctatcagggaggtttaaaaatgcaagataagagcatagtgtaggtaataactaattcacccctgaggacaagggagagaagaggtcacttttaaactatgttggaggaggacaggggaagcccctccgcctcctttttttttttttttcttttaagttgaaccacatgaacttggcaacattcaattctatttgacaaaaaaaaaaaaaaagtcaatttgaaatggtttaatctaactctaagagcaggaacagcatgaaggtttcatccacttcaccaactctaatcaaatgggaatcattgcctactggctgtgttgagaatgattgtgaggattccaggccaataggaaaggataatattgaaattgattaattccgttctggctaaagaatgggtaggtagtggtataaattgaccccatttgccatccctagattataaggaatttgataaaagcacagaagtctgagaagtacaggatgtcatcatgtgatacaaatgaaggttcctggcatttggcagtagaaggtttatgttgaaggctagggacagatagaagatccagctcagtggactcaatgaagagctatgttgaagctatattgagaagtgctttgaatgaccttgtaggccctctccatactgctgcttgtaccttattacctatttgacttactttttaaaacaaacacacttacctttccctgcccaaaaaaatgcatggaggttgcagtgttctctgctgctttggttttgtcgaattcaaagcgtccttttaagaaaaggtcacaaagcactaagggaacatacagtaagtactttccaaattaaattggaggatgcttttagataaaacaaaaaccaagtcctgtgaaggcatagattttgttttacaaaaggtcaaaatcattgcataaagattttttttttttttaactacgaagaaagtatccaaagaaaatatttcagtccaggttctcagaatccacagcattaaaaaaaattaggaatgcttcattatgccgtgccagaggttagctttccaggcaaaaatctgtgctgtgtcccagtggaattctataaattgcatcgaggatattgaaaattgacccaagggttttaaccatacaatactgaaatgtccttctgtgtatgtttgtgttacagttatacatttttcttttgaaatttagcaccccaagaaacttcatagctgattttaagtgtttttttaaaccaggcgtgcacaggagagaaggttgaggagcattccctaaatccacttgctaggatcctatcgtagatgattccgacctgataactctctgtatatcctatagaaacacattcatttatttctaagatttctagcagtgagcagaagcacatagataaccgctgcagagtcacacaggagtactcattgataaacaccactgactgtagaggggactaactgtctttcctggtaggtagcttgcctccccttgcttggtttcatatcccaatctccattctttggagtttggtttgtttgctgttaatccccagtgacctgctaaaactggaaatacctgaggcgaggttaaaccatggaaagtatcatctcatacgttgtgataaacttttttttttgagatggagttttgctcttgtcacccaggctggagtgtaatggcgtgatctcggcttactgcaacctccacctcctgggttcaagtgattctcctgcctcagtctcctgagtagctggaattacaggcgcctgccaccacacccagctaatttttgtgtttttagtagagacaggatttcaccatgttggccaggctggtctcgaactcctaacctcaggtgatctacctgccttggcctcccaaagtactggaatgacaggcatgagccactacacctggccgataaactgtttttaaatgaagaagaaagaactattagtttagcacaggtgaatcatactgacactccgccagactcttgatatatttactacccagagaaggttagttaatttcgagttaatttcactgttgtgtgaagggctattttgcgggtgggggtggctgttctccagctataagcatgggaaaccagatcgaaaaagaccatgggacattccttcaggtagaacctctggccctgggctgcttctccctgggaaaaagtggatggagttgtcagaccggtaacaggggaagagtgagatgggttagaaagaattgtgtctggtttactgtcccttgatgacatcaccgtgcagtccctctgtgtggcaggaccccacacgctttggaagttttaactacatttttgttgatcatagggaagatacagaaggagcatagaaccattccctagggcaagtctccaaggatatagaaaagttccctgttctgcgggtgcacttgtaaggttggcttcttatcatgggagattgctttcccgttgcggtcctgacaggggaatccaaatcaaactggggcggttgaccttccccagtcaaggaagtgaccagaaaccacagggaggtatttccatcaccagtaatggccttaaaactcctcagaattctaattattttcaaagtcttggagtttgagctttgcagcagtgggaaagtagcactgataccctgacaattcctgaccccagtcatccctggagtgggtggttgttcaaaatctgtcatagattgaggaggtatctcaggattccaccattatttgccgctgtaaaattccaccttgcaaggatgaacccagtgcccttcgctttaaatcaggaggaggcaagtcattgctgcaatgcagccgcagtttgcaggatgagctaggcagcctttctggctggaaggcagagagctttagggaagaaagcgggaatacagaagccgaagattctctcatccagtgtccagtgtgggtccagggtgggtcccagggatggcaaaaagttgcaatttttctttctccgccttacttctgttcttcctctgaagaactgattcggaaagactgacatttgaaggaagttaccgttttctctaaacctatcaacatgtatgcttactattgattgagtgattattacatgccagcccctgccctgggtacgtctccagtcatatgatgcacagccattctcggaggtaggtatatttacccctgttttccagatggaaacactgaggcacagagaggtacagtgacttgccaagatcacacagtgaagaggtgtctgagtcaggcttactatctagctccctccaatatttctcaagttcccttttcagtatgccacgctgcttccattcctgatctgaacctgggccctggggcaaccagagtccgctacacaaccccgtgtgaaaagtcatgacgtgtgcttggtgggccgggttgtggtgggtgggggggcttccattgattccctttggctaaggcagggggctttgttgggtacccttgtcctgcgctctgggatgtggctatgttttcatttctctgcatttctcggttgcattgccgtgatctctcaggtgtagtgtaccgattcccaaaccagataccatctctctctctctttcgtaggcacggtcctgttgtgccaggccaaccaggagggatcttccatgtacagtgcccccagttcacttgtatatacttctgcaagtaagcccactgtcgtggctctttttgttttgtgacataaatctgagtccaatcaccttccctgccatgtaagttctctccccctccctctgccccaccctctcttgtggctctctctgaggtgaagttaattttcataagcatgtctgtctcccatgccacttcccagatgtcctggacattctctgttagatccgtcaggattgggtccaatggttgggaatgtgggcatggggttggtggggaggggcatgggagggtgggaagctttagctcattgcctgccttctatcatagctttgcaaattaatataaaaataatttaaatagcatatacaggccaccccaaaggcacccttgcctagtaaaagatgcttaaccaggattcttgtacacagttgtctcacgatggaaaataccactagcctgcagctagtcacttgtttgcaaggctgttctgtcctttgctatgtaattccaatgaggaggaggaggaggaggaggagcagagagagaaatgtggttcccccctcatttaatcaagtgcaggggcagcaacattaaataactgtcttttaaaaaatcggggcacttttaaacgtagataagtatacccatccagtgcgggagggaagagacccaaaataaatacaggaagtagatcacaacattgacatggaagaaccgaagatttctctgcctcggatggatgctctgggttcaaggatgccctatcctcaccccaattcccagagcaggtagaagaattaaagccgccactgactctaccatgttctcccagagggtataccccttcttaaagaatctcccagccacagctgaaactttaacatctgttttatacaatgtgtgtaaatcctgtggagttgccgtaactgcagaatgagtcgtctttagggtcagtgcttaaaagtgagtctgggtgcctggagtgggggtggggctgtttctcagagtagttgtaaaaggcagggatggggaggagagcaggagtaccaggctcaagggataagagacgtaggagaatcctcaccatcgtgccaaaaccaaacatcttcgtttcctaaattgtgaagctgaggaaaaccaacctcctcactgttggggcagcacctccctgttaccagcagtcacagggaatcaaaaatataatgtgacacacccaagggtctgaagtcttcaggaggtctgacagccagttgtttctcacagttagaggttttgagacaaagtctcactctgttacccaggctggagtgcagtggtgccatctcagctcactgcaacctccgcctcctgggctcaagcaattctcatgactcagcctcccaagtagccgggattataggtatgtaccaccactcccactgatttttgtatttttagcagagatgaggtttccccatcttggccaggctggtctcaaagtcctgacctcagatgatccatccacctcagcctcccaaagtactggaattacaggcgtgagccactgcccctggcccagactataatctttaatggcaattttggcattaattaaatgcaagacatttttctgtgcctcccaagaagcccaaatctaatcatattggcaagaagtggttctttctgaatttgtgacaacaaattcagaagggcctccttggggccagtgtaaatgtgtgtgcatgtatctcctgaaattgtaatgttactacacattttcacatgtccagccttgtgtattcctctcaaaaccagcaccaggtaggtatcacaatgtttgctttacaactgaggaaatggagggcaatcccagagccagtgtgtaatagatttgtcttctgaacctgggaacattattcaaccttcagctacctttctgagtccatttgactaaatctgatcgctgtaccatttacctagccttcctcgtctatattattttctgaaagagagttggtgtgccaaaacttaccatagggctgggtcctagagtattatttttttctctaacattgcggtcctatagaagtgtctgggataaaatctttatgctatccagcatagtgctgatggaactgagacactcatttttatgttatattaattagccatataggggctaatggttaccatattggacagtatggctctatatgatgatatgacatatctatatttcaattttctttacagaagtgaacaaaacaatcaactccaaaagtgtgctagtttgaattggtatagctattctaaagtgaattggggaagcatctctcacatcacatgaaaatatttcccaaattctccataataaaatagctgaagcatagagagaaaatgaaaccatctaaagcgagggccacccaagccagcccatggcctgtgttacaaggcttatgaatgaagaatgatgtttagattttccaaggattgaaaaaaacaaaacaaaaacaaagaatgtgccagagaccaaggtggcctgcaaagcctaacgttttaacagtccggctctttacagaagaagtgtactgatctccaatttaaagggtcgattttagtattaaaaatacaaagtggcaatatcactgcactgtgtgtagctgtacctttttctatgtttaaagtaaaaattaacaattatgaaattgtataatgtgcatccaacatccttcatttctaaattgtatcagtcgtattacctgcacattatatgccatgtgctttttataaaaatatgttaatgaacccatagtattgtttcattatattatattttaatctattcccccattcttgagaacttaggttcatagcaattttttttcaaaaatattaaacaaaataaacacccttcaatagagcagttttaaagaaaatagctaattttaccaccccattaaaaagcaaaatgaaaactagtttcttacattaagaatcttcacttgtcgaggcttaagcaagggcattcagatggtcaatctcgattagtattttgtaatggtgaccaactctgagacccctccctctccaattgggtaggcagaggggccttcagttatttctgtttgcaggctgtgcattggtgttgaatgttaagtttatccgcaaatccctaagacacattgctgcggtttcctttctcttttatggctttttggtctaggctgtttgtggattgctggcttggcaacattcacttaggtttttctcttccagattaggtgcatattctactacaaaaccattccccatttcctgcaacaggtcagctggcacataaagggttatttttacatgcaggcctgtgcgcacacacacacacgagttatattcatggtcatccaggatttttcttctcccaacagtttcgatttgcacagggctgagagtcacatattttatctttgctctctgatgggtgcagactttttctctaggaatccaaccattgccctcaaagctgaggctaccatacttttcagcaattgtgtaggatgctcttgttttttaacttgaaaatgcatatgttcctcatttctgtttaacagctgtgctcctgaaggaaggtgtgtgtaaattacacttttgtatgttggatcctatgtgtctacagacttgcaagataactctggagcttcgtttttgtttttttgcgtttttttcctccatggatctttaactggcctttgatgtttgtttttttttttcgagacttaaattgtacctcttcctagtcaaatagctaatcatctgtaaataacatccttaaatgcagtaggggagatggtttttaaaggaaccctgctgaattagtctgtaatgaaaataattcctactgaagttatctgcttttgatatgcatttttgcataacagtgaggttttctcccccattaagtgaatcatcctaacaatgtgacccaggactcataaaagtattaagagaaagattttcactgataactttgtgtccatacaactaattccgtagactcttccatcggaccccaaatgactccagtttttctccgtcacccctgaacttcatgcaggtttaaaaccctagttcaaattgtgtcacaggtcatcatgcatcctcttacacgtcctaataaactactctcatccagagtgtaaaatgggcctgctttctatgaaacttaaatgaagaaagaacaaaactctagagaattaggcaacatcacctagtgtcaaatggaaaacatttgcaattaatatttttcaataggctttcaatagaaacaattcaaccccttaacagaaaggtttagtgaaatgggcagggctgcttggtatgtggactgttcattccattccgaaggccagtggtcagcctgctcctcttgttgaggggaaaggtactaggtgtattattgccagcgctgttttgcatatggcgaatgctcaacatcaaaattggcaccaggcagaaataggaaggtaaagaacataccacatctcttccaaattaatacatgagtttcattttcattagttgaagtatctaaaggtaaatcattggttccatgaatgaaaaagttcacttctgattcagattagcaaagccagctaccgcagatccttatttacatatgaagtagatgtttccagaagcacgtaaatgtttattttgttttcttcaggattttatgaatatgttttaaattacaatagtaacaggtgctcattgcaatcaatgtgaagtgtgcaaataaacatacacaccattgtaataatgtgggaataatatccccactttatccagtaacataaacccttaaaagtgtgtggacgcccagtatctttctacattttctccgtggttattcaggaaaggacatacacacatgcaatggtgggggcgggggacggtgtgttattagtttgactttacagaggagagtatacacagatgttacatggacattacatatatcaatcatatttagtttcacataatacattgtgaccgtctccctttaagccttttagatattttcatccagtttgtttaatgacataaatggttgacagtcaattcaaccattctctatccatagtcattcaagccacttctttttactttttattttatttatttatttttttattttttgagatggagtcttgctctgtcacccaggctgcagtgcagtagcgcagtcccggctcactgcaaactccacctcctgggttcacaccattctcctgtctcagcctcccaagtagctgggactacaggcgcccgccaccatgcccggctaatttctttgtatttttagtagagacggagtttcacgtgttagccaggatgatctcaatctcctgacctcgtgatccacccgccttggccgcccacagtggtgggattgcaggcatgagccactgcgcccagcccaagctacctctttttctattccctccacaaggagatagtaaaaatatttgcaaatacccttacgtgcaactacatccattctacacttaacattgccaaacatggaactgttggttcccttccagcatgcttgccagcactgccatgttttgctctattttgcaaattgcatagtgaaaaataacatctcaatttgttttagtttgtctctgcctttctcctattaatgatcaccgtctttcacatttttcatttagactttacctctttgaatttccagtatacatcttcctgtttgagatttttcttattttattatcagttcacacgtgagtgacacttgtttactaggataacctatgaatggttcagatgttacacgtgtatttcctgttttgacgattgatgttgctcagattccaccatacatttttaattacataggcaaatgtatctgtcttttctgatcattttagacgtcattttggattacaaaatccctgtcaagagcaagttttgttttgcactgtatcagtcagtttgggctgctataacaaaataccgtagactgggaggcttaagccacagacattcattttctcaaagttctggaggctggaagtccaagatcagggtgccaagaaagttaggttccggtgagggctttcttcttggcttacagatggccaccttctcccatgttttcacaagagagagacagagacagagagaaacagagagagagagaggaatagagcaatctctggtgtctcttcatataagggcatgaatcttatgaagggcccaccctcaggacctcatctaaacctaattacctctcaaaaggccccatttccacaaagcatcacattgggggttacggcttccacatatgaatttgagtggagaggacataatttagtccgtagcaagccccttgatacagggatgtcagttttatttgtcaagggctagaaaagcattttctggaagaaatttctttattgttccgtatgcttatcaatgccaatgagcgcgttttccacagttccatgaaagccagagttgaacagtagatccccatcaggataaatcctaaagttaatagaagattaattatcgtttcccctgaaattttcaccctgatacccttccctcctcaaaaaaaaaaaaagaaggaaaaaaaagatatcatgggcaaatgcttgggaacctgaatgttatcaaaatgcaaaatcaattcctcatttattgacttctatgaaactcaagggcaggtggtaggggcatagtttcaactgatatattgattgcagattttaaggaagtaattgtgtggaattcataaaacgatgatttaagtggcagaaacatacataaatcaggcctgtactattttacttttaggtaattgatagaacttccatgggtttctgtaattaaagtaaggacctaaattaatttacggcttcctttttcttctgcacaatacagaaaatgtcagtgggctggactcagttactagaaaggacacatacaggtcattttgttactgacacattggtgtaaagaattgtgtcttctttttccctcacttgccagtgtctgacagcttcttgctttcctcctagatatttttctactattttatggagggggtgcttaacaataactagctccgggactagggtaagcaagtgacgtgctcacttcaaagattaaaggggtatccaaatacctcataaatagcattttaatgcaatatttttaaaaatctaaagtaacagaaaaagatccatgattaacagaatatcaagacagaataagttttattcctttttccttttggagccttaagatcccatatggcttaatccagcactatttcaattttgatagtctgctcatcgtggatttaaaaaataatttgggtgttaaaagattgcattaaaacatgatctatctccattacagagttttttggtgtttcctcccttccaccccccacttaagttctgcaacgacagtgaacgcctgttaacctagttgcagccctgaaatcatgatgatatccataatcataagtagtggttattgggcactcactatatgtcaggcattgtgctaagcccttctcattagctttcttaagaaggaactataggacaggtatgattaattatgctaccttttctcaggaggaaatttaggcttgggggcgttaagaagcttgtccgagatcacccagctagatcagctttgaaccaagcctgtttaaatcccaagccgccttcttcactactctctcaacttaccccagaggctggaaacaggatggactccaagaaatggctgagcagggagtggtcacggggaacctctcagcagctgtccagcaactctatttgggccaaggctgtgctgtctcctccccatcccatcatgtttggagaggcagttttcccctctttgagatgtctggccagggcttagcaaaattattctgtaaaaggctggatgttattaatattttcagctttacaggccatctagcctctgttgcagcgactcaactcttgttatagcttgaaagtagccatagactactgtacatatagccatagacttctaggttgaaacatgaatgaataggcgtgactgtgttccaataaaactttatttacaaaaatggtctgtaggccagattgggcccaagcgccatagtttacccatctctttgtcaggccgtaattcttacttaaaaggacagaacatggtggctggctgcttgggggtggaaataaggaaaattcttttaagtgtgcaccctcatgtattttttgcattttgtaccattttatcacattttaaatgacgtgaagtagtacataaagataggtacccttctcctggtacctattaagatcaagatacaaattgatcttgatttaaatgatacaaaatgatcttgacttaaatttgatcaagatacaggaattgggtggttagttttgcttgcacaatgatcaaatctggtttcagaggcttaattctactgacattagtctaagacctgccccagtttccttgggcaaaatgtgaagactccattgtcttacccaggatcttctgtctgaactgtttccatttctatccccacactttcaacaatgctggctctaaaagatcctctgggctggacccttcccatcagggaatcagacactccttcttctcttttgctatggttcagcattacggtggcagcctacctgtgtcctctttgtcattttctcagagataattccttctagtttttagtcctttgatcggagagggggttgaaaggtgttacttcattcaaccaatctttattgaagttttttctatatgccaggtgcaattctacatcctgaaaatatgctgtgaagatactctcaagttggcttctattatacctatattcttggggggacacataacagacaaatatatataatgctaaggtttcagaatttcaaacgcagtgctcctaggggatatttgggaagtaacacccaacaggagacttattcactgttagcactgccattggggtgcctctcagtaggtgaattaagtgtccctattttcaccattcttcaacactgtagacaggtgccctttgctactgagaccctatttgcttcaccaaacccatggattgaggtgttttcagacacctactaggtgccatgctctccctgccacctcaatcatagcacttatctatttatgaacaatagttgcccacagcattgcagaattatccagctaccccccacccaccaatggtgaactccagagattattctttctccatcactgaagcaccatctctgcttttctccatctgctcaacttttcccatgtcccagcacatttgattaacagatgatttctaagaggcttttactagctctgatattaacttagttattccacctggatcacagtcctcagaataggttcatttgtatttttaatccctgcaaccactacccccaacttcttcatccgtgtgttgtttctttggctgtcataatcataacccactttgttgtttgtcctttttaaccaattccaagaaagaattaaaaccactagtagaacctctcacccccagttgtttaaagggaaagttctgcaaagaggcagccacatttcaggcagctgccatgcagctctctgtcattgctttcgttattaatctcaatgcagaatggtgattttcattttttcagatgggtgtctggctgcaaaaggccgccagttgcaaaaactaccatcccatggtgtgcccccaaacatcttatttgtcttgatatttctttcacagaaatacatatgacagataaggagtcactagaggatgcttttgctttgtgtcagacagatattaaaacaataaactatgttgccctgggattccaatgcatacacagccagagaacaaggccgagatgagatgtttcagaaaggcagtgaggcaattattctgggggaattccctggaaaccccaagtcctgtgatagcattgacagaaagtgttttttaatgctcacattttcttaagaggatcaactggctagtgcagctcctgcatttaactccttgacaaaactcaccctcatccggcctcatcagagtcaagagaaatccttcaatagtttgagaggcttattttgagagtttattttttaagcacttatctgccctttatttgcttccccaaactaatgtggatttacattaaaaaaaaaaaaaggaatccattttacattcagagctctgagcaggtaagttgcaggggccaacggcaagatcttgcttggttcttggaatgtaaaagaggacagtttgatgcaatggagcaggtgcacattcccaagggccccagctttataagttgagtcaagctctctctgggtctacagagctgggaaggaacagcttaggaagggagaggctgaatccaagggcactcataattcaagagctggagcaatcattctttcatcaaataccagtcttcttggatagaaatgtgtccaaccatagaggtggctgctgcttcttcccttgccttatttcttttctaaaataaatctcagtgcaaagaccatgaggagcagctcaggttgcctctcatccaagggaaaaagagcctggtgtagttcatataaacccagtaatgtaaacacgtgcttcaaacaccattttcttaaatcatgtttttatataaaagaactgtcatgccaaaagctatttatccctaatggagaacttcggagcactgttaagaaaatgcagtttcagaaccaaacaccacaccacatgttttagatttatctccttgagttttgtttgtatgcaacataggctcttgatgcctaatacttttcatatgaaagcaaacagaaaggcacaaccatctatgggtatttattatccctacccttactatttgctacaggagtctcaaacatttccagaagatcatttttcctttctctggcaagtcctaattcccactagtggttttacagcatttttcttgagctacagcgtgacttagtgaaaagagctggattcaggaaagtctgggagtaaactgtcacggtagactagtgctgtgaccttggccaagtctcctcgccatgtaaatagccatgactacctacctacccatgagcactaaatgagattgttgtgcagcgtcctccaggctgcttgaggcgttacagctcctcaaatgctactctttctttttctggctcagaagccaccttctccaggattttttaaagtccaccaaaccagatgtgatggtgtacttttatagtcctagctactggaagggctgaggtgggaggatgacttgagcccaggagtttgagattgcagtgatccatgaccacgccactgcactctagcctgggggagaccctgtctcaaaaaataaagttcaccaaagaagcgggtttggatggtttatattagtccagtgactggactggtggaccactcctggatggtagttccttagtctattctatatgggtgttttggaggctctggctcagatatcaggcagatgatccctaggctcagacagtacctgtcctccaggttggctttgggcattgatcaaaggatcaggactcttttttttaagtctgaaagctgatgctcaaaatcagatggcctcagcactgacacacagatcagctatccccacagctatggctgggactgaaatgaacaatgcatgtgcgtcgcgtacccatcttgtgagccaccgtcagacccctctgaaggcttcatgttcaggagctgcgtcagcccaagagaaccttgggaaatccagcccagcataaggaagctaatttatctcacttgccctgtttcctacctggagaggcaattcaccgagcttgctgtttcagccagctgttagatagaacatgaatgatttaacaattgaaacttcagtatgtatatgcactggataaagtaattatataaattatttgggttttttttttccgtggtttcccgggaaacaacaacatggttatcagtacagattttgttaaactaatagatgatgacgaactgctgcatccaaattaaaataaatctcagctcttcagggctttgtcttctccttcaaaggacagaaagcacctttgcaaatgccttttgcagttctgccaagttaaacactccaagactgagactcattctcattttgccgaatgttacaaaaatcctgcccggcgggggaaattgtcgatacctgtgagtaggcaaatcacaaatacctcttctgcatagtaaaaacatatcactacacatttagcagccatgacatttgccacttgtctgttggattaatctagccatttataacctgtgaggaaagatacaacagctaactttgggaggtaagcaggaacagcacgccaattagttaccaccaattctactgccttcgctcagagacacaaggaccttacatgatcaaagaatattcatgtgtgtgaatggtgtgtgtgtcttttgctgttgctttaatttgttaagttaggggaactttctcctttgggaacaccagactcgttgctcagagtaaatcccagtgtgctcattacatgtaattttattttcctagatgactatttttatttccacaaaaagaagacttatttcaaaaacccaagttgtaatgtgatatttgataacatattaaaaaagcaattatatatagaaaaacgtgcaatagcccaaaatgttatgaaggtttcttatgcagatcttccaaggctttgaaataagtttctcattccagtcttccaaattagaaatttctagctgaatttagttgtaaggagctcatcattgtgacagtaatcaggtttgtgttcatctgcagcctttactcacactgtactagtacaaacctgctcactaactctacagaatctgcattcccaatatttttgggttgaacacaacctccccctcacatcgagatgtagaggtaaaccctagtggcaaagggaaacagcctgcctttgaactcttaccaggaacataaatcagtggtgatccctatggccggcatccaattagcagaaaaggaacagggcctttccaggtgtcttgaaatctcagaacttaagtatctaacagaagaaatggcgggcacacacacagaccctctaatgtctcccctatcccccaacaagaagcatattgagatctctgggaggactgtcaacagattcccctgcaaattaacccagtctatgatgaattggggctggctctgtctcagatgtggtatggatatagggagatgatgtagcagcttgtacaggcaataggagggaatccaaactgagagtctctaagaagcagagagagagtagaagtagaaagcttttcccggagcctgactggggttgcctttatgttgcatgatggataaaatcataggctttggtgtcaggctgccttggttcaaaccgctgggtgagtatctgagccactctatacctccatctccaccccaggaaagtgaagatagcaacaatcatggttcatatggttttgtgaggcgttagtgggttaatctccgggtctggcaattagcaagtgctagtaaatcctagctgttatcatcatgcaattgaattttctccacctgataatggagcctcagaggttggaattttgccaactgcaatcacatcgttccttgaattactccagttatcactgcctgggtttttagacaagggaggtccaggatcccttatcactaactccatcaccccagagtttctgtgggaatatgcatccctcacaggccgctccttagcaactctcacccgtttgaggattgccacccattttctttcgtaactgtaggactatggcattccgagttcatcacacaccgtagtcaatacacatatcagtgatcaccttgtgctcggtcatcttctagatgttggagacacagtagggaccaacatagagtcctcaggacatccctatagagagatgtataaggaagttgaaatcaactcaggtgataagaaactaatgggaaggaaaaagaaaacaacagggtaatatgatggtaactggtaacagttgtgggtgtcaggagatgtgaaattagataaagaggtaaagcctttggagggagcgatgtttgaactgagaactgaatttgggagtcaagttcactgttagagcctggacaaaggagagagaatctgccaaaagccactgaaatacagccaagtgaggctggagaaaaaagagacattttagcctcttacaatcttattcccgaagtctagctgaagtcgagatttagatcaatatattcagcttggacaatcaggccagcacgttgtcaccatcttttttttccctttcaaaaatgtgcatttctctccaagttcacattcttgccaattccttcgatgcatcccaatcagacctataacagcctagaaacttctggctaatttggatttgactaaaacttttctaccatgacgttatgtaaagagattcaattatggtgcgcagtgttttgtgagtaactaccacccataaaaagttaattaatcagggctgtgtcaatttcctcgtgccatgtcaatttgctgcaaggtaattaatcactaatcacccaccaagcagcaggctgagggacaatccctgagtcatttattgtctttccccaaataaatggcacacgcagccaggaagaaacacatcttgcctttcataatatttttatcgacacttttgcatgttgtaatagactgcagcaacaagcagctgcagttcaatggaatatgaatattaaagaaacaaatgagcagagatttataggacattgcgtttctgtaatgtcagtgttgagattaaaccaagcaaatgaacagtgaaaaattactcttccatgtggagcatggtgattagacttgtacattaattagaaatttttgttttcctattcaatgcatttcaaatgagaatgtcctagaagaaactgtttgtccaaaatgtagatttattcacttctaaacagcagtatttaatatcaacatgcatttcatactgaaacaagggtcaatcccaaatgtgtgtttcagggataaatgtatgtgtatatgagaactggagattcgacaaattaagtggccgttttggtctttctatcagtgaccgaaaggatggaagctttctcccccacccaccacccacccaccttttttttttttctgcgaaactctgaaattactggatttttttaaaaaaagaaaaacctttccatttttgtttggagctagaacttaataagtgccatcatgttaaaattttaatttaaggccatttaaagagagtgacctagttgtctgtaaaatcctatgttataaaccaatttgatgtacttttgagattcgttctgaaaaaggagaaaacatattttgccatttggaaaaaatcaggttttttgattcttcattgtgatgttcattgcacgatgccctgcctcggaaattgctgctctatgagctatggctggtggtttatttcgcctcagtatgttacctattatgccacttcttaatttatggtccagcacatggaatgggagttcccccaaggggaatcctgcaaaaccatcaacccgctgttgaaagcacatctgcacccccagaattgtgtaagtgaatatttcctaccataaattacccacagaacaatttcaccccaaatttgcatgaatctctctccatcttaaaaccttccaaggctggggaaatgtgtcattatggagcaaagggagaggaggagcaggacaaagagagcccccctcatccattcggatgcccaccttttccagggcatctggcagtctcatgcaaattcaaaccagtgcacaaatgcaaagaataattgcccattaaagcggttgtatatttttatggctttggtgcagaatccgcccccctgtcgggttttgcatctgctactcttccatctcccccagagctctaaaactttaatatgcagtttataaccctcaagtattttccactggttttgtgttttttctcttgggatttcctggctggtgagatgatctcatttgtgtttattttcgaaggtaagcaccatgttcgtaaaagagggagagaagacacactcatcactgtaaatacattgagtgcagggctcattggaggtgggaggtgggggctttgtttttgagggggagacaggcagttagcagttgacactttagtaaatggcccatttggctggtggatacacccacacatcttccgttctaaaatgttgatttgccgtgatacttgagcaccaccacagcgtgcctcttgttacatccctaaagcttccatttcatcgagttccatgggacagaacttcttattcccaagaactgagatggttactctactaacctcccccagaatatgctctgtatataaatctagctgaagggtgagagtgggtgggctggaaattctcatgtgtcaacaagatgctcaattggtattttctctgaaagctcttgcctgttttgagagaaattcatttttagcttatgagctgaatccaatttgtgttgtagtgataccagatttttctctttgattcatgctggataaggcttcagaaggaatctcttcagtataatgaacctatgggttttcttgtttccctcatgccaaaaactaaggatttatactatatccacaaatcaacctgcgtcctttccattgttccttattgatggtctgcttacatgtgagttaacttgaaattgaactaggaaaaaaaaaaaaaaagcaaacttgcagtgctggggtttagaaatgaccattgtttggtgtctttttcccctaacattgttttttaattaacaaagaggcatttacaaatactggatagggtgatgtttgacttttaacattgatttaaatattttatttcatattctagaaatggagagaacattgtgagtttccactgggcattttgcattggctttattaaatagtcattcattgcccacttactggatctagacttctaagccagggtatttggcatgtctggatccagacatctaaactaggatagatgacataactctcactcaacaaaatataagtgccatacctcaaagtaaacatgtaagaggttctctttctatgtggtcaaaaaacagttttagtcttgtttaatttgtgtctgaatcatctgtccaggtaatcatctcaaatatacattttaccatgttccagaatcctacagaccaccacacctgtaggcaaataataaaagcatccattcttccacactgtgctgggttttttaaaggaagtgtggcaaacagttgtgtgtgtgcatgtgtgtattttgcccttgaaatggattattcgtgttagtggcatgcgaagaagccatgttgtccctaaaccaacaattgaggaaaaaattatttatttatttattttttttgagactgagtcttggtctgtcacccaggctggagtgcattggcgcgatttctgctcactgcaacctcctctacctctcctgggttcaagcgattctcctgcctcagcctcccaagtagctgggactacagatgcataccaccacacccagctaatttttgtatttttagtagagacggggttacatcatgtttcccaggatgatcttgatctcttgaccttgtgatctgcccaccttggcctcccaaagtgttgggattacaggtgtgagacactgtgcctgaccaggaaaattcttctaataaagatgggaagaaacacagaaggcacagtcataagtcagaagagtttggaattatcaagattgttattttctattgttcctggttgcacataattattttattcagggactgttgttgctgggttgtcagagagcatggtctggggctatatggaagggtgagatgtgatgaagaccctttaataggtgttacctgtctggggccaaaactggagtcccgcttttcccctgaacaagaaacaattttaaatcctgatagtgtgctgccatcgaggagaatttaaatgaattgagggctctgacaattccaagtgcaacaaacttggtccaagcagcctccccttgcttgattgaaatcatactctttcaaaatctggttactttttccgagacagtgaaaaacgtacaagggtagaagtggaaattatctttctagggattgtgactaagtttcagttgtgttacaggaaaagggttcctatccagaccctaagagaggattcttggatcttgtgcaaaaaaagaattcggggccagtccacagtgcaaagcaaaaggaagcttataaagaaagtaaaatggggaaagtacagctactccatagacagtaggatgttcccaaaagtaagaggaggagcatgtccaccccttggtataatacttgtttatataggataaaaaaaaataagatcatggggaaatgtgctctgctacaagggtttgtgataaaggattaattttcttaattactatattttgcaagaatcaatattatctttaaagcaaatttaggaatgcttctgttcacaagatattgggatatcaggacactcctaaagtctgggtctgtttagtaaacataatcaatctgtttccttaaccacaaacatctagaggccaggaatacctaactttctggaaatgtagtccagcatgtcttggcctcatttttcctagccttcacttacgatggagtcgctgtggttcgaacacctctaatggttgtgttgcttgcatgctgtttatctgcaaattctgagcaggtcactttgtacacaggacagtgttatagaaggtggacagtgaagaggtggtggctgtactctcccagaaggaagacaaacattggttaaccactgacagggtgtccaggcacagtattaggtacctgatacctgcttggtaccagttactcatcctaactgatgagcagaacgtggagatcaccacccttacgcagcttgcatgcacgcaccagtaagcgtccttctccttcatttctgtgactcaagctaatgatttttacatgaaccaggggaggaacagggcagccctctttagaaaaaaaattccaaagtgactgaaaggaaggattgtaatgaaggcaggaattaataaagaaatgaagggagaggagaggaagaagagggagaggaagaagagcgaggggagaaaggaaaaggaggagggaagacaaaaggaagaaagagggagggaaggacaggagggagggaagacaaaaggaaggaagaaaaagggaggggagaaggaataaaaaaggagcaagtataagaaggaaggaaggaatgtaagaaagaaaggaatgtgatcgatgagcatttttctaactagagatttcacgaaagggccccttggccagccctagattaacaagaaagagaccactgaaaataccaaccacccaggacacttgaatcctccagccctttctccatgaagcctctggcccaaagcatgacctgtggaactctcttttttttttttttttggccaagggtacctagccttccaggaaggcactatttaagccaggaattgattttcagtccttcctgtgttcttttcacaaaataagaagtcccccaatgtgccctgcttgggagagcccaaagaacctcctaggaagccttgtaaatatcctgcctcaggaaatccattttctccctgtaatgaagagggtacaaaatggaatcctggctccacgctcttaacagcacgtgctcccctctctctctcttgccaagcttctgtttcatgttatatctcaacatctaaatcctccaagaattattgtaaaagctgcttgtggctgagagggagcttgtctggctcactcggctccatagccagtgacaatgaatgggtcagcataattaccgtgtttcctcacacaggcagccagctgctctgccagattgtgaatttttcattttctttatttcaaaatccagggtgttcctctgaaaacttaatagttgaactgtggcaagacagatttggagtcaaggccattcccactcattttctccccagtcctgaagcaagcgtctcatctctcattacttatgggcttttatgatattaggatttactcgtgttccccattaagaccccacacgtctctgcggtttcaagcataccagttgccacgtgatccaagaaactcaggtgctaggagctggcaaaaaaagttaaataaaatggcatgatctatctttagcaagaataaaaaaagttaaaaataacctttatggtcttctcagatacaaatagaaagacggaatcattctgggttctacaatcctcgtattttacccgcattgtgatagaaagatgcggtagaatccatagaacaggacggctgtgggacctttaagaacacacagaattccagataatagccatttggtcttcactttggtcgggttcgggggttttatttgggcccttaaaattgcaagagtaatttggaatggctgctgtggcaaaccccacccgctcccttcacccaccatgtaagtacaaacataccctatctatgggtgtaggtgtaattcttggagttctaagtgcactacatggtcaccccgtccaacctccttggtcgcagccagggcctccagtgaggcttctcatgcacattttttccttccaattcttttgccttttgctccttctgcaaccctcacctgggtccatgcatcagtgtatgtggaaaggactctgaataatggggagacataaggtggaacgcttctactcctgaagctgatagcgggaagggaagaagctcttcttggcagtttggatagagggtggagacaactttaacatgaaatgaactacaacccctgccccttgagaggtttgctcttctgcagaaagcctggaaaaggagttggttgtgctgggttaactaagagcatttccttcatggtgggccttttgagcctttgctgtggctctcctgggacagggacttaccaaatgcattttttcagaaaagcattctctgtggacacagtttgggaaacaatacctgctgcttagtgagatgggacaagcgtagtgagtatggtgagagcactgggagggttagagaagcgaactgagcttgaaggaaaagtggtttgctgactctgtgggccctgatgagttaggatttgcatgagaagggaggaagggcatcccaggtagaggaaacagtgttggttatcaggggacaggggtaaccggggtaaccatcaggcatcctctgcggacacagtttgggaaacattgcctgctacttagtgagatgggacaagtgtggtcattatgctcagagcactgggagagtcagagaagccaactgaacttaaaggcaaaagtggtttcctggccccatgggccctgatgagttagttaggatttgcatgaaatgggaggaagggaatcccagatagaggaaacagcagtagttatcagggggctggggtaatcatcaggcttaattccccttcctaactcctcctcacctcctcatcttgctcagagaattttacccaagggaagatatccccgcccacattcttcttcttatttgagaaaaagtcttgctgtgtcactcaggctggaatgcagtggtgccatctcgactcactgcaacctccacctcccaggttcaagcaattctcctgcctcagcctcccaagtagcgggaattataggcatgcgccaccacgcctgaccaatttttgtatttttagtagagatggggtttcaccgtattggccaggctggtctcgaactcctgacctcatgatccacctgcctcagcctcccaaagtgctgggattacaggcatgagccaccgcgcccagcccccacattctctttttaagggtcggggtcccagacttatcgcgtatttgtaatcatgctggttgcctttgcctttaaatgctgcacaggagttcagcagacttatcagatgttggtaataagctgtttctcatggcatgtgtggtttgtgcactcataccacatacatgtgtcagtgggaatacttcaattagaagttttaagaagtgatatctgtacatgaaggaaactggaaaaataggatgggggaaagttatgaataaaaaccactcatgcagttcggccccagagattgctagcatgtggaaagttgtgtgtatgtgtatacaaatatgttcatatcagcatatgtacatatatgtatatatacatgcacacattcatacacatgtacacatgcatatacacatatgtgtattttgcatgcaaatacacctgtacatatatacataggtatatgattgataagacatgacacatcttgcaatctgcccttttaaaaatatgtttgtgggttgggcgtggttggtccataactgtaatctcagcactttgggaggtggagacaggaggactgcttgaacccaggacttcaagaccagccggggcaacaaagggagatccccatctctacaaaacatgaaaaaattagccaggtgtggtagcacacttctatctatggtcccagctacttgggaggctgaggtaggaggatcacttgagccctggaagtcgagggtgcagtgagccgtgattgcaccactgcactccagcctgggtgacagagccagtccctgtctcaaataaactcattaattaaatactcatgcagtgagcttttctcccgttatatagaattatttgcaaatgtttgtcagtcaccacattctcctgggcaaagggcccactgtgttaactactcatcctctctggagtcccaccctggccaccgtgctgctctctgctttttaacctcttgattccgggaagcgggcgggggtcctgctgggaccctgtgcagggacaagggttcccggggcagttccctccacagcagggtgtgcatctgacagcctgtgctctctctctctctctcctcttgccccgcagtgccaggcttcccgtatccagcagccaccgccgcggccgcctaccgaggggcgcacctgcgaggccgcggtcgcaccgtgtacaacaccttcagggccgcggcgcccccgcccccgatcccggcctacggcgggtaagtggggcagcctcctgggtgggcctccctgcaccagccctccctccccagaggcacggagctgtttgcgagcgcatgatggtcttgactccccctccgccacccccagaaccgcccccagcatgcagcccggccgcgcacctgcagtggagcaccttgctaagagtattgaaaaatgagtgtaatttgtcctgtcatggttggtgcctttaagcattctacatgtcacatgttgttatgtaaattctctttgagactgaatgctggagaacagagaaatggttacagccaaagatgtatttctgatgattgcaaacatctggttattaaggaggttggaccacatttgccccttgaattcctccacagaaagaagtgaggttttcatacataaaaatcactggggtcgtcttgctcgcctccccagggatatcttggcttcaagggtcacgaacctttgcctgcaaagagaaaattaggtgttgagtcacatgcaaacatacaagaattaatgaaattggagttaagatgcgttgcagttgcgttttccaaaatggcatttgccttcctttctcctctgtgggaacaatgcagattagtttgtttcccattgccaatttggtccttctctgcacagactttgatattgccaggcgaatgtcaaggaatggtgtgaatgctcagtaaaagaaaaaaaaaaatgatactggtgtgtttggtggcagtcttgaaatgctagtctgtccctcttttaaggctcctgctagaatattcttgcacctctgcagccagggagaaagggatacctccaaggcagtggccctagaccaggggacatttgcaaggtctagagacatttttggttgtcacaacaggaatggagagatgctatgtcctctattgggtagagtctagggatgttgtttgacagcccccaacaagaaagaattatcagactcaaagtcagtcatgctgcagctgagaaaccctgctctatgttaaattcagcgatccccagaaagcctggcactaggcttccctggccagtgactggctttctggtgtgtagaagaaaatatggctgcatttaagactgtgtgaaaagggttaaatgcccttttcatagctctgttgcttgtaaatctttcagaaaatctacattagcctagatcatctattatactcatgacaaaaagaaacactttttttcattacatattcattctaaaccagagcatttgaaatgtttgtttcaaaaataaatgcaataaagttaatggtaaaaagaaatgagagtaggtaaaaccatcagagaagggaaagttaaggaaaagtagtaagacaaagtccatcaaatttcttgtgtagtcatttgaattgggtcaactttgagcttcttggacaaaacaagagctctctctatgcatacacatattttaactgaaaagacggtggatagtaacaaaccaagaatgaactggctataaattctccctaatgcctgtcaaatgtatttgtatgtcttaagccttttatgtgaccatgcaatataaggagttgtcgatagtataatttttatctctggtatcacagcaatgagcccattttatggatccagaaatgtaaaaataaagatttgttattcccaagatcatgtaatgagttatgaaggaaaaagaaaatcccaagttacctttgggctcatgtaattactaaagcaagatttgtatgctataaatccaaaattgcacttataccacattcgtttgaaaattgttctcagtacatgggagttgaagggttttagtatatctaccatcagtatctcactactatattgaagagcaaaagaaacaatagaggaaaattatatggtttatcctcacatgaccaatttataaacatctcagaatgacacacctgctgtaaaatcaaaattaaattagctaacttataatgaacatgctctttgctgggaataaccatgcataactaattaatgccatgtttcaccagggagagacacaggcatttccaaatgatgaaacaatgtgtttgtaactacttgggatgaaaattaattttaatattccagcaatatctgtgatcagtttggttatagtggtggattgtacctccttgctgataatagtatggctggcattctaaagccatacttggaagcaagatcaaattctcagcagagaagcaggagccccagcaggactaagattgcaagcattcatgtctgcaataacctattagagcaaggtactggtcaaaaagaaggaaattcgtcttgttgcctgggtgtttcactggattacagactcctgggaatgaattggcacggaatgaaaaactttgaggccaccatcttagaggtttccttttcctctggaataaacagattaggttgcaggagatggcaaggggatggctcctcttggaaaggaagagagcagagtgggacccagggcaggagctggctggaagagcaagaacccctatcttgtgttcagggagagcaagaacccctatgttgtgttcagggaaagcaagtagcatagaggttagaaatacttgttttcagaaagtaacatcatcaggattcaggtggtccagagagcagatttcctgtagccttttatctctaaattcctttggaggaaaactaagatttgactgacgtctttaccccagcccagtgcagctcaccctatgactcacacctattgtgttttaggcactgttgtgtgctgaagagacaaatggcaccttgagaggtatttcttctggttggggcagggggtgacatacaagccaacaatttcaataaatgtgataagtgatacaagaggatattgtgtgaacactagggaaaggtccttagcccagcttgggtgtttacagaaggcatcccagaagagaagaaatatggggtatatataagtccaaacatttcctaaattgccacagtgaaatcttatcctgtgacccctcctccacccacacccccagcaatctccatcttttctaagatgtcacctaacaaactacatttaagaatttgtttccactgtcaccaattgaaggcatatctgccaacctaaatctgttcttcctgaagtatccaatatgaatctatattgttactaaaataccagtcaaaaaggtgtcctaggtccatgcatggcttccacattttcttcctcctgggagattgaagaaaatatcctttaggatctccatggctacctttatggaagcttgggtaacccttggagatatccaacataaagatagtcacaccagtagagtccctaaggatgccctacattcatccatttccttttaaaaaaaattttttttgagacggagtcttactctgtcacccaggcttgagtgcaatggcacgatctcgactcactgcaacctccacctcctgggttcaagtgattctcccacctcagcctcctaagtagctgggattacaggtgcccgccaccacacctggctaatttttgcatttttaatagagatggggtttcaccattttggccaggctggtcttgaactcctgacctcaggtgatccgcccatctgggcctcccaaagtgctgggattataggcgtgggccactgcgcacagacattcatcaatttccttttattgatttgccttttccttccatgtcttgatattttctgaagcccttccatgcagctgaagaacatcggttatgaagaggcccttttttgtctcacatgcctaaatagaaacctcttgggacattaacacatgatcattcctccaggggtagggaaagttgtggaccatggtgggatcataggtacaagtggaaaaccctgtaccaaaccaaccaactcccaattgattgccaacatcaattgaatgagactgaagagttagaaagtaatgtctacatagcctatggaattttatagtcctaggaagacactggatttaaggtaaataagactgggccccaatattctacccatactggcttggatagcttacttaacgtctatagacacagtttgcttaagcgagagtgggggatatatctgcccccatagagtcgatagagggtgaagcagggaaatccatgtaaggtgacaacttggtccatcttatgacatgcattcagtgaactgtacctactgttctccaggttgatgaacttagcgactttattaaccacccacagtcttctttctcaacatcccccttttgcttgtggttgagtacaaaagaagatcccatgtctctccctctatgcattatttatctttgctagggggcacttgcagtttcacagacctccatttccttcaagccacagaaatggttgaggcacttgcattgcttatggaatatgtagattgaaaatacaatattgagtagggaacagtcacagagcagagtagagttttccttatttctccttgcatttgatcctggactcaatttgactgagaagccacaatgcccagtctagcttcctatgactcacatttgggaggaattacccatcaggtaattgctgttcagggagctcacaagctgattatctgtgcatcaagacagcaagtggaggctttggagacaaaccctgtagacttagtatctttgatgttagaaaacagcagctaaatcccaatcccctccctcaaagaggaactcgatgagtacctattaggtaccgtgcatatttcatgtgagtacaatggggtgctctaatggagcatcacatgagttatttttgagatggagtcttgctctgtcacccaggctgaaatgcagtggtacaatctctgctcactgcaacctcctcctcctgggttcaagcaattctcctgtcttcagcttcccaggtagctgggattataggcacatgccaccacacccagctaattttgtatttttagtagagacagggtttcaccatattggccaggctgctctcaaactcctgacctcaagtgatctgcccacctcagcctcccaaagtgctgggattacaggcatgtgccaccgccccctggccatgtttttattattattctaagcctaagcatctagtgtcagctgtaggcttttggtcttgttctctaggtatctctgagtaagattttctgccctttctcaggtaattgtcatacatctgtgtaaacttcccagagttaccttgagaagtatttgagaagactctatattatttggggtataggaaagatagagcagtatcccaggagaaaacttaaagctggtcagtggaagaacaaatagatcctttggaaatgttttcacgttaagtcctaaaaaagtctccaacaacagtctctgggactatgggcatatctttctgtgtacagatcagccatgctttctggttttatcttctaaatatctaaatccgcaacctgtagtatctgatgcttaggaactgtatttagtataaatactaggaacaaaagtcatcattacccattctcagaatactttagacacaggggcgtccaatcttttggtttccctgggacacactgaaagaattgacttggaccacacataaagtacacatacactaactacagctgatgagcaaaaaaagaaaaaagaaaaaaaagaatctcataatgttttaagaaagttaatggatttgtgttggggctgcattcaaagttgtcctgggccacatgcagcatatgggctgcggtttggacaagctgcctttgcagaattctttttataaagtgtgacttcttatttgctagttttaaaatgtaatccaaacagcctctgaatagcatgaacttatagacaaacatgatgaataagtggtctttaaagcctttttttggaggggagaatgtgaaaagacattttcacagatgcctttaataatctgattaaaaattctctaggaaaatacgtacaaacagcacacacacacacccaaattctatacacatgccagctagtttctgatccccccaatatccattaaaaaatagcggtatttgaacaccttaaaaagtttattttctagttggaaggggcctcagggtagaacaattgtaaacagccttttctataagaatatacttgtggctggtatatatcatattacacgagcagattgtatagtttgggcattttatactttttttttaaagtaaactaattttctgtagtgcagtcactccctgctcgcattcattcaaatatttaactactggtattacttttctaagaaaataagatgtgcatttgcattatgtccttgcaaaagcacattgagtcccgatgtgattgacaaacaatacaagtacctttgcatggctagacggaccatctctgcattgaaatatgactgcgcctgtttagtgcgcaatggtaactcccttctctcctaactgttccgtggttaatttatctatagctgcaccgcagacatggatccctgtgcctctttccctgcatatcttatattttaagtgcagctgtttgatgaggctttacaaattatttggatacatttttggaaactagcatgaggctttgtgatgagaactttcccgtaaccagctcctccattagaatataacctaggaggctgaccttcagttttgtctcaaatgtaaagtaaaataacacttggaggatggtgttgcatagagctatgattctcatattcctgggaccaatagcatccgcatcatctgttaacttgttagaaatgtaagctcttagatgctgtcatccggatctattcaatcagaacctgttggctgggcatggggcccagccatctgtgtttcaaaagtcctccaggtgattctgctacacattcaagtttgaccaccactgcctgccatagtacttaagagtttgcactgtggagccggaccccctgggctcaaatcccagttcagacaatacccaactctctttcagtttctacatgtctaaagaggcaatgatcatattgtccatctcatgggggtattctaaggactgagtgggatcatgagcacagaaaggctagactagggactgatccatggtaagtgttctgcaaatgtgagtagtgggagtaatggtgctcgtgctgttactattagggagaaaaacaatgttttggtaaaattggcttcccattacatggctttatttcacactgccggtgaggatggctacattgcttccacattttttagagttatcctaaagatagatcactcgtcctttccatttctctccaatacatgtgcactttgaaaacaagtaatcccttcatgatggggtttataatggcagctacaatcatctttttgctgtgaagccaccatatttagaccctaatgcttatacgtttccccccagccctccaagaagccagagcgtgggtcttccagccataggtcttgccttgcagtaccctcaccccaccaccctttgccttgacagcacttcactcctctctaccgagccaaggctttgaggtttctgtgccatttgcttagcctctctcgtctctgctgctggccctgcctccttccgttccacattcagggcacctctgttgctgtctcctgcagtatctatctcagctgtgattctacagttttatgcataatttgtgactgtgtgtcccacttcctgtacactctgggagggcagggttactgagggggctttcttcttcggtcttcatgccttcgcatagtagttggggtacaggaaagctttcagtcacagagaaatagtatgtatttggcttgtttgagcttttcacaatgagaaagctacactagttcttctttggttcagtgtttcatcaatgtaggatgtcagcaacacccaagtaactttccatagcccacagtggaggacaaagcatggcaatcaggttaccctactgagcagagactcctaagagcaaacatcccggcatgttctttcctcacctctgggcaatgttggtacaaataggcttgacatggaggcacaaaactggccatggtgcataacaacttgtcttaatgaaagaagggatcagtttcttggccagagctcagcctcagccatatcaaagaaccccaactcttggcccacacccatgccatgtgccccgttggaacagcctccaaggcctgggatcaattcttctctccgtcatttacagaagatcagagacagatgaggttccaccattgagatctttagaagtcattatttcccatatttaaaagtatgtttcatatctcatgaaaaatacattgtttacttctagactgctgtctagtctcttgccctggtctcctaattcaggttcgagtctgttaatcgtatttctcctccattgacaacagccactgatactgaatagccaaatcagagacaaacctcagactcctcccgacccattattgaattctacctggagttggtaaagcaatgactcaatctccttctgacgccttctcatgcccacccttccctctaaaatatgaaccctattcacccagttattgtccatcttctaggtaacaagcagtgtgtcaggaactgagaatagaatgttagttaagccacagggtgtagcttttaaggtgcaacgagtcacatgcacacagacctttaatgtgaggcagaaattgacgagtggctctgataagagtctgaaaaatgatgctggtgttcataatgggaaaagtcacccagctgcaggtgggcaccgggtctcaaacatggtgacctcgttagagctacagtgttaagcatgatgccacccatccctttgcaagcattatcttacgaaaccctttcttgaggtaggcacttacctattttccctttttaacagatgagtaagtgaggttcagatgtctcaagtaatatgtgcaaaggcactgcactgttgattgaggatgctgcagtctgattcaaatgcccatgtgcttcccatctaacttggctcttgaatggtcatgtcactgcttttggatgaggatactagaataaagggcattgccagcacaaggcattgcacgtgcaagggcatggcagcatgaaagaatgggatggagcggttttgatatggctaagtgatcagtcctgtggtttgggacccaaactaaatatctgttgctccctctctttcatcagaccttggcagagggtggctctgccttctgaccccccaaccgacattctctatgttggaaaagttgaaaaagaattcaaagcatagctcaggacgatgcacacctcagcatcttggattagggctttatgccacttcacaagcgctcttgtgaactgtagccctcccggatcaaatatgaacaacagctgaaagctattcctaccaacctccttagtgtgtgaaatccctgccacatttttaaggacaatggtacttggagtttagtcaatcaactctgaaatactctaagcagcacactagagtgttctccagcaaaccagtgtcacagctgcgtgtgtgtgtcagtacagcgtgtgtgtgtgtgtgtgtgtgtgtgtgttgtaaaatgccttcccttggctcaatatgctttgcttacatgtgggttcattctgctacagaaacctgctggaatcctttggtattaaagttgtgtttctattagaacctcagcttcattcaatggtggggctcattggtcctttgccagaatcataagtcatctagaaacatcatgggaaggtatcggggaagattgtaaataactatgatccttttaaaaataggcatttagaaacagcttcatatgcaagatgccttgtgatccttacaaaaacctgtgaaggctacatatgattctcgttaaactcgttttcatgcttaggaaatacaaatcagtttctcacgaccacgtagctaagagcttcttttcctggttgttttactcaaagcataccaaaaagcttctggggaatcattccctaacccctgtccccagccctctgaagtctcttctttctgggatggtcactacatgggtggcaatcagagagctgctatcagattgggcttgttcaatcaaggtgtgggtctttgtttagtctagatataatttacgtgaacatgcagatattcacatgtatacacccttgtacatataagtacacaaatacatataaataagtatacacatgcatatatacatgtttacatacgtgtatacactatagacaaatacatgcattcctgcacttgtccatattaacacacacaaatatgcacacaatgcacttgtacacatgaagacatgtctgcacagaaaacacattcttgcacatgtacccatgctcacccacatactattagagatattctccattaaccataaaataatgcacgtgcaattaccaaatataatacaatgtgaaagaatatagaagaaaatttttgaaaccatatgtgttgtccacctcacctaaggccattcagctctagcccatactgagaatgctgcaatctgtgtgtcgacctttacaatccgatttttaaatagatgttttgggtttttattctgtggggtagggggctatgtggtttgattgccaactctgacctgttaagatgctcatgtctgtctgggccacttaaatctcagtcctctttgcatttcaaagtcgtgcctttctgtacccactcctgagagagtgggaagtttgggacctagcacaccgccaccaccacatcctaattctgggccaacaccaaagcccggcctaattttctcggtttgctcaactgccgttgtctccaacctccttaatccaatgtgaaaacgatcctcggttcctgtgttttggatcttgtgaccagactaacctcgccagtgcaggggttggtgtgtctgcatgggaaatgcactaatatggatgtttctctttgtgtgtgcacccttgcagtgttgtttaccaggatggattttatggtgcagacatttatgtaagtattcattcacgtgcatgccatccccgtttcctcctggagtcattctttttacaagtttgctgtgaatttctctacttggcgtagttgagtttctctccttggtctgtaggaaataattccgtggtttgtcttgcaggacagaaagccttctgctcttgaacttgtggcagacatcactggctgtttagtggggtggaattaacccctcgatcaacttcagaacgaatgcaattcccccaaaaaggtggcatttctttcatgccaactaaagaccccacttcacccacaaagaaattgtctctcaagttctcgatatgttcttcgttttcagtataatatttaggataacagctgtagtcaccagctgcagagggttaaaagatattttcatggctgctatttttgatgttttccctaaaatatcacagtagccttaggaacactctttctctctctagacatggacaagtttagccctaaacatctcctgattctcttaatatgtatgtcaaattgaacattgagcccccattttctttaaccttttattccatttcccccaattacctgacttaaaattgcttgctaaatagtaacactttaagtttatttttagaaaagagtaggctatttctcattatgagaacaagaatttaactatgttcatctagaggtagttattctccgacattatgatatgagcattgacgatatgaaaatgacttggagtaaacacaattttgaataagtaggcagtgttgggagatattccctaaatcacaatttttattacaaaagacctcagtcaatgggattatatttgttttacagactagatagcaaaaaaatcatatttctgatgaaattggtatcatgtactagaagatgaataaggcactgattattgtattccttttgaatttcaaatcattacaattttgagatatagtatgtatctccatcaataatagacttagttgagttctactattgcatcaagtatacttactataatctgtgggttagtattttttcccccgtaataaaatgagtgaacaacccatatgtcctaattcactcagtgatcaattttcttcttttttgtggaacttaagcttttctgtctcatgtcctcttttttcagactttcagattttaaattatgaggcaggctggggctgagcagtctgaagcccattcatttcctcaggcacctgctaaacccaatcaccagtcctggctctcgactccatgcagcccatgggtagattattgcagatgggaggagccagaatggtagttggcatcgcagaatttagggctttagaaatgaaagggaatagacaagggatagagaaatggttttttaaaaaatccaccaaaatggaaactatctccagcaacacctacccaagaaaaaaaaaatgcagattttcctgagtttagttaaaagtatttcacaatcatttagtgagtgtccacctcttcacgcctcagtttcttcaaactgacaataatttattgaatcattaatgtgtggtgtcttatgcagatatcaaattggtgtcttcttggcctcagattcttgagtagcaggaaggagaggctgcctgaaggcagggtctgtggagctcccacaaataaggaaaaagaagggactcatttaagtgagtgcgagtgtgtgtctgtatcgattggggcatatcgctgcatcagagaatccacagagcaatgcaaatagagaaaaaacaaagttagaagaaggaaatatgccaaccacttgactagagaggaaaaagaaaatttattcagggaagaaagccacagaagtgtccctttgtgcttttctagttcctttaggagattttgtctctcacacattcatcatgtttgggccaagcccactgggtgcagcggtgcagctcgggaagcatcagggtgagcttcaaggacagagtttcttccagtcctaagttgtctgatatgtttgttcataaaactgccctttctctgacttttcaggccacgacccccagccagaaattatcgttttccccactctttatattataatgacaataagatttttcagtgggggagcatcacatatgcaatcaggtggcagaaaaagttcctgcaatatgaatttagagatttgattacccagcacatgtttctgtcctgtctctaacagtctctggaatctggtagaccttcctgaatattttgctttgtctgatgatgactttaacatattgctgctggtgtgcatccgtgtgtatactggacagcaggaaactagcctgtgccactgcccagctcagcagcagaacaagaggtctttgatgaccataagtttaagaaatataaatatgttctgcaccacagaatatacagaacaagattcatcctagctagaaatatatcataatcttgaatgtgctttttaaagccactaccctacctcccttgagataccagcatgttctgatgagtggaaatatccccaagcttcgtttttaaaagagatgatggttaaacagactcttagaaagtcatgtgagcttctactttaaagaaagattttggcttactccttcaagctcgttaaaagtagtacacaataaataggtttagggcaattgtcaacggccccgggatatatgttagacacatcagatacctcgaatagatttaaacctctttttgttattattatattttttgagacagactcactgtgtcgcccaggctggagtgcggtgcaatgtcatctgtctgcaacctctgccccctggaagcaattctcctgcctcagcttcctgagtagctgggattacaggcgcctaccaccacccctggctaatttttgtatttttagtaaagacaggatttcaccatgttggccagggtggtctggaactcctgacctcaagtgatccatccgcctcggtctcccaaagtgctacgattacagacgtgagccactgcaccaagccataaacctcttctttttaagtttattgggtagtcagtttctagcttcggtcactgctaaggaagacaaaggaggatactgtcagattcttcctgctcaaaatgttctccatcctggcagtatatcagagcaggtcaacaactcaacagcttgcatctcagaactactgggcttttctaggtgccctgctctctcccctcccccgtcctttgttcttcaaggtctttccatgcctaccacctgaggttggagccctcgggcattttttagttctgccaaagcacatagtcattgaaagacctgcgtgatccctgtaactggcaagccacaacctcttctctcaaatgacctccttctgaaagttttcagaggaaagaggattgaacagagagggacagatgatcacagatatcttgaaattgccaaagggagtagacttgttatgaaatgctgtgagccagacacgaagggaaaaaaccaggacagctcatttgggcagagagcaaagacaaagccttcaatcctattcaggagctgagccctgcaggaaacccactgcctctagccacagtggagaggtgcaggcacagtgtggttggctactcatcggaggtgatgcgggggttgtctgagaatggagggtaggaatgatctttatctgagtcccttctacctgagaacagaacagaacacacacacacacacacacttttgtataaaaagatagataggaatttaattttcataatgaaacatatcaaatcttttgatatgttcactattattgcttagtggtgcacctttaaatacattcattttaattaaaaagtggatcaagttaagcaaactaaatggtagagtttatacaaacagagttgcaatgcaaggactaaggttcttagatctacagagtctctcatacttggaagtgaagctatagatgttttttgaggtggaatctcgctctgtcgcccaggctggagcacagtagcacgatctcagctcacttgcaacctccgcttccagggttcaagggactcttcaacctcagcctcctgagtaactgggattacaggcactcgccaccatgcccagctaatccatgtattttagtagagatggggtttcgccatgttggccaggctggtctcaaactcctgacttcaagagatccacctgccttggcctcccaaagtgctgggattacaggtgtgacccaccatgactgacccctgaagctataggttttatgaggctagaagttgaccaaggagtggaaaacaagcattgcttaactgaaccaagacatctgttggttgaccttctcagaaagagaccaaaaagtatagcatttgatcaaaagataactattaatattacaaatgaaaagagggagagaaagaaattataatgaactgttaaaaagaattgacaaacggatagaaactggaataacatagtgaggtgtgacaatggtaagagcagagagaaagagtgagaggatatagagtataaatgttaaccttgttcctttttattaagaacatcctaagcgtcctaacattagacgcaaccatgagggccgcctagcaaatatgtcttgagattccagtgcatttttataccattcctaaattctgtataacaagtttctggttaacaccatggctaaacacaattatttctgaattcctgtcactctgccacccatatgttttaaaacaaagaggtatcctcatttcactgatgtttaaactcaggaatgagatgtgtcagtagctttgggaacatgtaaagctggaaagtaggaattctttaaataaaaactcctagtctttcttcctgagaccttgctttcagtgtgaggtggctgaggattggcatttgacttgccgtccgcagtcaccatagtggagacctcagtccaccaagaaatcaggcgaatgctgtgtttgcaatgggagagacaagatgttgagtgttttacctgtattacgtcatctctcctcaccacagcccttgaaacaaggaatcttacctctatttttctgttgttccagaagagaaacttttttgggagacatagcctccctgtatcacccagggtggagtgcagtggcatgatctcagctcactgcaacctctgcctcccaggttcaagcaattctcctgccttagcctcccagatagctgagactacatgcatgcaccacgacgcctggctaatttttggatccttagtagagacggggtttcaccatgttggccaggctggtctcgaacttccgacctcaagtgatccagctgccttggcctcccaaagtgctaggattacaggtgtcagccaccacgtgtggccaacaggaaacttttttttccagaaaaaaagaaaataatttgtccaaaaatcttcagacactgggccttgagcccacatgatttgactactgagtttaatgctgaagccctgagcccacaaactcaagtcattgcgctagttgagcaatatttgaaaagtacggtgaaagatgggaaaggaagagggagagaagtaaaagcataacggggtggttagaccactgagaataatatttgtactggaaatattcaagtaagcagtgaactaggagcgaaaggaggagagagaggaacaagaatgttatcaggcatcgctccgtaagcttagacttttaacataaggaagcaaatttaaactggaaaggcaggctatgtaggaaaaagtatacacaagcctttatagggtacgtccctcagtctcttcaagtgttcagccatctcagtgtctgccctagaattggagaattttatttcaaactgtgaccactcacatggaagattaatcttgaccatgaatgactcttatgtcaaaaaactgcatcctagtccgcacaaggattctacagagaccttccttgccagtgctagatttgtatgaaatgatagcattttgatatgtatattaacactagtttacacacacgcacacacactcatatatactcacagttctctagtctgaaagtattaaaaggagccatcgtagcttcagtgtaattcatgaattcatgaactgcaattttgctgttagttgaaattaatttaacaagtaaaggcatttatgcagttatggttgctactgtgctgttttcttaactacttcaataataaggcattcatcttaaatccttagatattccagaaaattccaatcatgagataaagagatgaatgtgaaatagttaatttggactgttggaatatgctttaagaggcaagaagccatgaaattatctttttcttctttagaaataaacacaagttataacacaaagtggtttgatccccatctccaccttgatactctccattgcagagatttgcaactaaaaatgtttgtcgatgcccagtgcccctttcagcttggtgggccagtcccaaggcttggtgaagtaagagagaagcaaacttgtaaatgaattgctctggaatttgtctgacttatgcattctcttttatttatttcatttttgcattgaaaacattacatttctgtttccttatagagtagtgtatcaagagcctgtgtatggcaataaattgctgcaggtatgaaatcccgactggtggagaaactcatcactatgattgtgggtttgctgtgaaatccttactaacaagataattctggggaggggaacagttctctaacataggaggaaagacttaactgaattttccagttttaatatgaaatctcctagaatagaggtgaggtggctatccctgtatctatcagtatatccactgtgttgtggcagtttcttccaaatatgggtgctgtttccatgactgagtgctgttagctggcctcagccatgagctttgttagatcctgagtgtgtcaaatggtggtctagcttggctgttaattttttagtttaaaagctatctggactcaatcagtataaatccaatgaaaataattcaaggttctaattgaaccaattgtctggataattttttagtaggttcccagagtgaaccggaatggggttaaatcaagaatctcatgtgcaacattaagggccagcatacctgacatctaacataaccctccctggtcttagtagagctgatcagaaatttatttcaagcctgttgttatagcttttaaacctatttctcactgctaaagcaaccaccaactgaacaaatttgtaggaagaaaaaaagtcaacatattcattggaatgtggctggcctagagtctccaaatttggtctattacccacattgaaaccgtcaaataagatgaatgtcaaactgaggatgatcagtgagagttgtaggacattactttccctatctctgcaattcccttttttcttcagtattatgagtgaattacgaaagtactttttgtaaaccatgagaattgactgagttttaattaaaacctgaatgtgagaaagaggtactttgacctagtaaagagcaatatggttaaaattcctgagatgaactttcactgtcacatttcaagagaactggacctccaactgccacccttcaaaaatagatggatgtggccaggtgtggtggctcacacctgtaatccccgtacttcgggagacctaaggcaggcagattgcttgaggccaggggttcaagacggggccagccaggcctatgtatcaaaaccgcatctctactaaaaatacaagttagccaggcgtggtggcacatgcctgcagtcccagctactcgggaggctgaggcaggagaatcggttgaacctgggagacacagattgcagtgagccgagattgcgccattgtactccagcctgggtgacagagaagactccatctcaaaaaaaaaaaaaaaaaaaaaaagaacatatagataaattagggagataaatttttcattttaaaatgttcttataagtattatatagtaaataagatttaagttgtatgtgtatataccagcacacctgttttgcaccaagtgagacttgacccttgcatattttcatcataaagggagcctttacccctagttaagctgatttactttcctatgcactccagctgaaggaagcatgcgtaacacgtacatgttacagtcctaccgacgcccacgtctccctagcacacacaggtttcccctcccctatttcactgtttggccggtagaacatttattttcaaaagtgatctaaagtgaaaactttgatttaagcctcaaattctctgagatgccttggaggtccctcagtgttcatgaatattgtcccaaggagttccacaaacagagtaaccagtttaatttaactgagcatctgccaaaccagtttggttgtggaaattttcctttccttgccaccattaataccccacaagcataattttgaaactgctttattagctaggcacagtggcttacacctgtaatcccagcactttgggaggctgaattgggaggatcgcttgatcccaggagtttgacagcagcctaggcaacatagtgagaccccatctctagtagtaataagagaacaaaatgctttattggagcatcatttgaggtgcttaatgggtaactacctcaaaggacctctagaggttttgctaacaaaggaaacttctcagtccacatgagtggatcactttggtggcctcactcatttggtggtggtggcaacaagatgcacaatgacaatttgaaatttttatataaggttacatttatattttgctgcccatcctgtgaagaaataaatgtttcatgaatgggagcgtagaactattttgtgtttgtcatgcctcgttcctttggtttggtggtgggaaaaatttaattgtcaatgacacatttttgtcaaatgatctcggaagaccaggttcaacatgaacatggtctggtgacagcaattgaaagtgagtgttccttttacagacatcactgtggaaccttgaagaagttctggatatgctcagtgagctgcaaaatacagagcgataaaattgattcaagtcacctgttaggaaaattaaagcaatttgtatttttgtatgtaaagcaatttatattttacagtgtatgtacacatacactgagttaatacacaactcttatttccctagtatgaattgcatacagaagaaaaatagcaaaggaagaccatgcagtaaagatagaggagagataaaaccaccctaatccctttttccctaattattacatgtttcagggatcatttaggctggtattgtccaatcctttggccaccagtccccatgtggctatttacatttaaattcaaattaactgaaaagtaaatttaaaaatcagttcattgcactagttacctttcaagagttcaatagtcatttactagaagtagctactctgttggacagcacagatatagaacattcatctccaagtggtctactgcacagcaatgagaccactgatcaaggtttaaaatctctccgctggctctggagagttaaggaaattgtgatcttaaccctggaatcaggaatgctcacaagcaaatttctagataataaagtcataaataatatcagaatattgacgacttgtgcccgtcttgtctggaaacacacattttctgtaactggccaagtcatatgcaaacagagtagaggtcattttgagaccttcatagatgaccacatttgctgtgcagcggaatcccaggtgtacacacctgcatttgatgtttctactatacataacctactagtcagtgtggttcatttagttgtttgcaccgcagcaattcttcccatttatcggactcgctgccttcttccattgactgaaactaaggcagaaggtggaggatatgcaaagttcaaaccaagaggcttgcaaataggatgttgctagacatctttggtgggaccaaattcagtcaccaaatcatgattcacatggcatctgattgctgcaaatactttttcttgttccagagagaaacacattcataccacacacattctctccactcaaaactttaagcctgttgcagctaatgtcttctggaaatcagctagccagttctagcccctccctacctcattaagtttaatgtatgtacctgcacacctgtatctttctgtgaactttatgaaagccaagaagatgaacaagctatatagaaaaatggctccataaacctggtgacccaatttctctttagtccgtcactctgttgaactcagtgctgttataactgctttggttttataactcctcagcacatttaatgagttccccattcctaattggagaacatagtatttggaacaccaggtggcatctggctaagacctctttttgttgtggttaacttccattacctctttaagggaaacaaaaaaaaaaaaaactggttctaaattattggtgattatgtggcaggatgttttggatgtgtcttctccaggactgatccaaagaataaactttaaaagataaactcgtttctttgaattgctgtgcaaatgatagcatatttactctgaaagttaactgtgcaggaaagaggcagaaagaaattgagacccgtgtacctacatcttgaaagaggctttttgtagcttccctgcttcatctatgtcttatcgtatttagtttcatgaagccaaatgccatgaacctacctttccctctcatgattctgctgttgtataccttctcacacactactttgtcctgagttgcccctttatggtgatggtgaggacacttacctcagaggattatgggactgtgtgttctaattagaacctgaatggtcctgtgttatcagcggacactggatcctgtttaactgtgctgagttcattgtacactggttgatgtatcattgtggtccactgagcaagaagctctgttatattcacagtttgatcatcaacgctccactgaacacaattccttttgaatatgcctatttgctcgtcctctttgcttaattgaacaattgcaattactggtacatacaactaaatgttaattattttttcttttcagattttttctgttaatgattttatttacaaattagaagactatcatattttccacaccaaacaaattctccgtctgaagcagcatgatacataaccatgtgatatctttggccaaaaagaaatgttcagtcatttttgtaataattgtgtaacatttagacagctacagacattcttcaataacattagtggtttaacaaccagataggtaagagattactaataaactttcaatcaaagggtgatttaataaatataaaagacaggaaagcattcactttataagaaaataagaactgtttgaataaaatttaagttaatatctgataaaggtaaagcagaaacaattttgaaaatctggaaagttcagcaaagtataaagagtatttaaataattccccataatcctctccaccccaagacaatcgccattaacatttaggtacattttcttccaagggcctctaggctcttcttttgggatgtgcttatgaccgctaacctttaacatccagctggggttggtattccaccccttgtttctccagggtgtttttgtattttcgctttgatactaagctttcattaacctcaactttagctcagtagatttgggtaacagctgctctggtgtggtcttgccactgggcatccctgcattgggctccgctacattcctgagtcacatttctccttgtgttttagggtggttatgctgcataccgctacgcccagcctacccctgccactgccgctgcctacagtgacaggtaagggtcatccttcttgtgcttgacaactacttgtaaattaacttagttgatgggagaggagattcttgtatggtcttggtgaaactgcatgactgctgggggaggtagcaccccaaaagttaggtcccatggtgaacgtgaactcaagtccccatagagagagggcaaatgcttcagccaattctaaactactctctctgctgagacacaaagaaaatgatagccttggtccttgtgtagtttttcacatctcttaatttctgtgacaacgcaccttgctcacatacacatacacacacacacacacacacacacacaccgtacaaccttcttatggtcttccacataagaccacggtttcatctaactcataggaagaaaaacagaccatgatcctacaaggtttacttcaatttcaagcccctttcctttttacaaggtcttatacccaataaatcattccctccattgcattattacaattctaaataaaggagagggagagtgtccctggcattcataaggagattgattctttctagcaatgcccagtgtccaatcctacaaacataagccagcttttatttgtaatgtacaccacatgttaaggcaggcagtggaaggaacacagtgtgtttgaggaatgcagaagtcagaatggatgggcaggttgcgggggtggggtggaaatcaggggtttctatcacccaggctgaacagatgagttggttcctgaaacagcaagccgtagctacttttgtatggttgccttgaaaaggaaagtgtgtgttttcatattgaatgcaactccttggctctgttttctgaggacataaatgtgaatgttcagatgctctgcatgcacaaatgtcattgagggtgcttattttggtaatgagtcctttattttaaaaatatgtttcacgaataaaacaatgataacaatttgcatgtgtggctggggcatgctgggtcagacaggtaagcaggcgatgtatttgactcctgaatgggaagcgtcagcagcctctggtcctcctacctggcctgttgtgatgtagttcctacctcggtttgctgtggtgtgctttctctgcagttccattccatttctcacgagacgtggtgttagctaattgtagctacagaattcttgcaatataataaagcagaataaatccctgaatcctaaaagctgcattttgaaaaccccatgcatacacttgtaacaaatggctctttggcaagatggagttgagatctgctatctggttctatgcaggtatcattttcttataagcagccataacaagttctcaaggctgtagggggccttcagagaaatccagacaattgtcaagacaaggttctcaatacataaattatacatttaccgagtaatcagttgccaagatgcaaaatgtgtttcatgtaagttgttatctccaacacactttgacactggattaggaaagtagagagggtcaataagactaataaaaatgatgacaatcttgaaatactcaagatcattctacaaaggaaaaggcctaatgttattaaattctgcactgaagcttcacaaagtatcaattgtaatgtggttcagctgcaacccttaattattttttatgaaaatatctctagatgctaaattctcaaacacccactttgtatataattataatcatagtaactctagcctgctgtataattataagaatcttaaacagatttgatttatcttgcttttcagtataagtgcatctatccccaagttgaaaaaaaaagattacaaagatatgatttaaatggactccttcaataagactggtctagacatttaaacaattaacaatatttaatgctattagaattacctgagattctggccatccctacttgcattcatctaaacatttttaaatttctgcattttggaacaccatacatgtaaaatctgttattttgatattattcagatttctcattggcaacatgtcccactgaaagattgcccttgttcttggattggtgaatctttaataactgcaattccaactttagtaccatagtttcagttgaagaaaccaactaactaatactgttgtccatataattggcctcttgttgttcattagagaaatttgcacatttggtcttcttggttgctgtggaaattgataactattcctatttaactttatcataagcaagacacttgccacatggtattattcattgaagtaaattaattaataagtaaatggacagaaagcaatctttaaagttgtatttctgatgttttaaaatgtctattaaatggtgctacttccttttatctgtaataagcagatattgagaaagaatacctttttatagaagacacgtttaggggaaaatgtgaaattatcagaatagcttttgaatctagattaaagatgccaagtacctataatttctctcagaagtagcaattgtgtaaccaattatttttatatcatcacagcatagaatcagtaagtgatggaagcttagttcctcttctgtagaagacaggcaagataaagaaaaacttaacagaaaaacttcgtccaaaataggaagtaaaatcagcaggcattgagaatgttttggtaatgctcactggttgtcagttgatcaaaagagaaacagcaacaaactttccctgtaatcatgagattcactcttcagacatcttgaaagcaaaagaagtttgatgtccccagttggtaggattttaccttttttcagcacaaattaagccctcatcaaatgaaagattcagggatctttgaaaaatattgaactccagtaacctcaggactgtccagaaggtccttaatgggcaccttgcaactccctgcccatcatcttcttggttaaatgatcacatgctgattatctcggagcaacctgagagtctctgaatgttgacctccagaaagaagaccatctggtgtgggcagagatttccccaaaagaaaaatacctgactggactaggtaattttatagtctcattgacaaatttaatgggaataggtgaacatcttttcttggcatttaggaaacatttggcaaagcacttgaccttcaccaaatctttatttctaatctcactttgatttatgcaaagccaactgtctgaactttcaaaggagagcgtttcctgagcttgaaccaactgaagcatggcagaggggcctttggtcatccggtcattgcatgccacttggtgttgctgatgtgtctgtgatacgttctggattggacaggtccatcacatcagcttgatgaatggcttgcttgaattaagcctgggggcaggcttctctttattgattggctcatggtttgtgtattatgacttggttgttgttgcatcttgaagcagccaaactgggaggtgcggagggggtggaaaagattccctgtttgatcaactgtgccacaaatatttgggaaaatgtgatgtgtacatggctttgatgaaagtgttatctccccagacagacagacatttgtcatgcttgtcctgcttgctaacactcttaacatttcctaatgatcagtgcatgaaaatgtccctccacgtcagggctgaaagtagctagatgcagaccgcctagagacggaagcaagacagtttttcactcagatttcatcacagtccaattacactgatagttaccaggggccatttcttccacataaaacatgcatttcttgtaaagatccatgaaagccaagaagcttttgacattaattgcggcaccaggccacacaggtatctctaaactgagcaaaagatggcaaccaacataattttgttttaatgtatacctttttggattctgaggccttaaagtttcactgctaatgtagagttagaaattgctacttttgtgtgacaaaaatgacatattggctctgttgtaatatgaaaatatacatatatctacataaatgttacgtagctcaacttaatagaaatccaaataaaatgccatattatcttcctctctgcacacacacacgtacacacacacacactcacttgtgccttggggcctcacaagggacttataagtgttttcaggtaaagcttaatgcaaagagaccagggcttgttaatttcaagtggtcacaaactacatgctagagaacgtaagttaaatatgacattcataacctatgaataaaaggttctatttcagagacagatttgtgtttcttagaacctagtaaggataagtaggcatattttcaggttcatagaggatttagtcttattttaaaattatttaagtgacagagatagacatatacatacatccatgcttacacatacatagatgggtgaaggatgggtagatggatagatggagataaatcgatacataggtgggtggatgaatggaaaaagagggaaggaagcaaggaagggaccatctttctgccctctaatatttcatcataagctaaatacagaaaataggactaaatccttatgcacaaaagattgtacaagctgaactaaaaaagtaaaaggatttgagttgatttccattagcgcaggctacttcctgtctattttagaatttttctggcctcagattaagtagtagagaaaggctgtcatgaaaatagacaggcaaataagtatatttacagtgatattccattttaattggagttcttatccgatgatatatactaaaaattaaggaattgtcagcatataaagtatatgagcatcctgaatagaaaatttaatttaccatttaagggcttatttttgtaggaaggttaattttttaagaagatgttgtattttatggacattatgttttcattttttttttcccatgggataggatatagtttaacctgtggataatttggaacccttaatgaaagtacacatgcaaagcagacaaagggggcacttgctttgctttccccagtcctcttatctgaaccaagtttgatagggattgaaaatatttctagctaaacagcagtagcagcccttgttcttattctttgtgatgtgtggcaaggagagatctcaagatcttattctagtgccgtattgaaagcagtatctcccaaggccagttcaagacctggcacctgcctttgatggcatatttacggtttatcaaaacggaagaacaccaaccatgtaatatggttgtcaaccctcttttctgggaaataggctgtatctattcttccttctcacatgctgtttaaaaagatttataaaattagaacaatagcaaacggtagttttagacatccaattttgtttttcatgttcttccttggcaaagtaaacattggcaactttatgctagactctgtatcattttatttacatttgcagtctctgagaaatctgttggaaaaatatagtgagagcattgtaaaacatggccatgccagagatggtattctcagatcaacaaggaactgaggatggagttcttgggggttcagaagggatgggagagttttccatgccatcttcccagctgggatacagacccaaaggcagagagaagccacttgcaagtttgagtctaggctgtggaatcaatacgtggcaaataagccaaagtcatatctctgtgccatttttgatggtgctttgaagaagctgttcttggttttagttttttttttttttaatcttttatttttactcaacctgatgaactctcttgggttctataattttttttaaaaaaaagatgatctgtcaagttgtaataagaatgtagcagaaatgagtcactcatgcctttatttacatcctcctgtgcccctgtgtctagaaaagcacgtccaggttttagttagaactccaggttgagcacgtgtacatctatacatatctacatgtataaacacacactttttcttgttcatttaaagtttactttcctaacagatccattttgttgttgttgttttttggggtttttgcctattcagactctccttaggaagaaaaagtgaaagcaattgtcctagacagctttcgggtaactagaaacacacagttatacctgtgagattcctattacaaagcacacatgccagataaatttcttaatacttctatgtgtgtgtgtgtgtatatatatatatatatatatataaaacagtgctcctcttaaagtgatgttgattgtatattctccaaaaaattaggataactaagataattctatttcctcctgatctgctctgtagactgtcactgatgtatggagatggctctgaaatagtgaggaagggaaggtacatctcagcttttgatagtagagtcaccgtaattttttaaaattgggtttatgcatgtcaagctctcagtactgagaagtaatatggctgtaactgatagatatatttcctgagtttctcttagtttatagaaatcacacacacacagagacagacagacagacacacacacgttaaaagaaaatgtgttcaactttctctctcaagaactaattgcctttggtccataatctataatggcttcataacaactgttatgcactattggatgaatatgtaattgaatcagtttaaaaaaagaaccaatcctgtaacagtcaacagactggaccaccaaggagttggggagagattaaaggaatttccaagcccaacagaccgtagctgtcacagccacgtgggtagacacttttgccagtgacaaggcaaggtgtaacaactcctttggtcatgtcatggcctaattacacactttttaggtcgcagatcattgacttgataggccacaaaaaaggaaataaagcctgtcttttcagtagcagcatcagaacccttcagctgtgaagggtttagaggcaggttgggaaagcctaatgctttctaggtgtagctctgttgagaatatacgtgcaaagccctatgaatgagccatttctattgctaaaaaaaaacctgcattctagaagacagtaatccagtaaagcagaagatagaatatcttagctcatgcagcatttgtggatgtggcaataaaaattaaaccgctccactttgttacgttgttctttgtttgggttttatgtcactaggtagtatactatggatggtagtatactatctttcaagataagatgaaatttttcagtaaaagtgtctaatatttcattttaagttatcaaagcaagttctgactctgtacttaccacaagttgaaattcttttccagaagaactgatttctatttcaatgtggcctctaatttatttccacttttgtgtgtagtacatgcatgtaagcagtcaccagacagaaatgacttatggcttccttggtgtaaatcacaatgcttggttcctgtggaattaggcacttctcaaaaactatgatgaatttcatatttaattaacatatgaaacatttagaataggggccactattggaatttgaggggatgggagtctgtggggcaaaaactagggagaatagaaggagtaactagtcacttttctttttttccaagctaattattgatacattatgatgtgtgactgttcaaatagattaacagatttctgaaagctgaaacataatcaaagccaaatattctcgtaattatcccaatcatttagattgaaatgctttggcctgagattatagaaatatgccacacatatgataagctaaatcagtggttctaacgggtcttggggacctggaatttaaagaaaaaaaaaaacatgattgttagatgcttctaacatcctctcaattcttgcctttcatggtttcaattttgtaatttaaaattttagaatgtattaagagatgaagaacttgttttttccaccatttctgctttgttagagtgtttgtggatgactactaccaaacagaatatgagcccaggtagtgggagtggaggcactttaataattcttcctggacaataccagcttccctgttttttcagaatgatcgtttccccactatttttgttttcttccatttctgtctcccaaacttagaaaatgaacaaatgggggaaaaggaggattaacttgttctgttttgaaatttcaagatttgagtggatcatctaaaaagcctgcagagccttgccttgtaaagtgtagtttccagaccaacaccattgggctcaccaggagcctgtgagaatgtagaatcccaaaccccagtcccagccgtgctgaaccagaagctgcacttcccagactccagaatgactagtgaagtttgagaagccccactttagagaacaagcttctgttctaccccgatatgccataatgttgacaaagggttgtcctgccacaaaccttgcaagagataagaggatctatctttataaattattgacttttattaccattgcctctctactctcccttcttcaatgagagagtaagaactatcaacagctgagtgacttcttccctctcctggcccagggccacaattaattctttaccccaaaagatccgtggacggaaacagttatttatgctaacatcgtgtcattaattgcatagattcacgctaatataaaggagtacctgaaaaagttccatctgatttcactttactgaccctcagttttttcctatgctaagtggaaagcatggtactaattagaatcagaaagagatgaagaaggtgaacattataaactgaaagaggtggtgcaaatgttatcaataactcggtttcagattgacatattttggaatgtatgctagtatttgcagtgaatatatagaggcagtagcaagtacattaaattaaatgcatttaaaaatgtaaggttatttttagtctaggcaatctctaagacacactgtaacactaaccctctgggaacctgtgccttgcttagcatcccaggtcttgtaggtaactgtgtcaagatttgaaatcagatcttttattctcattggacctactctgatatagacatgcactagcaaatcattgctgttgatacagagaataggattacagattgagatttacacgtgggtcctgaatctctgtgaggttacttactacacgagataatttgggcaggccaacattgagctagttgaccctcaactgcctcatctataaagtgggattaatggatgaccattgcttctttgcgtggttgtgagaatccattgctgtcatgaacagaaagcccctctaagagatcctgacacttagttctcaggatattagcagcagcagcatcactgaactgtgggattatcgtgttctgttctcgagtgaaaaaaaaaacaaggagtttcctgtggaaacgggttttatgagttagaataatttttgactaaatacatttgtttttggttgttttaaaatcttgacttctaccctagaaatataaacataggttggggaatagaaattgggaaccgcaagatcaaatatcctatccttctttttcaacctgtgccttggatatttgttatcttttctgctcatggatcagcttaggccaccacacatgcattagctttgtagaagaaatgcccaatctcccagtataaacccagccttcgaactatcaccgctttggatttttgtaaaaccaattgcctgccctcttctttgggtggagagagaaagagactttcctttaggagtctacacagacaaaaaaagaaaaagccaatttttctaccaataaaatgacttcacatttgtttctcattcaacttgcacaaaaggtctgggaagggcatgtactgtttttatatctcaatttttccaaatgaagaaactgaggtccagacaggtgaaatgaattttctattggaatacagcttatatgcaacaaagcatggttttcagattcacggttggttctctttcacctgagcctagacaagaagtgcagtgggaactggggagaatgttaaatgttggaggaactaaaatgacaaaagggaactgttcaaggtctccaagtaatggagatgaacttgggtttgaatttccaaaactcagatctttttttggtagaatagccaaactggggagagattcacagaccttatcttctttctgtttaagcttctttacgaatatcatgttagcaataggaactgtgtctaaatgaaatgtttttaagtgtattttcatgtgttcccccttttcaaaaagagataggtgtaggacctttgagagctttctataatcaatctgtttggttacttgtctgtgtataccctgtctcattctacaatttgccacagtgtattgaagtacacgtgacaacactaaactgaataaaagtgacagggcaggtaaaaaatatgaatctgaatgggatttgtaccattctggagtagagtattagtattttatgtggaaaggaggtaaaatactgattgcaaggaacctccctttgaaggtgataaaactgaaatataaattagattatgagcttccagacaggcaagtccaagatactccagtgatttaaaggatatgagcatagcatcagaccccttagacttagctcagtgcctgatatgtagcaagcccctcatttacaatctgagggctgaatgatgtgagtcaactctttggtaagatcagcaatatgaattttaataggtacatcctatctgcatattatgtttaatattcagaaaacactcatggctgagttccatatggcacgtctagcaattttaacaacaagaataaactgattattgtgactttccaccttaattttacatgtaaaaaaggaagcaacctggtaagcatgattataagacaattactaattataactactgtaattagtataattagcaattaaaatattaagtataaaatgttaaaaatcaacactagtgcaatttaaacccaaaagacacaactgtttcctgaagaggcaagatacatatgttcagagaggtattcatacagtgagatgagttctccgtgctggctgacagatgagaatcaaccccaggggtttttcaggcatatctgtacatgggaaccactctcaaagatgctcaagttaaatgaccggggtgtgggcctggtcattggtattttatttaaaaaacaatcctagctgaatatttattaaaaaacaaagtattggctgggcagtcagggctaaaaacctctgccttataaacaacagatatcccaatacgtacaggtagaattggattttgtcccactgctatcctggggcatcttggctgccatctaccaggccagaagaccaacttctcagctgtagggattgcctagtaggcatccttggcaggtttaaatgtgtgtgtgtgtgtgtgtgtgtgtgtgtgtgtgtgtgtgagagagagagagagagagagagattcaatattcatagcattggatacaagaagaatcttgctatgagtgatatcgatcctgagatatatttaacaatagcaatgtaacagaattaagaagccaaataatgagaagtgagcagaatctttgcccataagacttaaagacagtattatttgctatggggaatgtttacgtcccacctgcccgcaccaaaagttttctctgacttgatatctagcatctcatgtcccctccagcaacacaggctggctactgttttaatttaactctgagaattcagctgtgggtaatttttcagaaggaaaactgccaagagatgagatttaacctaaggaacaaaagtgggctatgagggtgatatgcggcaatccacaggactaatttaagtgtaccaccagctgaggcagatagagtatagatggttgatctataaaaccatcttaaaagattagtcaggctagtgacataagagtgaaagagacagaccatggcatatgccatttcataatcaagttgttgttagaatatgtttttaattctttctctcaattattctcaaagaggagttcaaatatttcttagaggaaatgaagattcagaatgttaagttactccacagagacatcacacctcactgctgattaaataccccctacgtgaatgttccaagcagaaccttagatagtaaaagcttggtcttgagccaagccaactgtgttcaggtttcacctctaccacttaacagctgctcgcattatgtaacttttccatgcctcagtttcgtcatctacaagacgaggataaaaagaagggttataagaaaaattaaatgaatacataggtatgacacttggcaacttgcagtcataagtgccccatcagtgttagatagtagccgttgcaatcaacattcccatgagccaagacaaacacagccttctcccttaaactcaatttggccatttcatcatttttcatacattggtaatccttcctcttctccacccccaaccaagccttcccagttcaaaataatcttcctgggacaggtgagctttgaagtgaaaatgggaatgaacttgcagatttttcagcaaggttgcccaaacttcaaggtaagaagcagcaggaggcgtgattccctcacagcagaatctgctacctacagaacagtgaaaatgagtgcctgtggagctgatcaacaggcaggcctgagttcttattaagtgtatagattaccagacctctctcctggaaattctgattcaggtggtcagagttgaaacccaggaatctataccttgaatgagcactctaggcattcttatcttcagggaagttggagaaattttggagtggaagagaggtagaatatagaaaagttgtgggtgacaggaatgggaaaatacagaagtaggggccaactcaaagaaaaatggaaaaacccaagcaaggatgatcttgagtaaatgcataagaagtggtccattaagaggaacaggtaaggaagaactcaaataccaagagtatgatatggccactgtagagcagtttctctttcaggatgaggtttaaagtcaactcttagaaggcatctagaaactagaagtaccctttcttggatactgtatcaggtttgtgtggttgcatagtctaaaacctaagtagctaggttgccctggaggcaagcatggtggccaaacagaagctgcaaaagtagaaaccaaagttggaagagattcagtgattcaactcccttgaatcccttccttgaatccacttccttgaatctcttgaatccctctgccttggtgccataacactgcttctcagctgggccacatattagagtcacctatagagcattttccgaactactttccaggccctaccccagatcaattaaagcagaaacctcaggaatgggccctatcactggcactctcttaacctctatgaatctaaggagcagccaaggtgaggaccattcacctcaacaagtgattttcaaacgaagaacgttagcacattagaatcacttggaagcatttaaaaactgctgaggcccgagacccagtttcagaggttaccatttaattggtcttcagtgtagcttggtaaccagaaatttttagaagtgcaccaattatttacaatgtgcagccaaggttgagaacgactcagccagacttgttttatgaacaactaaggaacagaccagtttgtggaaaatcaggtgcattttgaagtttaaattcacgggtctgtgttgagagaaagcagcacactagggtttgcataaggagacagaccctggtaccagccttctttcttctcctgagaggcagccccactgtccagaatatacctgcattgttctgatcttttaatttttctgaagttgtttggatatagcggagacattcgtctctttgatcatatgtgtctctggtcatctggggcaaatggcttgagagagggtcatagatgatccatttatgggccctctaaatcaatagtcttaatgttcaaggtgaaacagctgtacataaaatggcataacatggtgaatatagacagcaacatgcaatctccccttagaactgtaccagaattcttctgttgtcctgacactgcaggccaccaaagccaatctgattttacagacatttcctgttaattgcacttaccgattgatgaaagcattgttcagggaagtagtgatcacacagattgaattcatggaattaattaatgaactctatagaaaggcactttctgacaccttatggtgacctttctgggatgtagtgggattgtttatgtggattaaaaaataaaatagtacagaatggatacgtcaaaaaaatacttaactggtagctgttaactccttttaaatgtcactattattgagaactctgccttgaaacagatgtgaatttgtagtcagaagtaatctaagccaactcttttgaagagggtgagttgtcaaagggagtagtcccttttgttctgaaacttagggatcaagaagagaccaggggtaaaaaataaaataaaaatcaatacacataggttttcaaaaaaaaaaagtgggggagagaaagaatgaagggaaaatgaaaggagagaaagaacggaaagaaaacggaaaggaaaggagaaaaggaaggaaagggtaggagaggaaaagaggaagaaaggaggaaggaaaaagggtagtttaaggttaagtgcagactcaaaaagaatactttcaaggacaccatcatactataaaattctgaaacaatttttaaaaacaagcctagtttcttagagggctgtttctattcatacttgtaggttgcattttaaaagttacctattcgttcagtcacaattttacatctgtttttgtctccaagtggctttcctgatgtctagcacattggacagttccttagggaaaattgcagaaagggaacacaagctagcaatctgttctaggattaggcagtagaaattgggtagagctgccccaccctcctgccatagatatgtgaatgcctagtgcaaagaccttgccgctttggataaatcatgtcgccattcttgcttacggtagcattcttaggagcattctgtaaatagaggttattctaagtgcctgttttgtgcagcccagaatatcatacctgtagttaggaattcccgtgttattgccccttctataagtcaaaggtgagtaagtcaaatattcaaccaaaatatctcctttgttttcagggataaattttattgctcctctaacatagggaatctggggccagatattcatgcggctcaaaaagtctgtgtcaaaaagcccaaaatcttatgttaacttttattgtcttaaggaaagtgataaacttagttgtgacttgttatgtaggagaaaagtactaaaaatattattctcaaagcatgtataacttgtttatattttattggtgtagaaatgactagaatttaactgaatgtgaaattctagggaatattcaaatggcagctctatttatattccagggtgtacctcttgcaacagtaaaactttcttaagatgttttaagaaatgctccatcactagataccttttgaagcactgaaacatttgaacaaaaccaatcatactaagaagaaaaatgcatttatcttggttcttggtgatccataagcataataaaaatctaaccgatgaaaacccagagcccctgtactgctacttttgaggcatttacgaacctagccaacctcattgtgccatttttataatttgactcagacgatcttatttgtagacgaattagtacctctgaattagaacacataatatcgtggaagtgtcacagttggaaacgtcttaagagagttttatcatctttctgggtttactaaaagtaaaatagcattttctattttcattatttttaatactgcatcattaaaaataattagggtttatttcaattgacaagttctcttagctctatgtagcaagctgggtttgatgaggaaattattatccataacacatcaccatataaaattgtcttctgaaatgacagcactttttcttatttttttttgatattataagtctagaattttataatttttctagctagctgtagtataccctatttcttaatcattagtcccattttaaaaagtaatctctttagcatagaaagtcatatgagcacaatttgaaatgctttagccttagaaacatatcctggcatgttttggtaacacatagtattaatatttggtgcaacagcttgtacatagttcgtattctgacattaccatgactttaagaggtccccgcatgcttatttcatgatctttctaaactctgaggtacatcagcacatttcctcgcaacatccattcacacgcagcacccttccctcccctcatctgtacacatcgaagcaattggcagagagcacatttccccctgagcgagcagtattgtgaattttatcttctcttccagaaatcagttcgtcttcgttgcagcagatgaaatttcttgtaacacctctgcaggtaacaaacgttgctacttcttgatgcatccatccaagtctcagtatccttttttttttttttttttcttcttcacatgctgcagttggtcactctagaaagtttagttaagaaaaaaaaaaaagatcttatatctttggagtacagctgaagccttgaggctctgccatataagacgacattaggcattttgctaactttgatgttttatttctggttttaataatacatggtccagaaaagtaagagtatgttgaatgaatccacaagaaaatcttacagtataatcagtgctcttatggtaaaatagggaacaggaagattaggtacacagacgtatgacttccatgttttttgacgtgttatgtctgggttcatagagactgatgtgtgaattatttgggatctttatggaatattagaggctgtaaaagactgaatctataaagcttagaggcattcgagaatataattatctctgtcttataagaaggggatcttcattctattagccaaagatcctctatttcctttcttataaaacatctctcaagtagcaggacttagagagaccaggtcttttggttttgaaaccaggacattggcaaatggaaattgcatagctgcatgatacgtccatcaaaataacacctgtcttttttctttgatgtggttcagaacagttaaatttgtactttgattagtatggagttaattaaatgccaagataggtgaatgccttaacactagatttccttctttttccttttgtcgtttttaagcctaaactatgaccaaaacaatcactaggaagtcttgccaatgtgttgctttcagcctgcgagggaggacgttacaacttatcactacataactgagcatcccatgaccttcagacacatacattaaactgaaccttacaaataaacactcatctgttaccttttatcaatgctgcagtaaaaaaaggcttatgtgccaatgtttcactccctatttactgcctttggtgagaatgaatgaatgaaaggaaggacagagagctaggaacatgcacccaactatctctgttctaaaaggcagggtcagttttatttatatggtcagcctcaaccttcataacgggttaaagtcttacctggtgagttcaagaggtatgcatgatgcatgctgacattttaaaacaatggtatactctttctataaaacctctttgctgatggtcctgcaatttccctcttaacccctagactcgtatctctgcttctcattgtgagaggtggcgacatccttaacactttactaatgcccagtgctaggtgcaatggttaattgaattgctgggagtggcagggaatgttcctgcaatacaaaagttgtttaacattttcagagccttagtggaatggagcatgaaacaaaaggggagaccgcttggaatgggaggtaggggtggggaataatgttaatttaaaatgttcataggcctcatgtatagatgcctcagtgcactagagcttctgccttctgttaacccctgtgcatgttccagtatgttaggttatatttggacatcttagatcaaacatgaaaaagatattgattttgccccgtgacttaaaccctgccttataagcaagtgatccacacacaatatttctaagaaaggcgacagaaaatgaaagtttgcatgcgtgtggtgagtgtttccatctacctaatctagatggctgctcagtaaattcttaatgaattgctattgatcacatttcagattgagagagatatccctagtcctttgatggccattttaatattatgttgcatgcttcataaggttccgtttgaactctgaattttgaatgaagcatgaaaaaggagacacccatatccatcaaatgtcagattatctcccagcaagttcaccttgctcatagagcgaaaatgaaaaatcaaaactgctcagtcaacaaaggttgtaactcgtggtttcagtgaaagccttctagggcatcatctcctacatgctgaaaaaacctgctttgggaggccaaggtgggtggatcatgagggtcaggagtctaagaccagcctggccaacatggtgaaaccccatctctactaaaaatacaaaaattagccgggtgtggtggcacatgcctgtaatcccaactactcaggagactgaggcagagaattgcttgaactggggaggcggaggttgcagtgagcagagactgcgccactgcactccggcctggacgacagagcaagcctccatcaaaaaaaaaaaaaaaaaaaaaaatcctgctgtgcccactacccacattctaaacagcactactgtaatgagctctcacctccttataaaaacatttattagagcaggtgtattgaatcctgctatctactggatatcagagtttgacaaaagacaagttctctatttttaaatggagaaaaaaaaatcaacatgcttaaaatctcagtgtggggtttgatggatgttataactgaaattcttataaagaggtgctattgtcacattgatgcccatggtggatgggctaagcataggcagccatcaggggcttcgggtggagatagtgagatgaaaatcattaagcagtagaacagcagcatttcaggatttgttcttcacgtttcccaaagaaaagcaatgccttttacgtgggtcttgtgtcgagagtgccaacacatctggtctgctttttctagccacatggaataggcatttttcattaacatttgtggtctgtgagactaatttacaaggatatctattttcttacctaggagtttcaacaatgctattagttgtgttgttttgttttggtttttcccaaagaatgtgtgctctgttgggtatcacttgggactaggcttttataacagggcaggacacctcctaatgcatccagcttggacaactgagtaggtcctcattcagtaacatcaagaacctttgatgagttggattcttcaatagatggtgaaaagggagtaaatgattttcccttcttagacgggaggtctccgtctgtgattcattaggaattttccagggtgggctagtgattgtagtagttgcagaagaagggtctggtatgagaatggaggttgaaaagcaagttacttaatcagtgactagaaattcattttagtcgattaatatctctagtcctttgtgggtgtcaggaactgttctaagccctggggacatagcattaaatgagtcaggagaaggtctcatcaaaagaccttcatggtatgggagaacagatcccaaagcacgtatatgaataagcagataatatatatgcatagtaagttatgtacttactgtaatgaatcaaaaagcaggggaggggatggaaagtaaggtgcaatgctattttagactcagccatcagagaaggcctgtctgagggggtaacatttgagcagggatctaaatataaagtgaacgtgtgacccatgaaacatacagcaggtgcagagaccctgtggttgagacatacttgaggtgtccaggagtaagacatccagtgtggcccacggatatgagtacaggtgagtttaatagataacatctaggaggtagacaggggtcagaggaagttaggacttggaggctgcagaacatatttgggattttaacagtgatgcagaggcattggagggagggttgtaatctgactttaatgatcagataagactgctttgtggagaccaaactgccaaagaacagaagaaacagcaccgaagggcaatgggggggcccttacagctgtccagagaggggtgacaatggcttgggttagtggggtggctgtgggtgagaagtggtcatctttaagctgtattttgatgggagaacaaacaggacatactggcagattagaagtgtacaagctcgagtctgttaaatgtccactccccactcttgttctaagggtctatcagttaattccatggagcaccaaggctttaatccctgaggaaagcaaaccctttatccctgtagtaattgtcccttgttgagggctttgctgaactctccaaggtgtaatagtaacttactgtcatttattgagcaaattatgtgtgctagtatgatatacatacatgcatgtatatgtataatgcatgcatatgtatgataaactatatatgcatgtatatatgtatcacagtagttcaacgaggtgttatccccattttggaaagtgaaaaaaacatacactcaggtccagaaacatttagtagcttgcccagtcacactggagtccatctgatgccaaaacccttcccctgggtcacactgcctccacacacacctttttcttcacccttggaactttggccttctcactccagatggaattctaccttccccagtatgctatcttgctcctatgaaactagtattttgagtcggatgacaaagttgttactatttggaagagacccaagggcactgtatgattctttagcagttgttccactggaattttatttaacttggcttgtccccttcaggcagcaggcatatgtttagttccgtgtgctgggagtactggtgtagttgtggggacagagggagcagatgtcaggtcaggaagcatgttgcgtattagggaagagagggttaaacaggccaagtgtgttctaggttaattcaccagacgtctttttgctgaaagttagtggctgaaaaacaattaacaatatgctagtccctgaaaaccccagacaggttgaaacagttgttttagacacagagtccaagagggtgtgtgtgtgtgtgtgtgtgtgtgtgtgtgtataaagggggtaggtggaggctgggactcactagcaggaagatatgccccttccaccatgccaggacccaccatgcattcccttagcaaatctggggacatgttttcatctcagttcctgatgagtatgggacacaaccatgtggggtgagggtagggtctgcaagaaagccttgagcaaatgaacaatctgcaaaagctgttgaaactgttctctgtggggcaggttgctacccaagttaccaattagaagcaagttcaggggtacaaggaggtgtcaccagcgcctttcatttttctatccccacttctcaacctacacatgctgccagctacattaaaactttaggtaatatttaatatttagaagaagtttcccaattggccattcctctaactgatccttcagcaagtctcatctaattgtcttttctgcattttagtgatttgattattcagcaaagttgtcatgcagtaaattgatttgtggctaattggtccatttccaataaagtgtgatatgtattataatagggaaagtacagggagctaaggggccatataagcaaaggaacttaggaaacatactcccacttattgagaaccttctgtatatgaggcatagtctcaggcttgctgcatgcaataacaataccctataaagtgtgtgcaatcaatttgtgaaaattaaagatgtctagatagtctgaattagcctaagtgggaaagtgctgtatccatgcatgcagaattttaaaaaatggaatggtggttatcaaattctagaagaatgcaccaaagtcacctggagaacttgttacaaatgcagagcctgttttgtcgccttcccctgcccctgagattctgattcataagtccggagagggagcctggaaatctgcattctaacaagttgccccagataattgtaatagaaaagacctcacaccttgggacacactaactgatcaatcagggaccttttctctttgagatagggtctctgtcatccaggctggagagttcagtgcaatagcctgatcttagcttcctgtaatcctggacctcctgggatctagcgatcctcccacttcaccctccctagtagctgggagtacaggcaggtgctaccacacccagctgatatcttaattttttgaagaaatggggtcttgttctattgcccaggctgatctcaaactcctggcctcaagccatcctgcccctttggcctaccaaagtcctgcgagtacaggcacgggcccaccacacccagccaacgttttttgtttcaatggtaaaaagagcacacaataggacttgctaaagttgtgttcacatgtggctgtggagcccttgagatgtggccagtccacaccaggatgagttgtaagtaaaaaatgcatgctggatttccaaaacttagtacaaaaatgatgtaaaatatatcaataattgtgagttacacattgtagtgatgacagtttgaatattctggagaaaataaaaatgagttcaccttttttttttactttttaaaatgttactgtaaaatttaaaatgacatatgtcttgcatgtgtggcttttattatgtttctctcaatcccattttagaaccacatttttcatttggctcaaatgaatattgaaagagtttgtgtgtccccaagaactggtcatttggaggtgggggatgttcaccaggagttaaaatgttgtgacagataatctggacattgtcagtgtcttggtattggattttaacgttgcctcctggtgctaggtgggtgtgttggtgctgtagagggacattccttggggttcagggcccagaacctccctacttctcaacctgcttgttttgtcttaatctttgatctgcttgctttgaggatgggagatgccagtacataagactttggatcatcaatccaattcaggggtagctctgacacatgtacccctggggctttaccgggaagctcactgatcccacataaaatagacgagaggcaatagctgcagtcctctcagtcttaataactgtcacttgtttagtccttaactagtaatcataaccctcctctcaccctcactgtagccttgtacgatgaggatgcaccattatcatctccatttatagatggtataaccaactcaaagagaagaactttgagatagcttagcaagaagtaacagtcagtgtttgactctagaaattctgactgagggatccccagctgctgttcaaccctgcttcatggaagggtattgaaaatctcataagggatacaatttgtttttcctcctatggggtaaagtatagctggggtgccatggtgatttcaaagcacaataaaaattcttagtgattttggtagagcaggagtagacaaacaaaggagaaatgaaatttctaagagaaggatggccttgagctctgcattaaagagaatgtgcctacagctccttttttagaggaggtattctagggcaggagaatttcatcaccaaaagtgggacttacttactgtgtcttctctactccgagagtggctgctattctgctttccctcaaatctgctgttgggtttcagaataggaagaggttttcagaataggaagaggttttgaatggcattggtgggctagagaaaagatgatgtgatctgatttgccatgggtaaatggtctgagtcttttagatgccacagtgttggatttgtgtacgtattatgtatgcatagttctgatgtatgacaggtatccatgggcaaaaaaaagcaagttctgtggcttctcatgtagggtctaaaaagctcagatgtgttccctcctacttctcaggggaggcagggaaatcacgaggttgaaaaatgtgctaagtgatttctgaagttaagcgctttaaagacaagctaaggaagtcagcagcaatgaaactcaaacagagccaagtagagatgactccatgttatcttggagcatttcttccacttctagttttatcatttttggagactttgctgcatttttagtcattttgtaggtcaggggtccccaactggacacacagcaggtggtgagcggggtggggggtgagcaacgcttcctgtttgcagccgccccctctcactcacattcctgcctgagctccacctcctgtctgaccagtggcagcattagattctcatgggagcaccaaccctactgtaaactgtgcatgtgaggcatctaggttgcacactccttttgagaatctaatgcctgatgatctgaagtggaacagttttttttcctgaaactattctccacctccctggtctgtggaaaaactgtcttctacaaaactggtccctggtgccaagaaggccagggacttctcctctaggtgtttagggactggtttagttcctccaacttcagtatcttgagaagctttgaggataagtgagcttggtcatccctatggtcaataaatgtataagtcattgctcaaattaaaactaggagaaggctatagtaaccacagaggagtatttccctaaattcactaactgaccaacagatctgaagtccagaactcagttgacccttgtagagtgaaagtgaacaggaacatttcctagataaaccattgctttctgaatttcccaatacatccaagtagttatgttaatgctttcaggagggtttctccctgttgcagcaaaccagggtgcatggcctgaggttctggaaaccctctcaaatctttctgtagggcagaggtggggtggttggcacctgttgtctctccatgtacctgcatagtgcactgagataacttgtcctttccttgaatggctcttctcctgcaagattaaaatcttggccataattaccccaacattttctcaaatggatgcgcactgggattagcccagaccttacaacctgggattctgcgatttgaaaatggagattttggttgtgtggtaaatatttattggcatgaagataagagactgatcatttcagagatatactgaggtgtcctaagctcggaatttttgaaagatcttctgtgaagtcccatattctgggctacatttctttgtcctttgaagtgagcttttgtctccattctgaccccacagaatccccaagaagctgaggggacctctctgcagttgcagaattgccaagagatttgtcagaagccttcagcctctttcagtaggactgtgagatcttactgttttgctgcattttcatttagtgacgagtatgggatggttgagttggaaaacataaatgcccataacagtttatgattgacaacggattcatttatttctagttggatgagagaaggaagtaaagcagtagctggggcagtgctgcagaactcagaagccatgcgccctccccttctggtcttgttctttcttttcctggccaatattggctgtgactcctttccagcccctgagaattgctgaaagccgagcattttgtccaaacacagaacacttggtctggaatgtatgttccagatgcagttcctccggatgggcaaaagcaacaactcattggtaatgataccagcaacaatgcaaaccaaaggattgtcttcaacacatcatttatttttcatttggaaaagtcctcaaaccccaaaaatgagggcaatgaaataggatgaatatctgagtgggatgagaatcacttcttcctgggtgcaggttaccttctgatgtcccccttcttacctggtgccccagagcaccccaaccaggggggtagacagcagaactgctaaatctcatttgaccctatacagggaagtgaaagagaacatccctttagctagaccatggctctctaaagagcatgcttttagaaccactgaaccacagttggtgccctgttgctatgctgtacggtaagtgtgcgacttgcatggattcatttttccaaatacttaagactatgccttagatataaggataaaggaggcactgtagtccctaattgcattgcagagacccgggccattcattgatccctggtgagacatcccattttgaatgcatactctgcagcccttctctgtgttgggaggggtacaagcccatgcattttcttgctgccatttggctgtttaggatgtctttgctaccttctgaacttcatctgagagctgagcagatttcactcatctttctgctccacaggattcacccagctatctctggggtgagaagcatggggagatgatactaatggaagaataaaaagttcccagggcataaacgctcctcatcaaaatagggagtaaaatatagtgaaattaattagtgttcttactgtggccctataagaaaattatgttaaaaccctggtgtggagtaccaacatgggcccattgtatctcattagcatccagcttgtttcaagtaggtgtacatagtacttcttgctaacgtgtctcagtagagttgataaagcactttaacaaacacgggtttatattcccattcaagaggctgcatacttattcattttgctccaacacaaccttaagttcaagtaagtatatccatttgaactacatctgtaactcataaattagatctcaactccaaaagcatctgtaatttgatcggtagagctgcatgtgattatattagaatggaatttttcaattgcctctgcagaccaaaagtctgggcaaggagggagagattggtttgtgaaatacaatctaagaagccatgtatcataatctcctctatctgtaggtggcttaatatttacctggctttcttgaatgcaccttgagttaggtagggctcagtcagaaaactactgctttacaaatgaggaagatgaggctcagagagcatgctctgtccaagtcatgagagcaaggacatcataaaagcagaactcaaacctggatctttttgccccaagtcctgaatctccaagccctcgggttgcttcccagttttaacttgttgctaaaggtcaaaaagatgaggtctcatgatggttgcaagccatggtgaattagccaggaaagcagtcctcttttatatctttgtttagtttttccctgaaggcttttgatgagttttatggcaacttggccagtgttttgcaaactcacagaaatgatgtaaaaagtgtacactatttctagagtccccagaaagttttcttctgtcttgaagcatcctgaatgtgtctgggagcagctgacccagagtcttcaaaaagcgtatctgaatgggatcataattacaggcatgagtgtctctcccaggccccatttctctctttactcctttgtcttgctgcctcctctctacctgcactgttctagacagtggggatgcaatggcagacaaaatagacactgccccagcctccatggagttctcgttccaggagggtgaaaggtaaatgatcaggtggagtgggaaataagattattagagttgctatacaacatgaaggggtagggatgaagttggaaagtgcccttaaaaataagagcagtcaggctgggtgtggtagctcatgtttgtaatcctagcactttgggaggccaaggcaggcagatcacttgaggttatgagtttgagaccagcctgggcaacatggtgaaatgttgtctacaaaatgcaaaatttagccacgtatggtgatgggcgcctgtaatcccagcaactggggaggctgaggcagaatcgcttgaacccagaaggcagaggttagagtgagccgagatcatgtcactgcactccagccgaggtgacagagcaagactctgtctcaaaagaaaaaaaaaaaaaaaaggcagagagccagagaaagaagcatctcttcatctctctagggaagggacatttgatttgaaacataaaagatgaaagtcaggtggagggtgagcaagtgccaagactaagcagagaatggatttgcatgtgtgcaggaacgatcaagaaagcctgtgtgggccgggcatggtggctcatgcgtgtaatcccagcactttgggaggccgaggcaggaggatcacgaggtcaggagatcaaaaccatcgtggctaacacagtgaagccccatatctactaaaaatagaaaaattagctgggtgtggtggcaggtacctgtagtcccagctattcgggaggctgaggcaggagaatggcatgaacttgagggacggagcttgcagtgagccaagattgtgccactgcactccagccttagcaacagagcaagaccaactcaaaaaaatattaaattttttaaaaatcctatgtgcctggagcacagtaaccaagggaaggaagatgaagattgaaagagggacagaggcagcttattcaagtttggattttattctaggatcaatggaaaactattgaagggttttaagcggggagtcataggattagatttatatttaagtggagagatggacagacttgagagatttgatacatgtaaatagctgctggtttgaaggagcaagagttgaaaaaatgagacaagatttatggctgttgagttggtgttgatgaactagtggcatatattagtgtagtcatcatgtgcatggagtaaagtggacacattgaagatttcttccgaaattactgatggatgggaagtgggcacatggagatcatcatgatctgactgcactactgcccactttggccagggatgcatggtgtggaggatgaccatatagctggtcgtgtcctaacatggcgaccgtaagacctcttcccatcattcctgtggacatcctgggtattgctgtgctctgtctccgggctgtgcttagccagctctgaggacatcagattgctgacgtgcttggcatatctgctgcaaacgtagcactcaagtccacatcttccccaataaccttgtgactaaattgtagtgtcacacaagggcgtgttcagaaattagcatttgaaaagaagcctccttgctttcagtttgagctgacatgatctcttttcctctggggaaatgaaatttattaatcataataaaaccattggattctgaaggtagaggtcaccctgaagagaaaaggaggcagctcatttctgaggagtagttcaatgctgctgtattttccttctgccttggaagagaatactgccaaattgttaccttgggttttccacaaaggttgaaactatgcccagcgttatagaatttaccactgaagtatgcagtaggaaaaggtgggagctacgcttttattaaatacattcaaattgcccatatagtgtctccccagaagaggaaattattgccacagtaaaaccatttccccaatttttaaaataatatatctgaatttgcatcttttcacatttgttttgaggtaacaccttgccataacatcacttaacaaactctcaaggatttcagtttgcctctgcacttcatatcctatttatgaaacagctttgccaaatttaagtaccttaaaaataaccctattaacagatttttctctggaccaatcaatcacagacttcattccctcatgaaataaagagcagtaccaaggttatagttttccttttatgcctgttactatgtacttctagttaagtgggtaaaggcccaggtctcaggagtgagctctctgaatatattattattttatcaaaaactttttaacacatctgcccttggaccgatacctgtttttcctcccagaaagaaggataatcgttgattaaaggccatttttgataagaaggactgaagggtgtccccaaagaatgaaaggcaagagggagatgactgtcagtttcactgacagattcacctcagaagagaggcatcccttcaggtccttgtttgaggatcaggagaatcctcttgaagctgaaagcctcatctagattatttgcactcatcaagtgccctttgacacaggcagatgggcttgagagttggaagatgcccagtgcaaacctggtataatcaattgttttattccacctagggtctaacttggagtctgagaaggtccatcatcacgctttcttcaccttctcagactccatggtgtgaggtggtcaaacatgtattggattggtatcacttatctaccaaccatgagaaagcttggaaggaaaatggggggaaaacaggaaaggagagggaaaaggtacgtgcaaattgggctctaagggatgagagacgagctgaaggttgataatacagacaaaccatttcttccaccagccttgttccttcattcaggaaatggtcaaagaatcaaaaaacgatgtcgatcccagtgagtgtctgatgcattcatgccgagctgctgtgaatgttggttgctaacagtacagctgttcccttctccagaaaattgccccatgtcagaggaagccactttaactcaatggtgcatcactcactcctcaggaaagcccacagctaatgccgaaaacttatgtaggcattaaaaagccaacccacttgcctctaggtggaacctgctgtagcatgaaacccataggatcaggtcgcagatattcatctcagacgttgcgttttttttccccttgctctgacctacttgcccctctcttcctcttgaggacaccccattcggtaagtcacttgcacaggaatctattccagtatcagctttcaaggaaggacgtcagcttcagtcagtattaagatagcagcattcaaactatctccaggaaaatatctggcagggcaaacaagtatgggcacaggatacggtggaccaagcacgcaagttgccctaagagattcaagtatcaggctgagtgcagtgactcacgcctgtaatcctaacactgagaggctgaggctggtagactacttgaaccctggagttttgaaccaacctgagtaacatagcaagactttgtctcccccctcataaaaaatcaagatctgccctgtctagttatgcgaccttgagcaagtgacttcacttgattcctttaaaaaaaaaagttaacttccagatatttagtaggcattcagcacgtttggtttccatctcttctccatttttatcctaaagcctataccagaagccatggcaggtagtaggatggtagagagaaaaacacaaagatgagtaaatgtcattaagatttgttgtttcaaatgcctcccccttcccagaacctggccatggattaatgtgacagaagttctggaataataggatcaaaaccaaatcagtctgattgaatgggaatgggaatgggggtcccacagaccctttaaggctgcttccattcaaatatacttgttcctttccattctaagatgctggacactaacttcagacaggttcacttcaccctttctgattcaccctatttcacttgaatggtgacagctgaatcaggagaaaaaggcactctcttgagaattaaaataccctctgtgggtgctgggcttaatacttgaagttgtttctttcttacctacctcagtctctaaggcagctacttgagcagtgtagaaacagtattatggggggaggcagggaaaagcatatgtaagtacgtgtgtatatatgtatttatctgtcaaacatagcaatagcaaccatgttaaatgcacaaaaaatgtatcatgtacagatgaactcttcttatactacacagcagagtagaatttgcttctcactggaagatgagtagggcccctgcatactgtcttggtattttggattttatgattgttattgttttgtaattgcatactgtggatcaatcttcacctctattttcctttcagttacggacgagtttatgctgccgacccctaccaccacgcacttgctccagcccccacctacggcgttggtgccatggtgagtacaagtttctccttgtcctcactttctcctgcctcccttccctttccccagctgggacctcagtacgggttgacgtcctctcacttcccgttaattgaatttgtctcttgtgctaacagcagctaaaatgccacattaatcctcccagtaaacttgataaatgtcttaatttcttggcaatgtagtgcatgtaagttattatatttctaattttgcaagtctcacctagcagagcacttaccttaatggaataattagtcattttgataattaaatccatcactaacagaatgcagtgtcaatgcagaacttttttttttctttttttttccctcccttgctgctcattcacatagccccaaggttccagccccagcacagacttcagaggagctaagctgcacacttccaggcctctgctgtcaggcagctgagaatctgactgcctctcctcccctattacaattcatgtttaaagtcatagtcgcccaggaaagaaaatagagaggggcacactttgtgtgtgtacctagtacataagaaagtagaaggaatcagctgggtttgggggttgccttttgttttggggcaggtctgggtttttgttttgggagggggtggggggagggtaaaaaatgggaggtaagggtggggtgaacttgcctgtacttgttcaaacttctatgcactgaaactcttgagtacagtaagacgtgcccatcacgtgagagcatatgcaatcattacaaagctttggcatgcagttttctgcttggatcaagaatatcagtccttaccctaaaaatgaatccccataggcattcatttgaattgccaatacttttagaaaaaggaaatcgttaagtgccaccttgtagccattaaaaccatggccggacagttcactgaagctcagtcatagaaattcagccatgatttggaagcattgttttgcacaagcttaattacatcaagcaattcatctgtacaactccacaactcccttctcaagatcagattccatacagcttacagagccaagttaagtaagaagtaggttgagattttcatcccaattctgcattcaacaactctgcttcaacacctagtccacatgaggaatgtgttggagagttgaattacattcaacaactggtccaaattcaacctcaagtgcagattattctgttataaaaaaatgagacagtgaaaatccttccattgtccagcttataatagagtccttttagctaagaggactggctgacagaatttggttttgcagggaatttctttaggaggagctattggggaaggtcaggaatggccctatctttagttctccaagaatgacctgggatgggtagggggtgcctccatttcggttggttttgagtgtctatttttcacattagtctttttgatgatccacatgttgcaaaaggaaaatgtaaaaaacacacccctcaaattgctttgtttcagaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaattacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctatttgggaagagtgtaagtgactacagtagtcatttttttctgcacctgcattattttattttgcgaaaggggaggttgggaggggcttaggggattggaactggggtttggctgaaagaaaaaaaaaaaaatgtaactgatgaatctaaacgacccactgcaccaacaatcatttatcaatggttctaagttactcattgccagttcaagccaaaggtcatgttgttaagggggtgcttctagtagcacttgtgcatctgagttgaatgaagctgtgcaaacccaccctttaaaccattccacccggcagtattcagcttcttaaccagtcgctatttaggaaaaaaaacccactagttaggccatcaacaagcattctttttatatttcttccagtataataaattattgatatcactgctgacttttatattatgggagggaaaaaataacattaataaaaaggtgataaaaaagcactgtttctatttttttctttttttccaaaaaaagaaagtaataaaaacttaaattctttgtaccagttaaaaaaaatgtataaaatttacatctgtgcagtggagttgttaagttctagaaacagtctatgaagctttagttttagcctagtagaacaactgttagagacagacgtataatttttatggaattacatgataatcatattcggatttatagaagcattttacaagtattgcaatcattgagtagagataatcatggtattttcatcagcttggtactttttgaaacgtgactgcgttgtgtgaacaatctgcaatttttcagtccgtgagatcctgcccttccacctctttcccatacccccaaggattatctcaaaatgatctctttagttctgtctccaaggcccaggacacttgtcagaaggatgcaaaaaaagaaaaaagtacatccaccctcttaatcccaaaagaacaaagtctccccacctttctcggatgcagggccagagtgacacagccgaaaaattgcagtttgtctgtacttctgtttgaactttccacgttgtcctgtttacaagttaacttaagttggggtatccgtcacgggtcttcctgttttgtatttaaataaaaacaacagcagcaggctgtccctgagtagttttgctgccataggttaagtcctcatgtgtacagtgcaggccctgtggcccgcacttcagtaagttatcaactctcaccgctgtgaacctgccaatccgctgtaacaactctgctttaaaacaaaaccaaacaaaactttaaaaaaaaatgtgtgatccagctttctcttgccatcctatgtgcatgccgtaagatcagttggatattaaaccatcaataaagtttcacaagatttgaaaacaaagtttctgtagcttcgatacctaagacagacgatagtgatcttgaaaagagaaaagggggaggggggagctacttatcagccaaaagcatataaagtgttcttttcaccagacttctttgggtgggtgaggggaggggcaagagggtgttttatagcatcactaagacattctcattcccccacctggaaaacagtgttatggcaatgggtgcctggttgatgttcttaaaggaaacgaattattaaaacactatgacatcctccagagggaagaaagagtaggagcagggggctatggagaataaatttctcccaattgccgcctcagatttcaaaatccagaatttgtattgtgtttcgaatcacaaacatagaattcttactgtgttggttaaagtaaaattcatttgcagttttgattttcatcaatgagctgtactttcccccatgactgtatgtagttttaataaaatcatttagagtgagtgagtgccaaccgatgttgcagaatcttttgtctaggcactccaagatgccaataagtcattttaaaatgtatgtcagagatgtaaacaaacattttggattttttttaaacagtatttatttggaatgttttcatttatctaaataactattgctattatgaattatggaaaattaatattatgtgtggcatatagtgacttcttaacacacacatcacgcaatctgcaaacccagaaaatgtgtatatctgtctttagaaattagtgtttatatcacttacagtggtttgtgaataaagaaaactggtttgtaatatcaaaaaaataaaagcttagtctgaaaagg

SEQ ID NO: 346 - DNA, 1694209 bp, Homo sapiens; identical to SEQ ID NO: 345
